United States Patent 8,153,369 (ASSESSMENT OF RISK FOR COLORECTAL CANCER) - sequence listing, part 2

SEQ ID NO: 1763 - DNA, 883278 bp, Homo sapiens
  DPYD gene - 97255323 - 98098600 of chr1; NCBI Entrez Gene ID: 1806; Build 35; sequence includes 20,000 bases upstream of initiation codon and 20,000 bases downstream of termination codon of the gene
aactatagattcagtgaacagaccggtggttgccaagggttccaggagagggcaggtttaaatagaaaaaatacagcggatattttgggcaagaaacttttctgtatgctattataatggtgcatacatattaaatggtatggcatacatattaaatggtgcatacatattaaatggtgcatatatattaaatgcaatttaatttgacaattaaattgtcaaaacccatagaactttatagcaccaacagtaaagcttaacacatgtaaattaaaacaaaatcatataggagattaagaaatcccatgatggaaggcaacgtgtgacagaagaatctaactctactacaagtggatgaaataacctcactgaagaaagtagggagaaaggtactgatggaagcaactccagaagtttgtggagtccacaaagctagtgacaaaagacatggtacctaagcaatgtagtatagttgacaaagttgtttcccgcagggttatggcttaacaattctgacactaccatacatatacactggaactgaagaattaagtaaatggatggtggaagccaggtttctcactgttggagtgggaagttacaaaaacactaggggtggttagaatgatcaatgtagcaatgggttaaagttagagacattagtatgaactcatgtttaatttagcacattatttaatttcctctatatattacagcagattacggaaatatttacagataaatgtgcatacaagggttagtatacataaatttgtttttgctctgtcagctgagaagacctagaaaaatgacactccaatagcaataagcacacctagtgcccagatctttgtttctaatgtacatttctccaattgaaggaagcaagttacctgggaaaatggttgattccaaaactgaggctaggaatatacaagataagcttggggcatattgtagtgccaaaaagtaaggaagtgttaaaacacacatacacacacagagacacaaacacagacacataatgatgagtgaaggaggcatatcaaagggacactggagccaaatgaaaaagctctcaatgtcaaatgctggaaaaatttgagcaacaataaaaaaaaaagtagtgtggattataactcaaagtataaaaaaaatccatcagtccatattaatataaataaataattgaataagtaaataaataggggagaataaacagagctttcatgcagaattccaaataatctatgtaggtacttggctataaggagggggagcataacttcccatcctctgtccctactacctatccaaaccctacctttttttcaaagcacaaatcaaactctacttattttatattattctccaatctggtcactcctccctaccaccactgatctttcttattattattttttctttttttgagacagagtctgactctgtcacccaagctggactacaatggcatgatcttggctcactgcaacctccacctcctgggttcaggtgattctcctgcctcagcctcccgagtagctgggattacaggcacgcaccaccacacccagctaaattttttctatttttagtggagacagggttttgccatgttgtctaggctggtcttgaactcctgagctcagggaatccacccgtcttggcctccctaactgctaggattacaggcatgagccactgcgccccgctgatctttcttatttctaatgattatatgtggtcttctcataagggacttcattctaaaaaatacactatgaaaagaaatagaagaagagagtaattttacagtggagaaacctgacaaacaatatctcagccaggtgaacaaatttaatatcaacagtgataagtcatattgctagcacacacttgtattatgatgggataaaaatggaagtttccttctgaagtcttcatcctaaaaatctttagccaatctaatcattaagaaataccagacaaatctaattaagggattctacaaaatatctgactagtactactcaaaggtcatcaaaaacaaggacaatctgagaaactgccacagtgaaaaggaacctaaagagacatgtccagtaaatgtagtatggtacactggtgggatcctgcacgagtgaaaactattaggtaaaagccaaggaaacctgagtaaggtaggaacttagttaatgataatggactaacattggatcatgaatgtaatattcgtaccatactaatgtaagaaggtacaataatggaaactgagtgtgagatgaataggacctctctgtactatcttcgaaacttttctctatatctaaaactattctaaaattaaaagtctgttaaaagtagagggatcgtctagggattatacactgtcactattaaactttactcttccactgcattttccactcattcactggtcattccactctaacattttatgatggctgtggctcccgtggaagatgaacttcctcttttcctggcttagttgtgagagacactcgccaagatccttgaaacagcgaaattgagtgctaagtctttacagggacccacagaggcttctccttctatgaacctacatattcagggggcctctactctgtggaacttgtacttcctttttcttttcctctccttcccatttcccaatcaggaaactctctcattaaccctacccactccaactgcctcccaaaacataaaccctccactatcctggtcctgttctctctcataaagtggattaatgtctcaagaagaagtgcttattgggttgcaaaactatccacaaaaatgaaaaaataatctattcatctgtctttgcttgatgggcagcatgattaaaaaatgactcattagaaacacagtggcaagtcttccttcttggaaactggatgtagaaagggagggaattacatttacaactagtgagtcaccttcctccaatgacagacaaaatggctcttctaaagccacagctaaccaacaaatgagcatacaaataataatcccctatcccatcaccaccacctctaaaatacattttaaaaatgtatttctgggaacacctaagcctccaggtaaaatactaagttaagaatatgattgggatgcatattattaaagaagaattttggctctgggattgcaaataaacactggatagtcaggttttattagataatatagttgcatggtgcagaagatgaccaccttacccacaggaaacctgagtagttagtcagcaggtttggcaatttctccaagaaaggacttattagtttggtaggcagcattatctctttcaatgtgaacaacaacaacaaatacacacacacacacacacacacacacacacacacacacacacacacatttacatacacaaacatatatatgtatctctttcatagaatgatattttgatgaaaggtatgcatttttcaactttttttcctcatttttgcctctactcagtcagcgggattatagcttcagctgagagttattaaaacagaagacaagttttagaaaagtcaaattttagcctcttgatttcaaaacctgaagttacggtacattgtaagatttgggagaatatgcaatcagccaatttctacacttcctatcctccctatcaagggaaaaaaactagtcactactgggactctgagaaaagaatctgagccctgatgttttacatccccttgccagcaccccatctttgacacattcagagcagaatatgaggcccacactggcacagcagcaactgagagagaacacaacgctttgagagtcttttctttaggaaacagaagcttcttgtactcatgcagatggaccagcgaatagaatgggtgatgctcatctcatcagtcaccacactggaacatgcaaatgactagggcccaggtgcctcactctcctgcctgaaatatgggcactttgctaccccctaaatttagaagaaactctaggtgaatgggagaagaagtattagattggctgagattttgttttgccacttggctgattgaggattcaaaatagaaattaacttttattatagaacacgtaagttatattttgagtgaacctaagtctgaagtctaaaggctagtaactattacagatttattaacacttgaaaaaaggaaggatgcctttctttataccccgaactttgagaaaacactgctaaatataaaactgagggacatctatttaagaaagaaattgaggagggttaattacataaaatatcccatgtgttcctttacagtctgcacaccccttacaattaggcactgtaatgcaacttgttctggccattgaactatgagtagaagtgacatatgtcatttcttatttaagtattttactttgaggtgagaaatttctgcatctttataaccacttggactgaggaggccatatgttcctgaaggtataatcaaaagaaattgcaacctctggcagctcaagtccctgtgtatctgtatagagcagaagctttctaccagcccacatgggatatgtaacgtgagcaagacatacacctttgtcgcattaagcctctgaaatttctggagtgatttgttattgtagcataacctagcctacacatattaatattttagggaacatccaaaatttagaataatatgaatctactaaaaatcacatttcaagttaagtaaaaaagataacaaatcaaaatttccataaattgatataaattcaaatgttgatagtacaattatgagtattttgtattttcccctttaatgttttgtgttttatgattttatcacatattcagaaaaaaatgtgaatgaaagtgatcacatatttcttaaaacttcattactagaaaaccaggatgtgtactgcatacggtcttaggtactgtaataggaggtaggaaaaatttttctttcaattttaaaccaaggggttcaaacctcacatccctgaaagctactaccctaactctgtccttattagtccttcgattcttctttaggattgcaacactgtggcaattgaaaataaaaggaataacaagatcccacaattttatcagaacatcaaatcaaagccacatgcatttatttgttgaacatttattcagtgtaccatgaggtgtcatgcgatgtcaaggacgaacaagaagtgcatatatcaattactggaatattacactcaaaatctgacctagtaacaaaagacttaaacaagcaagaattggtgtacaatagcatataaacagccttccttttttccactatatatgataaagcactgagttgaatgcacaaacataatattttcttgcagcaaatttgatgtattgtgacagaatctcaggctaggtctttaatgtgcctaactaggtagtgtcttgggtcaaggaacttaaactcctagaggcccattctcctgaactgtaaaataagcataataatatcttctggattgataattaagtatcatatgagtatgtataatgtatatcatgcacttaaaggagtgtgtggcataacataatctctcaataaatggtggctatttttgttactcagtctcatcgttttactcatggggaaaaaaacatgcaagttcaaggttggaaattacacaaaggcataaagctaaattaacttacagtatacttgaaaaatagtattagatgcaccaagtacctcaataaacatatgaaagtaatatatgtaggaaattggttgtgaaaggtaatcgctatttaattattttccaaccagaatgcacacttaacacctaggtgttttgttttgttttgagacagggtcttgctctatcacccaggctgaagtgcagtggtgatcatagctcactgaagcctggaactcctggggttaaacaattctcctgcctcagtctctccagtggttaggaatacaggcatgcaccaccacacctggtttatttatttattttttctaatttttagtagagacaggtctcactatgttgtcccagctggtcttgaattcctggacaatcctcccatctcagcctctcaaagtgctgggattacagatgtgagctaccatgcccagctgcacttaacacgttttgatctcgactaacgcctggcactttctatccactttctcatccgtccattttattgtctcatgtgggtaggacttacttccgtatacgttttttgtacccttcttggcatagggtgctagtccagcaagttaggataggtggtggccaaagatggataccagcactgcaggttgttagcaggtggtgtttctagggtgagcagccagagatttcagggtgaggagcaggatatggtttcatatgatgtggttaattaactgagatgaaagctggaaaaagaaaaaatgaagagagaataaggactgaggagtttcaaaagagttatggggacattgatatttattcttctggctaccacagtgtcctcctacctaccaatccttccagcactattgaccttattacttagttgcactggtattatatctaatttcaggtcgttggtaccaaccaagttcaggaatgatagaaatctaccagtaacaggaataactgggagaagtttcatggagagggagaaggaatgcattagataatttaaaggactagattaagtatagagaaaaaaaaatggagagaatctaggtgagtgagggcaacagcatgagaaaatgaagattgggggaaaggagactggcttgtgcttggggtaacgaagatactgcattaactttgttcttattagtccttctattctcctctaggattgtcaacactgtggcaattgaaaataacaggaataactgttttatgacaaatggacctgaaccctatgaaatgaatttgcaagcactggcacagttaacatatgctacaaacaaccatcttcagacagtgtagcgaaccaactgtgccagacttaaactgacgaccctgaggtgaatcgttctattgccacaacatttctgatcttcaaggctctccatgctcctaaactcttttctttaatattctacagtgtgtttattttcacggctataaagtcatactcagatttgcaatgatatttactaccatatttcagagtgttttaactgatgttagttcaaatcaattctggagaaactttccagccaagggaattgcaagctagctggttgacattggaggtcaaatactccagggtatgggtctcaaatcacttaattcttcacagcaaattagaaacgggactccagctggtgctaaagaataagacagacttgctgtataaggacaagctgctgcttggatttcgagtctttatattcctaaaataaaaaatgtgagacccaattcccaccccccaatctcattctttcagagtaaaagatttcttaacaacagcaaaaatctggccacctgatttcaatacataaatcttgccaagttataaaaataaaatatgatttaaacagcaacctgtaatctcctgttgacgaccagctgtgcctcctattagtattaatggaagttacacaggcataataagaaggaggggaaaatgccaccttatgctttttgcacaccttaacatttttatagcaagtctgattacaagggtttacttgagcggcaattaaacaatgattgattactcagtacaatttgtattccaggcaacatgcaaatggtaatgaaattctcagataaggaatggaataaattcttctcacatcagagaatcacatctttttaacagaaaacgttttcttatatggagagaagaacttcagtataagtttcttaaataatacatgtttacccaaagacaataagccttgatttggatttagaaaggaatggtaatgatttttgcaaattgtacttcccacttcacctttagactacggctctctttccatgatgacaaactatatggatggaaagtataatattcactcacaaatatattgacttcaactatagtcacaactataaacaatatttttcatattttgacattgcagaaataatatctacttttaaattgaaagtgaagtgaaaggtttatttattaagtgtctatcatgtgccaggcaccattctaggtgtaggcaacacagcaaagaacacacaatactcatggtagagaagaagaaactgacaatatacaagtatacagatatagatacaaagtcagcgtatatagaataaagaaaacgatcgggagaaactgatgggcattgatgtgtatatgtacccattcatattcaggggaaaatgatggaaagggaagtcgatgactttgcacttgctttttcctacttaaggaagatcctgatccaacatcattgaatagttgcctgctgtgtaccattttgatattcatccaagtacaaataatagaaagagcttagaattaatatgctggataaatagtaaagccacagtggctgacgtggtataagctggagtaaaatggagatgacatgagatcacagatacacagaggtatagtcattgtaggccaatgtaagtaatgtgtgctttactttaattttaatgagaatccattgataggttaacaggggagtgttatgatgtaaatatgtttttcaaccatcaatctaattgctgtatgtatgttatgggatataatagaaatgtgacctaccttgaaatctgcatttttcctgaagaactggctaatacattaccattttcacttattgaaaatttaacgtaaaagagaaattgcagttaatatcttatagtcaggtatgtttaaaaataaaaatcagaaatcgctcctgctttaaggtactattatcataaaaggcagggatatgtgaaaggaaagagaagaaaaagttatgatgtctataaaaacaaaacattagaaaagactattaaggatcacattgtccatcaggttgctttttgcagctgggataaatggctgtttatgttctttgttcagatttccaggataaagacttcatatcatccctggtagtccacgctaatattttatctttgacataaagaagttattttttatatccaattacattgtctcaatttattaaacctatttcatgacctgatgtcaaaatagaaaacaactgctcactattctgataaaaactatttgaatacaataatttattcaagcttagccagctttgtcttctctaagctaaagaatctgaaactcttttatcattccctatttttatcactttagtcaaatttttcttatgcccagaaaaatctactttaaagtatgaattgcttcttgtatcaaagcacatacaagttgattagaaatttatgttctatgtttagcaatttagcttagttaaaatgatgagaggaagatgacaaagtatttaacacattatatttctgtcaaaatctgtgatacaactcatcgcgtaggcatggatttactatgcgtaacaattacaactatacatatttatttaggatgtggatgatacctgtaatatatttagtcatatataataggtatatacatatgtttgtttcgtactctaacaaggaaaaaccatgaaatagatattatcattctttaatcaggattctcataggtcacagattagactagaatagaacagcaaaataggaaaattctgtgagggaacacattactctatttcaaggcagacatgtaaaatagaaggtattgagtgaaggagtcctgggcaagaatccaagatctgccacccattagtcttgtgaagatacagcattaacattgtgaagcctcgattttcttaattatatgataattaatatacaatgtctaataaattgcttagcaaaataggaactctaaatgttagttccatgaataaaaccaaaataaaatccatttggacgtttataaaaccaaaaaaagctgtttataaagtatactgcatttaaaataaataaataaaattcacgatattgtggtggtgtttcaataactcctacctaccacccccaagaaagaaattaggtatctgaaactccaatacaatacataagtgtcagtttctacatttttaatttcagattattgtggtaattaaataaaagatcatgtgtaatgtcctgggcatacagtagatgatcaataaagtcagctatttttattagctctaagtaaaattaatgattaagcatgcatggttcaacagaggatgcaacacagcaatcaatggtagttaaagctagtacagatgggaaggtggctctgtccatatactctagtcattcattacccaggaacaacaagtgtgggccaggaaaatctttccctagaacaatagtggatgccaagatcctaaccactcaatacaatctcccagaaagaaacatttggtggcctttaaatagaaagtatcatgccaaaagaatgtttttggttctatactttttaatctccaaattgaaaatagttaaattgaaaaatgtttctcatttttcttcttattatattcttcagggggtcaaagttaatcttgaaatatgttaatgctgttacatcctaaggtgctgctgggttggaagatgggcaaaaaaattaaaaaatgtataaagcctttaagaaacaaacgtgtgtgtgacacagatggctggaataaattatgggactcaaaaagcggttcaatttgcttagttttaaaatccatttggacatttatcaaagttcacattgtgaaatgtatttgtgctacttggaagagtgatagtaatcagcacccgcaacaccaacccccagaaaagaaaaataaataaaaaaaggaaaaatctataagctcttttcattgaagcctaaaacaagatagttgaattaatgaatctagtgatgactcattttaagcaacaattggaaaaagtatgatggatgatttaaaatatacatacagacatacatgtatatatctatatatacacaacacatacaatggcataagcacgtaatatatcggttcttccaaaagattgtcaaaatactttcagaatggttattctgtttaagacacaaagtaccaaataatctttcccttaaattctgcaaataagatgtgaatattctttaaaatttaataaaatttttaataaatggagaagaaactgctcagaatatttgaaacaacaaaacaaattaaactatttgaacatgttgaaggaaagatacaaggaaatgggaaatattttcaaatttattggaaataccaaggtcctttgcacaaatgactgtatttatcaaatattgtcaagtgagttgttaagacaagaatgagaaatgtgtttcagagcaagctcttagcttagagtttctctgattgacaaacatgataaatttcaatttttgaatacctaaagatgcaccgaggtgggtgcttttgggaaagtacacaaacatgatgatttttattccatttgcttgttcaatcaacatatatttagagcacatctacttaaatccagacactgtctaaactgagtgattcaaagattagtaaggtgtagtccttgcctttgaacagttctgtctggtggatgagacagacacataaatgtagaatattaaatgctaatacataagtatgaaaagagactataacctacaatctgtttcatgagttttttcaaaaacatttattgagcatctacaatatgctaggcactggttcagacactgatgatacagcagtgaacaaaacagcctcagggaacttacattctattaggagaaggcaggcaatgagcgcacgcatcactaaaacaaatagaatgtcatttgtattctattgctagggagaaaaataaaataggaaaaggggggtagtgaatgtgagaaatgtgagctgcaattttaaatatggtattcgagaagaccttactgagaaggtggtcattatgcaagtgcttgaagctgatgaagggctatctgttgaaatacctagtgtggaatatcaatgcagacagagggaagagcaagtggaaaaatctctgtgggtggagttggagtaaacaagaatagcaggaatgagaaggagagaagaaacaaaaagctagatatatacatacatgtcttgcaggccattgtacaatttttctactgagtgaaatgggaagacataatgggtttggagtgagagactgacaggattgctgtttcatagattaaataaatcaaaacattcaaacaactatcttataataggacattctccacatatttagattattttgcctagttaaagcttaaggagtttgtgctacttgccaatttctataactcttaaaaataatttgctccagactgatgataattattttgctaataatggactatagattatagacaaatttggtattcagcttttcatgtaaaacacttcatataaaaaaattacagaatacctaatatgtatcaagggtgggagtaatgaggtttttaccctgcatgcacaaacatacacatttataaaaggtttttgtattggtctatctgctcagagtgcaatggagcttgtaaaataacttttacttttttgtataattaactaatatgtgtttgttacttgtccatgaatatttagatcttatatcatgttattcgatttattgatatatattctttatatatatatttatatatataattacccatgtttttttctgttaatattcttctacaacatcatttctaatgcctgcataaagttgaattatgaattcaccagattaatgtcagttatttatgtattttttattgagatggagtctcactctgttgccaagctggagtgcagtggagcaatctcggctcactgtaacctccacctccggggttcaagcaattctcctgcctcagcctcctgagtagctgagactacaggcacgcagcaccacgcccagctaatttttgtatttttagtagagacagggttttaccatgttggccaggatggtctcgatctcttgacctcatgatctgcctgccttggcctcccaaagtgcgggaattacaggtatgagccaccgtgcccggccaatgtcagttattaataatcagttatctatcagtcacctgttatagggcatatatgctattttatttttgcatgaacaacttcagaatgaacatatttttggatacatcttgcaaaaagaatattgttttcttaaaaaaatcagaaataaagttgatgactcagagaaagcacatatttaccgtttggctattgctatggtttaaatgtttgtgtcctcccaaaatttacatgttaaaacctaatcaccaatgtgaggatattatgaggtgggccctttgaggggtgattagatcatgagggcagaactttcataaatgggattagtgcccttattaaagcaacctggagagttgcattgtcccttctgccatctgaggacacagcgagaaggcatcatccatgaaccggagggtgggtgctcgccagacaccaaatttgccaatgttttaatcttggacttcccaacctccagaatcgggagcagtaaatgtctgtttataagctaaccacttcatggtatttagttatggcagccaaatagactaagaaagctatgtattgctcaactgccctgcctatatactatactaagtttttactcattatggaatcttacgaacctgttaattttattgcaccttcatttccttaaaaaatctttgccagtttgatgtgtgaaaaactctatgtcattataattttttgacattgctttgattactgattgggttgactcaattttcacattttcattaactgcttgtattcccttttttgtgagttggccattgatgccctttatctatttgtatatcactggaaatcttttccccttaggctttctatactctctgctatgtggaaaaagagtaatgctaaataatgatctgcaatgaagttttaagataaaaatatgatagttattcataatatttatttacctgctatgtactaggtactatgttaggcatggaggataaaaagataagacccattaaaaattatcaaggatcttacagtgtaggggtagtgtaggggtaggggtagtggaaatcatgaaaacaaactgcagaacaagaacagcacatcgttcattattcagatgattaaaaattgatgattataattttatgtaggaaaacagaatgagagccagtgactgagagagggaaatccttctggagtgtaggtttttctttctggcctctgattaaaaacagagatctgccttttaagtgccacaacatgctaaattgcaacggtgttaatatatggtagaaatgtactattttggtttctaatggcacttatgattaccacccaggctagcatgcacaggaaatgactgagcccatctccagaaatcacttgccttggttgattttcacacattcaaccaagtgagtatatgaatatgcaattacacatacattgcaatcagagtaatacttcaaaatacacacttgatcataccattcttctactttaaaaaactttcatggcttcccatttcttatagaatgaagttcaaaaccctaaacaaagactaaataaaacatggcatgcttatcttgcagcttcaccctgggtcactctcccactagttgcttaaactccagccatcagggccttctttccctgttggatatctctgaccctggagcttttacactttgctctcctttcccggaagtcttttaataacctccttttgcctttttaactcttacgttgtcctttaggtctcagcagtaaggccattacctcaaggactccattgatttctcagggccctctactataacagccttttgtttttcattgatgttgccatttgcagtaaatatatttttgtgtgattattttgcaaatgtccatctccctaactaatctgcaaagcgcaggagaataagagttcacttttattttgctcatcacggtacctctagtgttttccactgaacctagcatgtgttcggcacataattatcagtgataagaatgaatgaacaaatacagaaacatctcagaacaatgaaataaatgatgagatttaaaaatatgggttaatttttatgtccaggcatgatgataattaagcatgtacattttacatgcagtatagaccatttgttaattaatatacagaggtaacaatgcagcttaggttcactaggaagcagactttgcaatagaaatgtgtgtgcaggaagtatattcattattcagtgctgtctgtatgaggcccagtgagagcaaggaaatgaagcaggatgggcaaagggagaagctgaactctacagacgtcccaacttatgtcccagctaatcccttgagggacctctgaaggtgggatggcccctaaaaggtgtcttgaattgaggcaagggcccagcctttaaattcccacatcaactgtcattggatatctgctaccccaggaaagggcttgaacttccagtgagatgtctctcttagccaggggcaatttccagagagggactcagcagacagctgtcaaccactaacattcccaggagctgagagaatgagtgcctcagttttgaatgggttgggggatgggtggtgatctgtgaagcacatcataacatctgctacagataaccaaaagggaaaatacatactttaaggcaaggatatgaagaacttgctcaaatgtaaatgaactagaaattataaaacaataaaattccagcaataaaacaagaaaccactttaaatgccagttcttggaattgtgacaatattagatggtgagaggaaaccaacaaggccaaggaaaagacccctaagtagtaaggcaaattatttcaggggacattcattctaaaggatgttttcccccactttaagttagataagtctataaactttccccttacactgcattttacccaaaatctttcataggcaatcatgcattaatgacatttttctagaacgtgggaacgtgggcattgaaagattatatctttaaatttgtaatatttaatttatatgacactgttcaatttacaaaatactattgcatatattttgacatctgactctcatagtaatccattcagttaaaccactcatttaaaatcactaagcggcaatttttgtttttcatttagtggctaaaggtttgtggtaacagagacaatgtctctattgtccactgagatgtcactaatgcttatgacagtgtctgaaacaattgtactcaataaataattgctaaataaatttatgggagaggtttgtagtttctctgtgttatctgtgctttttatggcatttacataatacatgctgatatactgcatatctatatatgcaatatgatagacatgtagttgagcacattatactgtttgttccatgaaatatgaaccaacgtattccttttggtctttttaacaggaatgctggaaatatttgggcctaactgatctttagtcattatcctactggtcaatatgggtaggaattaatttggcccttgaaaatcagacagcggaaaaaatgcacctcatgatcattcagcctctgactttttgggaggaaatcattttcaaagaaatgtcccccaccaaaaaaaatctcttaatgctacactgcaaagggaaaataaaggcatatggaaatctgaatttttgttgtgtttctaaatttgtaatattgaataactttttagatgtgaaattaaagatgactcataagtcctacttctgactttggtagtaataatattcatttatgtactgtaaactattaggttcaaacataagctgtttctccaaagcctacaaaaaattaatgtggaacacctgatatttcactgtgcttccagatggagggacagcttgacaaacgccatcataatttacaacttttaaaaagtgtggtgcaaatgcatttgcagtaaaagctttaaacagcttgcattatttacaggtacaactgtgcttaatgtgcaatttcaatgaatttaaaatattattagattaaatcactgatcacagagcataggtgtggcacgtgagcaatgtgattagatgccttaattaatatgtcagaacaggatacatctgtttgatgaagttgggggggatggtaaatagcatttaaattttatatttgattattgactatcaccgatgaaactcttatctttggaaaaccaccgtatattggacttatcctctatagttgtttaggagaattataacagaaaacgaatatgaaaatacactgtataactcttaaagataacttggattcttgtacacataaattaactatcaattgctaactgataagatgtatgttaaagtgtaacctgaaagagcaataagcctgtatccctgtaagttaggaaattgaacattgaacctgactgattaaattggggaagaaatcatatgtattataattatatatattatatttgtaaatttatatatgtttatatgtgtatatcttttctcaatatatacatatgtgtgtatatgtatgtatgtatttgggtgtttatatgtgtatttatatatatagactgatagaaaaatagatatagatagatttatctatctctctatatctccaagaggatctagagtaagtgggtaaggtgtggttgtagggagatgcaggaacatctgactttggaacattactccatgaaaagataagtagttattttgacccattttaactacaaattcattgatagatattgtgacctatttctcagcagtaagtaggacaatgagaatatgtgatgcagagaaactaaagtttctaaaatgaactgcccagtgtataaacgaatgtactctgttcattcaatcaccaagtgttcttggtctcttatgcttcagtcctgagctaggaactgagtatccagtaaacaataaaagtacacatgggccccctcttcctggagcttcctctctaaatagaagacatatattaaatgaatcacattcaaataaatatttaaacaacatttgaaaagtctatgaagacgaaatataatgaaaaagacagagtgggtgtaattttgttggtgatggggttagatcataaaggcttcagtgagacctaaatgatgagtagaaggggaagaagagctccaagtggagggcaatgtgcaaaggtagagaagtggatggaggatgagaagattaccttgtggttggaacataatgagtcagggcaagagtggcggagaagcggagtagagcaggttattcagcggttactagggagtttgtattatattctgactgcaatggaccattgaaggatttataccatgggtacctgggtgtgtggatgtatcgttgtatggcatgagccagttaatactttctaaagctcaatctggtatggatatgaggtaagaatagaagctagaataccagtagcttggaccatggtggatgcagcaaaatggagaaatgaatgattcaaaatctatttaggaggttgacttctgagagtttgggcatagattaaatgaggcaataaggataaaggagtcaaagatgattctaaggtttccatttaactttctagtgtctgttaatatttgattcaagaaaaatgtatctgtcttttagtaatttccaggttctggaaggtaatctgatggtttgttcagagaagccttctcaaccacgcaaggtacccataccctagttattctgtcctatttttcttttatcttacaagcaggcatcacattttcttacttgcttattttgagtataatctccatgacagtgatgtgtattcttgaagactatatccggagaacctagcacagtgtctgtgtctggcatattgaaaatgctcaataaacatattcgttgaataaaacgatgaatggactaatgaaaaaataataagggagaaatacttgactccaaggtgtcactacctagccaagtgcatgaaggagtgccgcaaatgtcctaacggaagtagaaagtgttatggtagaagagaggtgggatgcatctaacaggggtggggggggggcggggagaaaaggagagaggtctggagtacacatatcctcaaaaaacgaggtgaatgttttctggattgggaccaactctacaggaaatctctcccttctcctcagcaagctctagagcaaaaacgaagagcaacttttcaaaagagtttcacgttttagaataaaaaatatttaaaaaaataaccattaaaatgagactttcctgcaaaaagacaaccttgattatgtaccacctgcagcacttcctgtatgctgctgcgggctgtggatgtttttgctcgcctccctcccctccccgctggggctgtgaactctcagaagaccggtgctttggtatcctccactgcagctcaaaccccgcccacctacttggtggatggatggaggaacatctactatttcatccttgaggagttcctgaaaatgcagttgcccctcaaacaatgtatctacatctcgcggggtttctgtggaagaaaagaaaaagtgcaagttgttgcttggagcgcggactgcttttacctttgcctggggatccctcctatctggccccgcctgcctagctctgtttttagcagtttagagattaaaggccagtccccagagcgggtgctctactccctccctcccttctgcttgcaggctggggcgcggagcgggctgaactgggaaggccgggctgcggctgccgtgcctggcgcgggagccgcaggaccgagagcgcagccccgccccgggggcgttgccgccccgcgcccgctccgcccccgcgccgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgaggtacggacttcgcgccggctcgtcggtggtggcggggtggtggggagtgctctgcgggtaggtgccggggaggcccccgcggcccccgcaccccggagagtgagagacgcgggaaagtttcccccgtgggagctctgcgggggagcggaggagcgcggagccacaggcccgcgtgggcaggcggggagctcaggggaggactttccgctactggaggggttgccctttgcgtcgggacctgtttacttcggaagagatttcaggaagcctgtcttgtcctcctctgaatgtcagtgactgaagaagcactggagttccagagaggtggactctagggggtaggagtgcccatttcccacacgttctaccccttcacctcctgtatgtcgtttctggacacctccactgcccccatttccaatagctgaatcctgctatttgcaaaggtgaagcatagaaataaaacatctgtgtgtcagctgtagcagtcgcctctagtcatagtattgtttatgaaataatttaacatggagagaatggaacgaagtattcagaacatgaaaaatgcagtgccctcagaaaaactaactgtatttttctctcctctcaacggtttttgattccctcttgcactccgtttctgttaaaaaaaatctttttttatgtaaataaggtcctacctgaaacgacatggcatttcctttctctctagtatcttaatatatgcgatgaaaaggatttaattatcaacagtgattttacacatactaaacctaggtcagcacttttgagctaagacaaactgatttttagttttctgttttgtttggggcttttctttatttgagtcttctactctggtagaaaattatgtgtgtgtgtgttttctttagaaataacaaaattttcctttcgtcagtccttttggcggcttaagtaaaagttttgcaaaccacctgtttgcaaaatagctgcttttgccacattttgcctccgtaattgaagaaactttatattctgggaggaagtagtcctgttttctccaggctccataacttggtttgaaaaatcattttagtaacaagagccaaagtgtattatgtggacatctctggttagtttacttttggtttctgttttggagagttgactttttgatattgagcaatatgatatatttaacaaatagttgttcatctgtgtgcaggataatagatacttgtctttttctatatttcatttagggtagtctattcctttttggtccttgtgactttgacttaactttttaaaaaattttatttactaagtcgaaaaacaagcttctgacagtattaaggcagtattgatttaagatatcggagttgacttaggatgggtggcttttggctctttaatttcagaatggtgtgttatctgcttaactgatttctttctctgcagttgtcttcgaaatcagttcttacattctactgaggagaaagatgccagtgaaacattgaatgccaagcttgatttcatatattgtttcaactaagaacatttaagaagcccatccttcccactccctccactcaattcaaccttagtctatatggccagtttgcctaatattacttttaatctagattgctggtgttcaaacaccttcagctcttatgtagttcatatgtgcaacactttaatcagtaacatctttcatcactcacagcaccttacttttccctcaaagtaatacccgtgattcatgagctagaataccatgaaagagcatgaaattaatcattaaaatataatgcagtgaggaaaaatacattaagcttaggggagcacattcaagcataaatgcctcagttgatcctattgatttaccaaagttcatttttgtgttgaagaattagaatgaattataaaggctcagttttccatcaaatttgaatgcttttcttgaacaaattcattacaaccattgtctagagatctgattgtgatcattgttttagcttcaaatacatggataagcaagtaatattttaaaaatattggtatgaagcagttaatgaatgtgataagaacacattgataaatgtgaaaagtacttgacaattgttaaaagaacagaaggtgatgataacaacctactctaatagtgactgacttttccctatgagctaactacagaacctcaggtttcagtgaaacagccaagaaatatctttgtttctgggggaaaagttattgaggtatatataaaggtgctttgtgtgcctgcttcataatttctagtctgaatccaatatcacatcaggatttgacggttaggaacatggaaaacaatcagatcaccaaactccatagctggaatatccctgggctgggagataggcaaggaaaggatgtgttacttggtaataggacctagctcattactcagaattgttgttgttgttgttgtaatcatagaagttgcatgagaaatcatgttttttttcagatatattaatgtggttcagagcctggcttctgaaaccaactgcctctgattgaggtctaactttaagctgtgtgtttgggcaagttagcctctctgaattgcacatggaaaatctgctaaggataataaacaaatgtcacaagttgacagcatcttgttgggaaaaaggacaaaaatgttaaaaaataaagataacagaaaaatatatcttattctcaggaaaatcacttccaatgaaatgattagcattttaaagtccgttaatagtagttatatgcttttagaagttattttgctttgtgagtgtactgtttggatacagtctgaattttgtcaacgatgactttaatacaaactctcctgggatggtttcaaagaaggttagtattggacattggtcactttcccaggcctcagcagtaacttaacagcacttcttcatttagattgaatttacagccagtatattgtgaatatctgcacacttgaaaggaaatgagaattattttgaaacagtactcttttgttcaagaccttgttcccctccaccggcaaggataatgagaatagactttgaaagtatatatatctaaacgaaatgtatgcagctgcagcaagcttttaactatttgaatactagtacttttgatatatatttgtagccaaaccaagttgctatctgttactgtactgctaccacagtcacaatcacaaggcccattccttgaatgatcagttagtgaatgttaaagggttataaacttaattcacatttaccctaaatgaaaaagggattttagtccattgtccacaaaatcaaatgcattttaagtcaaacagaaatggtttcggaattactgatactgtgacttctattcatttgaaaaggtaattgggaattttctgtatgattaactaggaaaatgagattaaaaatagcgaatttggaaaatagaagcataatgggaaagacttggagaaagtggactttacaaattttgaaacaaggaaagtcatgggttataaattggcagagatggcaaaaaaattttcagaacatcttttatcataattgcctttgctgctggggaggaaggagaatcatggatccaaaaaagataataaagattccactttatacaaagccatgagttgtttattgatttaaatggatatatttttactgaatgtgtaagcatcagtcatttcttttctccttccttttattgactgggcactgcagatcttttggaaatatattcttaaataaattaagacttttaaagctttaactttttaaaactattttgtgagttagagttgttgaaaacatgcttgtacttcctactttaagctgttttgtgggccatagttttactttaaagtgtttctcctttctaaggagtttagctggatagtagaaatgtgtctgattatctgatttgaggagtcactgattctaatggtagcttcctgtagttttaaggtactgcatatttctgtagttgagtgtgttgatatgtgtttcagtgcagttttttaaaatagagatgggggtctcagtatattgcccgggctggccttgtactcttgggctcaagcgaacctttcagcttggcccaccaaagttgtgggcagtttaaagaaaaattctatcctttgcatatgaattcagatgaatagttttggtagtttaattaaaatctgggagattaatgactaatgatggatcttgatggagggtgatttttagattggatctgcttaatcttaatgatagcaaatggtgttgactgattgcttaattgtaaagtgtgctggaatttggtagcctcctttgttacattctagaagaaaaattcacttttaaaaagattatgagttcatatcctttgtagggacatggatgaagctggaaaccatcattctcagcaaactatcacaaggacaaaaaaccaaacaccgcatgttctcactcataggtgggaattgagcaataagaacacatgaacacaggaaggggaacatcacacaccggggcctgttgtggggtcgggaggagggatagcatttggagatatacctaatgttaaatgacgagttactgggtgcagcacaccaacatggcacatgtatatatatgtaactaacctgcacgttgtacacatgtaccctaaaacttaaagtataataataaaaaaagatgaatattaacagtaaggaattgataaggacactaagaagatctagagtcaaaatactgattcagttatggaagatctttaagcaatcatacctttctttaactatttgaatacagcatcttaccaaactctgtataaactggcaacaacacaagggctgaaagctggaacccctagtaaaataaagatgtctgatcactgtgggagaattctaataattagcgtaaatgtaagtaatagtttggaacactaaaactagaagacaatgagactgaaaaaagattgtcgtaaaatatcatgacaaagaaaatctgatgagatttgatataatccaggcttcaatacagctaaagaggagatcaaaatggaggattggccaatttatttttctgcctctcagctgtatgaatgcatgacaaatatgttgcagagcccttcagtccttaaaactgtaaagaaaattttattttgtttatattccaccttaattaaaaatatttaataaggcattgtaagattacacctttatctataattgggactttgattttaaaatgtgacatatttaccttctggacttcatttgctcataatcctccatatcaagacagaaggtgtttttggcctcaaatatcagtcatgtgggtgttcactgatatcctggagccaattatactactgagataactcttaataggattatgtctttcctgtggtttataattattactgcttccattgcttttaattaaaatgttacactagtacatatgaaacatctgcattcaaactcaacatataacttttagccagttcaccatgaatacatatatatttatatgtattgaggaattaagtacttttatatgaagttatttattttgtatctccccaaatcaagcttcctttcatggttagtacaaaaagaaaacattgtatttaaacagacctgggttagaatcctggcactattttattttatttgtgtgactgtggtcagcttctttcttggactgccatttcttcttctgtgaattgaatttaatcctatgtatttcatgcaatagctataaggattaattggagtcacatacacaaaatgcttcagacagcatttgtcacataaatatatgcttttttaattggttacacttattttaaatgttattactgcgtctatcatgtacattatataaacatcaattggcaagaatttgtttttgctctagtaatcaactagtggtattgaagtctgttagaatctatgagaaagggaggagttaatgaagttaaaagattatgaaagaggtgcattatagatttataaatgttgcatatatctattgtgaaaaagttactgaattaacatttgtcaatattatgagggagattggggagtttctgaaattcagatcaatttaaagagacccatttcatttcatttctgtctaaaaatatgtttttagtacctgttgtactgcgagcccactggtgtaagtttcagatggtacaaaggaagtatatggcctaggttttgtttatacatgactattcacatctattacgtaggttaataagattcaaatccaggctagccccatcctttttttactgcaacatacatatggattgattcttctgtgtttttctgagtgtttttgagactagatcagggctaatgcataggtgaaaattattttttggcattctcatagaaatgtagaaggcatttgacattaatttttttctgaaaagaaattcctacataattaaaacaaacccttgtatttccatgtgctaactggagtaaactcatcttctttctaagcaaacatattagcttcaaaaacaatttttttctaaacttttaagcatccctaaacacactgcatttgcttatgaataactcttttagctcctaggaaacagttggttggagataacctattttgcaccaggaaaaggtaaagtgtgatcttactgagagatgactcatatattacactttttatactagctataataatttcatttctttgagaattttaccttggctgtgtaacagcatttttgctagactttacctccatcataataattaaagagacaatctgtgtccctacctcccaggtgcttggaaattgatattataagcacttatgaatgtccccttgaggcactcttgactgagccactttgaagaaaaatctcttcatcaataattaatccctgagggccacttctcaggggacccacacaaaattacatgtcaactccaggcctgatttatataggaggcgatcatggatggagccctgactgcacttcctcctcccccccatgttttattcctcacctctctctgctggttctcctccacctcaacccctcaaagcccccagcacttttacttctctcccaaaactttatcctccaacttacaactcagtgtacctacacagaattgactcacccggtagatcttaatctttatgaaattctttaagactgacatgaaaaattgtagcatgttaaaatttatagaaacattaccatgcctaatgaaaaggtcgtgtgaaaattgccagcaaaatagtagaatgtgtatttactatttgttaattaaaataagtacatttcccaagatacaggataagcctggggataattttgctctatgccatagatcccttgctctctgaccttgtgggaatcattcagccactgtgaagagttttctgatcttcagtgagtttgctgttgatcagtcttttaaggatggtttgaaataaaatatggcaatggtgaaattgtttggaaatgtgacctggtgtgtgttcatattaaggaaatgctgagatattggctcctcgatttacatacttggtaggattgagtgtactatttataccagctgtatgaatttcatgtgcttattcacctgattttaaacttttttaatgtctgcttgctgccttttcttttttaatctgatgaagtagctaaatctaaatttcgcctgagaatacaagaaaagttcaatcgtactatatatggctggagttctgtgtaagggtgatctggaattaacaaatttacattttgtatgtttaggattatgctgtctttaactagaaattaagaccagagattcgaaaaaggagatgggactctttatgccaatttcttcagtgtgtttgttgattgatgattgtaggtgaaaaccatggcataagcaatggggtccccagaattcaagctatactaatctgactccttgtaccacagtgacctgagagctttgcgggacttctttcagatatttctctatgccaaatattgaggagtgctggggtaaaaatttaaacttctccacagttcaaagaagaaaggcattcagttccccttacagatctctaggggtaacgtgtgttaccgttcaccacaaaatgttcattcctgttaacttttagtgtaaccttagtgtaataaaagtgttaacttttattatgctttatttccccgatttgatttttaaattatttttcatgattattacagaagatttaaaacatacaaaaaactaaaatcaaaagatgaccccaaagatacatagtcatcccactcaagtcatccacgtaatattgatgtagtacatttctttcctgtgcacgaggtaatctttccctaaatacttttagtcatatataatttgatatttgttttcttgtcctatcaaaagcatttctttatattcatattaacttcagttttaagtcacggcgtaacattccttgtgagtggagatatcaaaatgtattcaagcctctctcttattatcatacatttaccttgttttttagtagtcagttattaagaacaatgtttcagcacaatttttttttatttgcttaaagcattgtgctggaaatacacttgagagtgttggctcaatgatatatagtgcattttggttctgccgttctcgtttgcatgcttcaactgaattaagtgtctttaaaaatatgttttaaaaaaggaaaaggggaccattttggggtgcaaagacagaaggagcaaaatggaaatggaaccagtttaaccgtttgcctcatcttcctaacactgattctaggtaacagaacgggcaggcatctggatgtagttccctttgatgtggatgtgacttccttttaactcagtgctgataatagcgtttctttctggagaatggcttgacagcgtgcatggttcctaattttttctgccctgggagaaaaggaagagtaaggttggacctcaggttgttatcttggatggaacattcataaacctcagattattgtcgtgaatggataaatctcaggttgttatctagaatgagtaaatgtaatactaactgcagctgtctcattatgtgatggaaacttttatattatcccagccttctcaccctcaccccaagaacaaaccactctggcagaccagattctcaaagaattattttatcctagcctgcctttactttgaagtatgggttgtcatgtgtgtgcatgtgcatatgcactagcatgtgtgtgtacattttcttttttttttcttcctggtactcagagaagaaagggtccgtgagtgtaactacttttgactcaacacatttttctcccacatacaaattaaatgaagcaaaacatacttcttccttgggtgtgccaaccaaaatgactcttgatttttgctacattttaaagctaaagtttacttgcaacccagactccagacattggtatgcttaaggctctgtcttttctgaaagagataaaaacatttgcagagaaaaatttgtatgtagctcatgaaaattagtgcccatcacccctttcattccaagactggacagtaagaaacaaaacttaagcatcctttatgcttaagatcacaatattataggatcctagaagggaatcatcaatggtaggtatgactactttaaggatttgaaatattttcaagttgatgtctacatagtactactaattaatatagctgctagcagctgtatgagtatgtataaaatgataccctttcaagtgttaataaaaattattttttaaataaacaattaggtgaaacttttgtgtgattcgtttaatttgtatttgtttgaatattggtaaattttaaacatttttccacattttaaaatattttgggttttattttaaacaaattattttaacaacattttaatgtaagagtaaaataaaaaaatgtaaataagaatacaaataagaaaagtagaagtataacagattttaagaaaactagatgctaatgtatcatgagatcacaacaaaatgaatgttatcttggaaacataaaatctccccaaacctcagataaattcagaaacagcagtagactgataacctctgtcctttataatatttattgatgatgagtaacagataattaatatttagtctgattgtagtggaaggacagcatagatttgtggttaagagtatagactctggaattagagtgctaatgttcacagcctagctctgccacttactagttttgaccttggcaaataacttaaacattttttgtttcagttttctcattgtaaaagtggggatagaaatcatacttacattacaggattgttgtgtggttgaagaaaatactacagattcatcctttttaatagttccagcatgtggcaagtatgcaattaatattaggtattaaattattaataatggctaccacctattgtttgacttcagtgatttatctctttgacaatatgttattttagtcttctttaaaacacaggaatttactctctttttttaaatctaaaatattaattttttcctaatgtgctaagcactggtctagatgttgtaaacacattttcaaacaagacagaaaagaattctgcagtcaataaaattgcattctaatggaggaacaatagtaaaaaaaatttctttaatatacagtaatttcagataatatcatgagcttttgtaaaaataaaccaagaaaatgtgatgcagaatggctagtagggtcttttttcacatggtagtcagagaaggcctccctgtagaggtgacatttgaactgaaatctagaagatcataagaagtctgctaggggcttttgaggaaaaatgaaagcaaatcaaagaggtgggactgaactttggtaaacaaaaaaagtaagaggtgtggggaacacaaatttaatatgtaatggcattcagtttgaaatcactattagatagcacagtaaagataccacgtaggcagctgaaagtaaacttttggatgtctgtaaagaagccgtagctggagatagaaattgaggaattattgacataaagatgttatttaaagtcttgggactgagtaagattacttaaagacagcgtagctcaacaagggactgaggactttaggcattaagaagaggagaagatagccaagaaaccaagggaggaggaaggatgtgtatatagtcaactttcttgtctgctgttgggagggtagttgagggcataaagatttcttttaacttagtaacattgaaaaagtgtgagcttgacaatagccattggggaaagaagcctaataaaaatggtttgagaagaaaatagaatgtgaggaagtaagacaatggcattgggaaatgctggagaaaagttttcctgtaaaggggaacagaaaatagggaagtagctggagagggataacagagcaggtacatatattaagggaagagttgcagtggggaaactagagttgaaagacatagacaggataattacttgtataaagggattcttttggtgagagggaataggattgataatataaggtttagaataggtggtgagacagaggtggcacattgggtggcggaacaaaaaataagttccctcttccaatggatggttttaattttctcaataagagtatgaggcaggattaccaactgagggtgagaggaaaacaggctgtaaaagtttgaagaacaggtgaaagtatgaatagattttctgtaaagtaggataatgaaaataataagtatagtaggattgttaggcagtatttattttctacttgatgcttgcagtcaagaattgaacatgagagcagtgaacataatagtggattgttctccatccacttttaactgcttgggttcaggcaaataagatgtaaagagataagtttaagtggattagttttgcttgggcaataaagttggagtgagagaagagtagggaattaaggatgttgtgaagaagtcataatagtgtatcatggaagctgatctgagggacgtcagcataggagaatgagatgactactgaaaacaccagtgatacgctccatggattgatggtttcaggaaggtcagataattcttggaaagtggaatgttgtcagaggtaaagattggagtggtatgtttgaaataaagcttttagagatagtgcgataatcatggtaaagtcaagactataaccaagggtgatggtggctgcagtggggtggaagaacaagaattattggtggtgagatggtgagtaaaaagaggcagatgctaaatgagccaagagtctgttgaagtcactaagactggtgtaaaaaattgagtggagttgaagacatagagaattagatgttaaattctcactgaatctgggtagagggtgtggtggcaaccccctggggttggtagatgacagaagcactgagttatagggagtagaacacagaggaaatatgatgggaagatacataagaaaggacagccaggccaggtacgatgacttacgcctgtaatcccagcactttgggaggccaagtggtgtggattgtttgaactcaggagttcaagaccagcccgggcaatagggcaaaaccccatctctacaacacataccaaaattagattggtgtgctggtgtgtgcctgtaatcctagctacttgggaggctgaggcgggaggattgcttgagcctgagagatggaagctgcagtaagccatgattacaccactgcactccagcttgggcaacagagtgacgccttgtctccaaaaagaaaggggaaaaaaatgaaaagatagccttatgactatgcagacagtgattggagtgatgcatcaaccagccagaggataacaaggattgccagaacctagaagagacaacaaagaattctcccctacagatttcagagggaatatgacaaggttgacacctttactttagacttctagacttgagaatgagtgaggcagtaaatttctgttttaagccactaagtttgtgtaatttttttaatggcagcccaagaaaatgaatacaaattttgatgtgaactgcaaaggagctgggatatttgtggaaggaagaaaggaaggaaggaaagaggaaggacaaagaacgtaaggaagggagggaggaggaagcaggggaggacctcagatactttgatattaggaataaatgagactggggataactaacatttgtaagagacagtatttattaaattcaaatttttgtagttgaaggaagtaattggggttgactattcctaaatatgaagaatcctaaatatgctattaaagtcctggttctggcacttttgagctttgtgaacttaagctaatttccccatctataaaatcgagatcgtgatccttgttctgcttatcttataatgttgttgtttggaagaaataagttaagaacaaatgcaaatgtaagctgttactatcatgaagttgcttaacttccagatatgcacagtccttatatgaagggaaaagatgtttgttatcaaatatggaaaagaaccaggtagataattttttaaaacccacactaaaaattaaacacagcagttccccttcatccaatttttgctttttgtagttttaggtctgaaaatattaaatgtgaaattccagaaataaataattcataagttttaaattgcacgattttgggtaatgtgatgaaatctttcattgttccgctccttcctgcccagcccatgactcatcgctttgtccagccagggtctccacactttctaagctccctgcctgctagtcacttagtaaccatgctagttctcagatgactgtggcaatattggagtcctttgtattcaagaaacgcatattttacttaataatggctctagagtgcaacagtagtgatggagacaattcatatatgccaaagagaagcagtaaagtgcttcctcaagtgaaaatgtgaaaattctttacttaaggaaagatactgagattgctaagatctatggtaagaatgaatcttctgtccctgaagctgtgaagaaggaaaaagaaattcttgcaagttttgcagttgcaccacaggctgtaaaagttacagttcatgagaagtgctcagttacaacggaaaaagcattgaaaacaaatatatatgtagggttcaatactatctgcagtttcagacatccactgggggagtcttggaacatatccccgtggattagggtggactcctgtatacatttttcgaaagcttaagttaccaacaaaacatattattccatagttcaattttataagtaatttttaagtacttgctgtatcttgggaactatattaagtaccacttagagtctggttagaaagataaatgcatctcctctaaatgtgcttttgatacagaacagaagatgaggcaatttcaccaataattatatatcaagacagaaagtcataagtacttggggatgatggttcagaattatggtgtaagagttaaaataagcatgttataaattcacattcatgcaacttaataatttagttttacaccattatttagattatatttaataaatgataaagaaattcatataagttttgttacagtttcccttcaccttcacctcaatatccagtaatttaggggccagaaaatgaattaggtgatcattttccaaggacaggtgaaggaaggctgtcctggctgaaatgggtcaggtgtgaggcaggtgtaagtataggagctggcagagttagaattaatagggatcatcatggatctatgcactcagagcatttttttttcttgttccctacttaagaacatgtttccagtcttaaaaagatgtatccgtttcagaaatggtgaaaccaaggacatagaaaggttaaatggtttgattaaagtcagtagtgaactggaaactaaaatctatgaatatgagctcagttttacattgctgtttattcagacattaaaatacatgacatgaaaattaggaatcatagaggtatagaagtgggaagtccttcaaaagttacctcatttttcctgaccgtatgtattcactgagtttctcaataagatgtttaatattcggttcttcaaggagtccttcacatgtgtaaatgaagcaaggtatgaatggcgtctaatccacaggccagatggttgcagtggagggagctgatgagatatcatcaatcacttctctacatcatgtcaaatgaccagttttgtcctttgccggccactttggcagctgacaggacagaatctttatttgttgggaaatttggaaaaagaaataggcaaactggattaccggactggaattggttttgggattctatatcgtgttttcttttctttaaagtctgtatacatttagatgtgttataaaactgattcactggagcccttgactgaaggacatttttctttttatttctactttataatgataatgatgtcattgtcaagaaaaccagttcatattgaggactgaaaaaatataatgacaaggatatgatctaaggttaattttatattagtctaacccttgctccctttgcatctttagtcctgtataattttgaattaattatgctacaggagcaaatagttagaggtgcatattgggtaattataatttgcactacagtgttcaaaacaaagcaattctagtctagttctcagttaatctgaaagtgaaataaatccagaatctatgaaattctttattttatcaattctaaaatagtatacttccataaaaacatatattgggcttaaaataaatataattttaggtttggtaactttaattgtgtaagtcaactttcctggagaaattagattacattgactatgcaggtgcccttgctattactcaagatcagtagtgccttttaatacccatggcaactgatttggattgatatggaattttgagtacaaactgtaagggagtaataactttcagtaggttcttagttggaacatacccctattatgaaagatggattaacaagagaaaagtaaacaagctgattaacatatatatttcacaagtacatgggagatacccagagaatgagtagttttcccagaagtggttttgaaatagctccttcaacaaagaacagtacatttttagagaactgaaaagacaaaggatggcaacttgaggagaaggcaaatgcatggcagacaaaagttagtaaaacttgttaatataaattcctctggtactgttgctaggctgataagggtctaaagctgtctttggtggttaaccttttttctttttggtagagaggtgggcaggataccattttctttgtaaatctatctactgcttttaggcaaataaagggaggccagagaactctcctgtgtttcttcttaactgccttcagtgcaataacccttcatattttgggaaggtatattctggtctcccacacttccattatgattaagatattgtcactgaaatgttatgattaccttgccacccagtggatcctgtataatcatttctgaattattccattgttttaataatgacatctttaaatgtgtttgatttccatcatgatagtacatgcatatcataaacatttaaaaataaacaaacaactttgtggaatagtggttctattcctcccagtgatatgatggtaaactagtaaatgggagttaggggagggatggtgcagagaagggacatcctgatgtgtagcccttcctgattaccctggggtaaatacagcctctgttgctgattttaagccctccctaagaatagggagttggaaatagatgttagctatcctctctccagtgcccactgggtctagctttcacctcacccctctccatcttctcctatttccctttctagaagcaacactttagctgtttctcttaattcatttgctagtaaaattcaaatttttattcagccgtcagatttttggacagttaaaatgttgttgttggccatttgcctagcagtcttggaaaggcagctttttaaaaggctgcctaaagtttgaattaacattttaaaactctagatatttggatttcttagttcctctagtatagtttgaagtaatttaaaattaccaaacaatgggcctgaatgtgaaaaaagatgaattgtaagacagtatcaagaaagattttctaaggaatagttttaaaaagatactgttgatattaaacatacttatatgttaatatataattaacttaataaccaaggacatttacttagcgttgtccatgttagatattgatttgctagaccaacatgttttgaccatttcaagattctggttatgacaaaaactcaaatttggaattgatagacagaactgatccataaattgtgagaaacaccatttacatacgtttctaaaaattttcacatgcttcatccagctctataacctgcattttagggggttatcattcattcggattaaaacttttaaaaataaatatgtattatattcagtaaaacaaattttaaagcaaaagaaatcggagctatttcattctttgtgatattgttaaatatagattgtttctagttttcaagttttaattttgcttcgtagtaaataagagatgtattatcaagccttttcttacttaaatcttaacaagtgtgtaaatagtatgaatgttgctcacaacccacactgtttgtaattaagtggcaaacttattaatttccatcacagaagtctcccattaagtcaaattctcttctgtgccagcccagtaaccttaattacgatgcaatatttatcatcctttggaataatgtttatatctttgagtaagtctaagtgttaggaaggtttaaagaaagcgtggaactatgtagtgttgggaggtacctctttctaaacacctggaagttattgcagttatttagattgaaatgaaaaataatagctgtttgttttctagtggtatgctccatttaagaaaagtcttaaaaggtagattgttttgtttagtatgctcctttaggaaaatattctgtgtctaaaataataaagaaatctcattagaatctgaatgttactaatttgatgaaattacctcttattatatagcaacatacccctgcttttaatttattttcagtcttaatctttaaaatgacagagaaagtgtaggaagcattgtattaaagtgatggtgataatttacatatctttgagatgaataacatttcaatggaaacagcaaacttaatgattaaagaattacttgacatgtgggcatcctgtaatctttcctatggaaattaaagaaaaccagttttacccagtaaatccaaaacactgaacttctgacctcttatgcctctctggtctatattatttatgcatcttctaattcttgctcttatgctactttcaagtatggtttcttatcagaagtaggctcgtaggcaatgtaaagtcatggataattcaaagtattcaggagcctcattgtagtgatatttttgtatgagtgtggtgatgtcatagagttaggagacttggttctaatcttgactcagtctttaatatggattgttcttttacttcactaggcgcatctgtaaatagaggtcccttgtggctcttacactctaaggagatacaattcaatttattgcaagtctctatatttatgccttatataagttcctggagatactgagaagggtaatagccagtcatcatactcagtaagctgaaaggctagtggggcagacaggcatataagcagagaattttagactatgtggatttcaattggaatacaagaatttgagggtttaataatatatgtaaactattttataaattgataaatattaaacccagaatttctattttaatggaagtagcattacctgacatttctgaatggtaaatgtatttttgataccagagcatctgtgatttttttacaattaaagaaaaatcttagctttttagacaagatgtgtgaacttaattcaaatccaacaattaattgaaaggcactggagacatgctgtatttcactgtcagttttttgttattgttgctgcttatatgtcatttgtaagatgacaccattattcaagtgatgagccaaacagtactaaatatttttttctaagccagttttctatcccaacttttattttctgtgcatactattccccttataatcacaaattgttaatatgggaggtgtatttacttttctgtctctttacaacctatactcattgttatcaagtcctgctagagcttccttaacaatatttctgaggtttgtctctttcttttcatttgaagtaacactatataagcaatgtgtaccaggaagtttggtatatattgtggcttaatcagcatataatagacttttctttaatctgacttatttcaggtcttgtttctgtagctgcaccagcgcaaaattgatttcagtatttacagtgaatatgcagcaatcgttgagttactacattaaaatgaaactaatattagctgcccatagaagaagtacagagtagtgaataacagtccataatctgaagccaaaatatgtgggttaagaatctctgttacttcctggggaagttactcaatctccttgtgatttagttttctcatctgtacttgaaaaacacttgaaggggtgcctggcatactgtaagctctcattcaacatcaggtattaccaaatagtcatctgatataagaacattaaaaaatgttcttatatcattttttaatataatttttttcgaataaaagacattataaaattttgataaaaagttgctaaactgtcttattgttgaagtatatattagactgagaacacatccagaaatcaagttagaatattaatagagatagggtgttttgcatggtgtatcttgggagcacagaaatgtgttatctactgcggcttgataggagggagggatttaacagactggttggaagtgtggattttggggagggagttgtgtgcatgggagattttcaaaaaacagtttgcaaaggagcattggatatattttattcacatcattatgctatattgtaaaaaaattatgtcagttaaaatggagaaacctattagcagtcaatgaatggagatgaaaatgaattactttttttgtgctggcacaataaaatttccattgatcattctttgaaatgagtaagttttggtttaggatttttgacatttgatggatttcaagaaaaatacttaagctgatgtgatttcccacttatcttttaagtacataagccaaatgcttttattttgaagtttccatgcaccctggttttgaatattttgccttgttgattggactatcagtccttcccatacctagttgaccaccagaatcaccttgggcactgtaaaaaccaggtgttggggtataacatgggaaaaattgctaaaagcggcttaaagaagacagaactttatttattcctcatgtaaaagaagtccagagatagatactagagtgcgtatagcacctttttgttgtcaacaggtttctgtctttccattctgatatcctcaagttcacctctctgttgaagttagcagctagagctccaaaagcagagaagaacaggaaaaacaaggtatacctctccctttaatgagactccttaaaagatacacacttctaaatgcatattatttcctggtacttagctgaatggcttgtcaaagcctgggaattatagtctgtagctgagaactatggctcccaaaatgtaataggggtttgctactaagaaggaaggatggagtgcatactgaggcaggagagctgcaaagtctgccacagacatttgttaaactgattgattcccaaggcctatccatgtataattgatagatgtgtagggaaatctgagatattctgatgcagctgatttattcaggagtatctgtgataagttaactttttctactttaaagcccatggtcccatgaccacgtatcaatctctaatacatttacctaagattcctatataaaagtgagtaaagaaattacgtattgccattttgaaaatttttctgtattgtttgtccaggtgctctataaaattaagccatgtgaaggagtggccactagagtatgatactcttactggaattctgcatacactcaaggtgggacactagggaatagatgtacattttgtattgggggttccaagaccacctccaggcacaattgatttactataaataccctcaggatatagaagttgttgtattcatggttatagtttattatggtgaaagaataaattaaaagaaacaaagggaaaaggcgcatttgtcaaagttcagaggaagtcacccacaagctttcagttgtcctctcccaatggagttacatggcacacatttaattcttccagcaaatgatgtgtgacaacatgtgaagagttgccaataagggaagctcacccaaaccttagtatccagggtttttaattgcgtgttagtcatgtatacatatagtgctgtgtgactgacttcagttattcaaggttcagaccaccagagaaaaagcagatactcatcattaatcacactgttaatgtaaactagccaactgttacaacgtggcccaaggcctttggcattaaaaaaaaaaacaaaacaaaacactcttgtctgacagaatagtcacagcttggttcctaggagtgagctgagggccacttcttctgaaaacaagcctttcttgggaatgcttagtgtattagtctgttctcacgctgctgattaagacatacctgaaactggataatttataaaggaaagaggtttgatggattcagagttccacatggctggggtggcttcacaatcatgttggaaggcaaaggaggagcaaaggcacatcttacatggtggcaggcaagaaagcttatgcagaggaaccaccatgtagaaaaccatcagatctcatgagacgtattcactaccatgaaaacagtgtggggaaacctccctgatgattcagttaccttcacctagccccacccgtgtgacatggggattattacagttcaaggtgggtttggttggggacacagtcaaaccatattgctcaggatttgagcaactcaggcctatcaggttctttcctgtacacatttccacctgaaacaataaaaaagaaacaaaatatatgaaacaattatttttaagatactggctatcaagcaatgaaatacagtgttccctgagaaacataaacaaatgaaggaaaccctaatatttttctagtttatcctcttgagagagtttataggctgcagatcagaagggggaaaccacacaaagcctggtggaatccttcaattggagagacagagctgaaagtctagggagaccaaggaagctagagtttgtagaacagaacaacagagaggctagagctgctcagagagaaacctgcagatcagcagagggttccccttgagtactccacagagtaatgattagtatacgcatgtgggaaaatgacccatggctgcgtaaagaacagtccgacggaactagcactcacatgggtctgggaataatgcctcctcccaccagccagactggaaaacttcatgattcatacgacattgggtattcagaagttttttgcctcagtagtgggaaataattagccccagagcaaatgctgcttgattccctcctcacaaagcttaaaaccaagacctgagaggatcaaatcattttcaaataattcaattatgtcctagaacaaaactcaaaaacatttataggaatgcgaaaatatcatgtacccaatatggtaaaattcacaatgtctatcatccaattaaaaataactaggcatgaaaggatgcaggaaaataccacccataatgaggataaaaattaatgtattgagacaaatccaaagccgacacagatgttaaattagcagagaagaacattaaaactgtcattataactgtattctatatgttcaaaaaatgaagtagaggtgtgcaaaatagataggagacccaaattgaacttctaaagatggcaactgtaaggagatgaaaaacacactggataatattgaagacagattagacactgcagaagaaaagatagttaacttgaggacatagcaataaaaactctaaaatgaaacacagagagagaaaaaaatgaaaagactatcagtgagctgtggaacaacttcgagtggcctcatatacatgtaaatggaatttccccagagatgagagtgaagcagtgggaggagagaagaagaaaatatttgtaaaaatgaatttgtaaatccaagaagcccagtgaaacctaagcagaagaaatataaagaaaacaacgccgaggcacatcataatcaaattggtcaaaactagtgataaagagtttatcttcagagcggctagaggaaaaaaacaggtgtactggatacagaagaacaaagataaagcaatagcagatttattgttggaaataatgcaagtgagaagacatttaaagtatcagggaacaaaaactttcagtgtagaattctattatccagtgaaattagagttcaaaaaccagggcaaagtagagactttttcaggcatacaaaagttgcaaacatttataagcagcagacccgcattacaagaaatattaaaggaaatcacatccttcaggcaaaaggaaacaatagtaggtaaaaataggggtttgcaccaaggattacataattgcaaaaatggtaactacataggtagatatatgatttttacttactatttaaacctcattaagagaattggtcatttaaattaaacagtaaagtatggggtttataacacatatacaagtaaaatgctatatgaataatctttgaagacattatgctaagtgaaagaaaccatttacaaaaaaacaacatattgtatgattccatttatatgacatgtccaaaacagacaaatccaaagagttagaaagtagattaatggtgcttaaatctggaggtttggggaaaactggaagtgactgataatgggtacatgtttttggcagggatatgtttgatgaaatgttttaaaattgactatggtgatggttgcacagctttgtaggtatactaaaattcatgaattatatacttaaaataggtgaatcatgtgtaagtgaattatatctcaataaagctattgtaaaaaagtaatactttacctatgaagaaaaaaataaagtcacttaaatatgagacggggagaagtaaaacctaacaatgcacaaagaatgttgggtaacatgcacatcatcggtgagacttgacaagagcatttgcagtagtggtaggaaagtgaagactcagtgggtagctgaatgtttctctttttcactttaaattggagatatgtatgcattcttctgtgatctgttcatgcccttttccagcttatctgataatattttcctgttttcttatccatttatgtgagctttatataagagactaacactatgtcatttttgattaatttgattgatatagttcaatgagtgtttggaacaggatttctaaataggacgtgaaatcaaatgttaatctctaagagtccattccaactctaatatactaaatcctagggacccaaaaaagatgccaagttaattttattaatccctggaaagaagctagattaggtcaaatagtatgtaattacagtgtaagattgggtgttatatttttatatcttgctttaggtataaacttaaattattttaagtgagatatttgttctcttaaattggaattcctaggttgtttttggtaaaaaaattgggatatcttgatgtgactccatactgcatatacagctaatactactgtttaaatggaaagcattctctctaggcattgaaacaaagtgtattaattaagaatacaaaatattacttattaaggaaataaaagtagcttaaatagtaattgtatgcatgaactttaaattcataaatttcatgattttaaatagtccaactcctcaactcacccaattccccaactcctcagctccttgctctactctgatccttctcaaaaaatagatatgataatccttcaattaataaaatccagaaatgaaaactcatttttatcatatcagttcttatttttaacataagtcacttgccagcccatatatatatttccttttagctgttaaccatatagatgaagggcaactagtcacgctatgatttattacagttttgtgaacctgaaaatcatgctacttcctctatttacttaatttgtaaaacatttaaactcagttagcccaggtcctgctttcatctttcccttgaagtcctgttttccagcatctctatttgttgactggtattaaataattttagcatgctggtatacacttagcctcttttgaactaaaataacccttggtcttgtgagcagtgtcttttgtaaatgagagtattttatacacaaaaggtactagattaaaggtaaatcataatacttttcatactacttgaaaaaggccctctaaggccaattttacataggagccaggcaatttctgtaaagcaagttttgaggtaaattgactaatttgttttgaatgaaaaaaagtataaatgctaaaatatagattttcttacccaatgaactggtgaatttttttggtaacgtaataatccctatcaactttcttttcacataattctgtcttgggattttgtataaatttatacatatgttcaactttttgcaaatgcaagatattccaacgtgtattttcatagttacacattttctacatactggttttaatttaaatatgtaatatatggatgctttgccacattatattaaattgaaaatagtttataattaaagtaatgaaattttaaaataaagtacagtataggttatcccattttatatatttttgatatctctttataagtgtttgcatttgacactttatttctcaattcctataataaaaatatacaaacagtatatataaagtatatatgttattaatgttttgctgtttaaattgtttaaagaataaagatatataattaatagctagtgttacattatttggtaatattgttttcttttcttttcttaaattaagcaatactttaaaatatctcctttggttattctgaagtttcttcttgataaaataaaatggtacagtcaacatggtaccatttgaactcttaggctaaaggtgactttaagttgatgcccaatattaatagtatttgcatacttccacaggtggtggaatcctttccttgtctgttatgaactgtttatgtcccctcaaaattcatatgttgaagacttaacttccaatgtgtggtatttgaagatggagcctttagaaggtagctaggggtagatgaggtcatgagggtgggaccctcatagtgggattagtgcttcttataagaaaagactacagagagctttctctcattctcatcctctctctctgcaacatgatcacactgcaaaaaggtggctgtgagtgagtcagaagagggaaaaggattcttacctggaaccaaattgtcaggcaccttgatcttagactttccagcctctctaactgtgagaaataaagatctgttgtttaagccacccagcttatggaattctgttataaaagcctgaacagactaaattgtctatgtcagaattagtcactacctttggcatgctctgttctgtattaagaattgtgaggttaatatcagatgttattattcttgtgtttgaattgtcaatcttttctgaaagacaataaaaagactttttttttcacatagagatcatttaggcacctgttgtgtggtgtgtattttagaagtgaaggagagtcacacactgggccttgcaaagacagacgaagagcttcctctggctcaccttaccttgttgagtgtgagagtgacataatagacatgatattttaaaatgtgtaaactatttgtgttaactatatgctcagtagaaatgaatcaaatattccaggcgatatgatgagcattctgaagggattcatttattttcagttgataacattttttgatgttttacaaattcatcatttttcatctgacatgcccttcctgggaaggaaatgtaatgtaaatttacctaaacatgttgggaccaaagacccatgagttatatacagttctatggattataaaatgatatctccattgctatatatatatatatatatatatatatatatatgcgatggatattaaaatctgtttttgaatttcatgacccttccacactgccatattaatttgcaaaaagcatattgtattttcaggcagtctgcctttgaaattgcagggcttagggcaatgataagttcagagacccatgactcagtcagtgatttggtttcctctgagatacatctctattttttgtactaccttatttatagatattttctcacctgttgtcttcatcctttttctatattcctgtacttaaaaatatgattcccatgtatacattcagaattgacaatataggaatatgagtatacattgggttaatagtggctaaaacctagttctattacatacatagataacatgtggtaagcacttactgcatgcaccactctaaacatcttttgcattatcttatttaatcatcacaacaaccctatggggtaagtactattactaatcaccattttacagttgaaggagtagagagcttgagagtttaaataaccaacaagaatagtagagctaagatagaaacccaaatttaatctcaaacactatgcatattgcttagtgaatacttaacaaaatgaaagttgtaagatttaggactatcagagattctttccttcataaatttttaatcaactgcagtgagttacccactgtgcataaagggaaaattggcctttgtacagagctagtaaaatgggaaaaaaagtatgataagttacttggaaaagtagaacaacctaggggcttagaaacctgtgtctgggcaaagaatggaagtacatttaaaaaattattaggtaaatgtaagtctttgaccaggactgattaccatgggtttctgaaattttcagactctaaggttgattgtatctcaagtgtgaacctaggatgcaaaataaagctgcattctctcctcttctgttccctacctagcaggagatgggccgtatcagttctgagcttattcaagaaccaaagatacctttgtgaatttctgagatattaattaaatcactctacactatgactaatgagagacatggagaagcgtgggataactggctgagactggggcttttaaacaagagactgttaagcaaataaactgaaaaatttagttctccactgaccagccttagttagattgttacctggataaggcaacaaatactcgtcaaaagcattaatcaatagatatttctgtttttctgttagctgagaatatttattgataaaaaattggcaccacagcacaatgttatattgaaatcaaagtatttctgtccaattatgaaagaaatgggaaaaacatgtttattattattattatttgtttacttgatgcattggaaagtaggagataacttatagagaactcagaataagccattaaagaaaaatgtaagcataatttaaataagacaaaacttagtttatcatcttaagcatgtaagtacaaaatgtcagcaacatgtgtatcattttaatggctcagaattatagcaagtaattaccagtattgaataggaaaaatttgtttataagttcgaatgcaaagggtaaaggaagcttaatggtacactatgtttggataattactattgtgatataaaacaataccacatgttaagaaagaggacatgttggtcaagtagcttcctgcaattggaattcaagctcttgaataatactgaagctccaatgttttaggcctaagatttagtgattttgtttgtgacatgagggcctgtgattgtaatcaatacaggcttctcttttttgccctcaatggtaatacagaaaaactctctttagatgtataattctagtttgtatgtttccgcattccactgcttcacagaatagtgttaacagaccaaacggtgacaatatataactcttatttgatttcatttatacttggccctggataatattccatcatttcttaaactaggtaaaattagtacaattaaattttttctaatttttttttctgcgtctggaataaccagtgtatctttattgtgttactgaaaatgtttggtaaagccaaacaagtcaaattctttgatgagagaaaaatctccctgtataagtaatgtaccctgtatctgaaagggttaatgggcttcttaaagtgctcaattcatccagagaggggactctgtgacctgttggaacgtgcctttggccatttcttaggaaaaatgcaatttagaactctcctgtattatctgtcagctgcttagttattgatgatattgacttttagttttttaaagtcttgctttggaaaattatttttaacagctctgaaccactcatgtcttgtatttttattttatatcacatttcatttgggatattattaagccaaatccttggtaaccattttgcacaatccaatttatttttacccaagatccattgaattcaactcactgcctttttgcaaaaggttaacccaatatttcatgttatgttatgctttctacttatgctatgtgaaagaaaagtagctgtgataagtagccaataaattacattcagaatgtttattctcaaaagttatattgctatgctgacatagataaacatgatcatttatcacaatatggattatggaaataaaaactaaaataaatgcagccatctttcttgcatgttacctggctggtttgctttaaatgttagaataactactttaaaaaaatgtgtctttttatttctcaatttgaattaatggatgagattagtaatggttgaaaactgaatagataagcaaacattatattctggaataagaaaatgttttcactttttttctataagcatgagattacttgaatcttctaatactggctttgtaaaataggtcctgttagtattatttcatcataaggaatacaccacttaaaattaaagctttattgtatatttttcttcaaaaagacacagatgtctaacttgagagactgaagaaatatgatttctgtaatatttaggagttactaaaaataatcttgttacatttatattgagctaataaaggaagttttagtggtattacagtgaataaagtatatggctaaatcgactgaatgtagaatttaatagggttttactttggtaacagctttattgatatacagttcacaaatcaacaattaaccaatgtaaattatagaattcaaagtattttttagtgtattcagagttgtgccaatataaccataatcaggtttcttcacccaaaaagaaatcacttatcctttttatagtagccatctcatttctccctaatccgccagcctgagcaaccactaatatactttttatctctatagatttgcttattctggacattttatataaatggtatcaacaatatgtcatatttgtagttgacatctttcacttagcataatgtttacagtattcatcatattgtttttgaattttccaaatttctttctgttattgatatctaattctattccattgaagagggagaactattttgtatgatttaatatttttaagttagtagaagttgttttttcatctagcatacaatatatcctagagaagattccatatagagttgagaagaatgtgtattttgctcttttagagtgttatatggatgtctgttaggtcttgttgatttatagttgttattcaagtcttctgtttcctttttggtcttctgcctagttgttctatccactgtttaatgtggagtattgaagtctttaattagtattgtttaaagatttgtttcctttcaaatttgtttgtattttgggccttgttgttaggcacatatatgtttataattgttatattttcctggtagattgagcctttatgatgataaaatgttcctctttatttctagtaaatttttttgtttctttaaaagtttgttgttctgatattagtatgggcactgcagctttcatgctgctgctatttgcatgatatgtcattttccatcttttactttcaacatatttgtgtcattgaatttaaagtgtgtctcctaaagacagaacatagttgcatcttgctttttatctagtctgacagtatacatttatactattataatttcataattacctatactttactgttgacctttgtttttttcgtgtgaatagtaagttatggttacttactttctgcctgaagaacttcctttaattttatttttttcactttttattttcatttttatttatctatttattttgagacagagtttcactcttgttgcctaggctggagtgcagtggcgtgatctcggctcattgtaacctccacctctggagttcaagtgattctcctgcctcagccttctgagtagctgggattacaggcacccacgaccatgcctggctaatttttgtatttttagtagagacagggtttcaccatgttggccaggctggtcttgaactcctgaccttggtgatccacctgccttggactcccaaagtgttgggattacaggcgggagccatcatgcctggccaagaacttcctttagtaattcttataagtcacatctgctaataacaaattctcttattgtttgttattctgggaatgtattttttgaaagatagttttgttgggtataggagtcatggttcacatttttttttcttttaatactttgtatgtcttatcccacttctctctggtctctctggttgttaatgagaaattcactgttaaacttattgaaactatttttacatgatgaattattttttttttgctacattcaagattttctttttgctattgactttcagcccttttactgatgttctttgtgtggatctctttacatttagcatacttcacattcattgagcttcctgaaggtatagtgtaatataccttgttctactttattaaaaaaaaaataaatcgggcaaattttaagccagtgtaacttctgtattttctcctgctttgtcttttctttttcaggtaatcccattacagtattttggtttgctcagtggtgtatcacatatcattgaggctctgttaatttttctttattctttttctctttggtcttctgattgtgtaatctctcttgatctgtctttaagtttgctgattctttcttctgctagttcaaatctactattgaactctagtgaatgtttcatatcagctattgtatttttcaagaccagaatgcctgcttgttgtttttgttaaaataatttaagtgatttatatctgtatatggatattctgtactctctaagacattgtcatcatactttccttgtaatggctgctttgaagtgtgtattagttctcatgctgctgtaaagaactgcccgagactgggcaatttataaaggaaagtggtttaactgactcacagttgtgcatgtctggggaggcgtgagggaacttacaatcatggcagaaggggaagcaaacacatccttcttcacatgacagcaggaagaagtgcttagcaaagacggaaaagtcacttataaaaccatcacatatcgtgagaactcactcactatcatgagaacagcagcatgggggtaactggccccatgattcaattatctcccaccgggtccctcccatgaccacatggggattatgggaactacaattcaagatgagatttgggtggggatgcagctaaaccatatcaaagtgttaaatttgacacatgggccctcttaatgggagtttctgttgtctcctttttttgtgtgtctgtatggatcacacaattctgtttctttgcatggctcatacttttttaaattgaagactgaacatcttacataatgtagctattcttgccggacactaaaccccctctagaggagggcgacttgttactagcgactggatatacttttttttttttttttttttttttttaatgcagagtctcactttgtcacccaggctggagtaaagtggcatggtcacagctcactgcatccttgacctcccaggctcaagcgatcctcctgcttcagccttctgagtagctgagaccacaggcatatgccaccatgcccggctaatttttgtattttttatagagatggggattcactgtgttgcccaggctggtcttgaattcctcaagcagtccacttgcctcagcctcccaaagtgctggcattacagacatgacccattatgcctggcctggatatactatttagggatgtacattttcctctgtgtgaaccgctgatgtcattctcacagggtgcagccttggatatgtgcagtcattcttgggtgtccctggttttatcaggtgtctctttgcctttttctctgatctctctcttaagatgtctgcctgtagtaatgtcacacccagatcttagttccagtggcttctggttgatttctttattacttttgctgtggaatatgagttgttccacagtgtgattcagttaaatttgggccttttttcagtggtagtttttgaggtgagtccttgaggttttttgtaactccaggagaactcatcttatgtttctttccctgggtttcccttatgaactacctgccttatggttcagttttttgttttcaggaagctacctccctcttcttaattgtttgacatgaacatttttattgtttataagagtactcttaggtttgaacttccctgcatacaggttcaaataaagtcagttcctttggggggacctctctgttcttatggcttgtgtcttctgggaaaaatctctgggccactgctccagagctgaggatagtgacaatggcccacttctctcagagttaaatttctgctttatgagcaaagtactaggtataggcaatagcctctagtcctctcagcttgctcttccttgtgtgcaatctctacccagtaagtgaggtgaggcaaggataatcagggccctggtgttattggcatgatattcctgaggtagaaccttggctctatgagtgggggctggatggagtaacagaactcctgacctgtcagctgcactttagtctcagctgcactcagttgcagttttgtctctgtgtagcatgggggagagagaaaatgagaaatgctggcatcttacccctctctgggagataccatagccctcaactggtggctggggtagagcgagctctgtgttttgagctatacccatctgaggtagaatgactgtcacactggactgaagtggtgtgggttatacttcaaatgccatagaccttcactccttttaccagttttagcagattttcatgtattattgtttcttcatttgctgtttgccttaaggcaaatttccagagacttcaaagagttttcatttttactatttttgcagttatatgtttatttttatgggagtcagtctgcagaggtccttactctaccattccagaggtgacctcttaatggtcatgtttactggcttgctcaagacagggtttgaaattaatttttcattgagctactcaggtgcaaattgatattatttaaacatgtggttaaaaatgtttcctaccttatatctcaaaaagtgacttttaaatatagccctcatctttggatcaggttcaatataagtcccatactcagaaaaacagagttccaattcaattctttttgcatattaactgtgagatcttaagcaggttacttaatcaccctcaatttatttgctcatcctaagtattgagagagtagtagctgtttgtaagttaagttacataatggatgtgaaagcttttgaacttttaaactctaaaaacttaaaacacaaagcattgttattaccactttaaatcaaatgcagaatgaaatgaagtgactttttctgattttattcttgtctaagaatactaagtataacatttattttagaaagtcatttatgatttttaaattcttcatattagcatgtgatactcttataaaatcagctaagatatcacctagaaaatgattactttagatatgttgattgtggaattacattagtagaggtggaaaataacatttttagcttgtgtctgttgttaatagtataataattcttttatctgttcatttattgtggtctttttgatagttctctgtggatctcaataagagttcatttttatatgtgaaaatgatgaacatgacccaataatttttaaagaatcatggaatctagatttggaaggtgatcttggatttggttaaatctagtaggaattgcattctcaggtccccttcaaattcttacttggccactacatgaacaaatcatggacagaggattactgttgcacatagcctctggattccattttcactacacttcaatttttagggtttttgtagtttagaaaacatgttgtatcatgcatttcatttattctttacttctgattcaggtgttgccctattttgcatgtgaggaaatcaaagatcaaaaagatcaatggtttactcaaagttataagagtactaggaattaaaaattatatttatgatttttgaattactattttacaggaataagcatatgctacctacctggtactgtatatcataaactgaaagatttttgaaaagtcaggaatcccgcaactcaacacattcacagtttagaagggaagaaaattcttaaagcagcagttactgtttagactgaaatactgtggtagagatgtttcagtgatctgaaacagaaaaatggatctagattagttaggggtaacttcatggaagaagacttttgaaatgaacatcatttaaaatgactgcagtaatgtcagctggaatgatttctaatacaatctcagctgccactttttaatttatatctgaatccaaatcttcctccattaatttccacagccttggttctgtgttaatacaaaacaaattaaatctctcttccatgtgaaagttcttcacctactgaaatacactgtgtctctcccagatcttttctccaggcttttcttcagctgttgcatctaacttttcaacacataatcattattgaaagatggtaggtaataatgttaatttggttagacagaagcatgtgctactaccatgtttcctcctctctggtgaaataatggtatgttgttcattattgattatatttatttgtttttcttgaagtttttcttctggtcaagaattgcttctggctaattagtagaaaatacaataacaattactcgatttatattttgccccatattagtctattaatgtaagctgtttgagagccatgcaacattttaaacatatattttagctttttgtcaatgtataatgatatacattgatataatgatgtcattatatcaatgataacattattagattttttctaagacaagtatatcttctcactttttccatataaattttcattgtattaggattttcccatactgaacttttttttggaaaaccaaatataggattcctcacttgattttattaaacacaatcttgcaaatttggggtcattcttctgatttacatgtatctttttttttttgtgattcctaagttttctttcctggctaaccctttctttaggggcctgtaagaggaaatcttagataaagtttgattcctaaaaatgctaccagacatggtggctcacacctgtaaccccagcactttgggaggttgagccaggtggatcgcttgagaccaggagttcaagaccagcctgggcaacatggcgaaacctcatctctattaaaaatataaaaattagccaggtgtggtagcgtacgcctgtagtccgagctacttgggagactaaggtgggaggatcgcctgagcctggaaggcagaggttgcagtgaactgagattgtaccactgcactccagcctgggtgacaaagtgagagagaccgtgtctcaaaataaataaaaataaaataaaaataagtttaaacaaatgccaacatatttccatatatttacacattgtttatgctgtctttagagtatcctggctttaaatcctcgaacacaaactcatgcaactctgcgttccacttcggccaagaaattagacaagaaacattggaaaagaaatcctgataagaactgctttgtaagtaccactgatacactatttcatgctgaaaattacctcactccacacattgtaaggcaagattttacatacacttagaaataaggtattaaagtacagccgtgattttaaaaatattttaaatatttaatatttgaaaaagtttgaaagtgtatttttaattacactgctttaaaaaatctcctgaaatacaaattatatacaggttgagtaacccaaatctgaaaattcataatacccaaatctgaaacaaatctgttgtcaagcatttttgataagggatatgcaacctgtaaatttagtttggtgccaaaatttcttttttcaaaatctttaaaatttgttttaaaattgttttgcctaatgacacaatgatacagaagagttttcatgttaaagatatagtctaaatgaagaaagctatagatacactggtatctgtggactttaaaaatacaccctcacaaaatatatgaacattagatgttctatgaacacctaatatttccaggtgaggtgtaggagcaaaacagcatttctctgagattattgctagaactttgtttaactgtatataggaggtgattatagagctgaaactgacaccatagatcggatataagtacaaccttaaaggtgatgttagaaattccatcttaaagttatatacgtttttaaattttgaaagaaatgtctttttatctgatttccccagattaccccaaattaacattcccaaattaatgagtgagacagtagtattagtttaacattagctcaattggaaccgtgtatatactttcttatagaatgtatgattttagtttatgtacttctttcctccttcttatattatgaactctttgaggatggaaactgagggtgtgtgctcatgtgtgcttgtatttatctaattttaagtttttctatcaccagccactgggcaattttttttgaatgaaaaaagaaaaagaaacagagaaacaatgttacatgaaaagatcccatagtcacttaattacagacatggattttgaattcagtttttcttgttccagttttgggagctttgttttctatcatgatgcttctagtagaggtctctaaaaggaaaccagtgtgattcagattgttcaaggaataggccacttacaagccatgacgcagtttaatgataagagcaattgaataacactgaaaaaagaatcatataatttttttattatagttttttttcttttttttattattattatactttaagttttagggtacatgtgcacaatgtgcaggttagttacatatgtatacatgtgccatgtgctggtgtgctgcacccattaactcgtcatttagcattaggtatatctcctaatgctatccctccaccccccaccccacaacagtccccagagtgtgatataatttttaaacttagaaagcccttaaagactatcaagcctaaatctctaatttttaaaggtctgagaactatgatcaagagacactatgtgacttccctaatgtctcgcatttataagttttcaaagtatttatggtcaggactttatttcgaaatggagactttctttattttgattgctgttgttgttattttatggaaattagcatttgtatctcataatgtgatcctataaattgagtttattttatcattttaaaaataataaccaaggtacagtgaggtccactttctctgtcaaatatatattgacccaaatatttataaaagcagtttgacaatatctttgacaatattcatttggacctgtgatgctatacctagggatgctatttatacctacggatgctacaagaagataccacagactaggtggcttaaacaacagagacttattttctcacagttctggaggttaggagtcccagatcaaggtgatttcttccaagacctctctccttggcttgtagatggtgtcttctccctgagtttttcactttgggtgtgcgtgtgtccaaataaggacatcggctatattggattaggacataccctaataacctcattttaacttaattacctctttaaagactctctctccaaatatagctacattttgagatagtgggggttaggacttcaacataagatttttgaggagatatagttcagttcataacaatactttaaaattatcaaacacttgcaccagtaatttattttctaataacatatctgaaggaaagaattaggaatatagataaagaattaagcacaaagaggattatcttaggcattatttactcaatggagacaaatgtaggggaaatcccactgaattccaaccagtgggtcatggttaagcaaattagagtaaattaattcagtggtatattgtgcagtcattaagatgtttttgaaataataatctggataaattctatctgcattacatggaaaaaggatttaacatcactgtattcaatagtgattgtgtacacttacacataaccatacctttatatatatatgcacaaaagaacaaaaaaatgaaatattaatattgattatattttttggcacttttgtatatttcaggtcttctgtaatgagtattagtagaaaaataaaatgaaagctttagatctatgttaaaatagtaatctcgatttataagatcagatttattgcactgatgtctgttagtttgaagactctctgtgacattcatgaatttctcagagcagtaaggtttattcccaaaagtgaaatatgaagctagggttgaaagttattctcggtgtggttgaataatgctgctccttacgtatttgttattatcctcttcatgctggcataaataattgaatgaaagtgtcaccaaaacatatggtttgtttttcaattcataaagacccaagtaggatgctggaacttttatccccactagctagccagtaaccagtaactgatgagatacgaaaaagttttcttcttacctcactgacatctccttcttgtttttcttcacttctttgttgattatttctcctctcatccctagatatttcagtgcccagagctcaaactctctttctttcttttaaaatagtcactacattggttatctcgttatctccttacttttaatactatctttagattgaagattcctttatatttctagcctgcattactgtctctctatctatatattgatatatatacatatatctctctctatatatagatatctatctatatataggctatatgtttcttatgttcacttacccaaaacagagttataattggactcaacaattatagaagtttttcttgaggcattatatagtcctctcttactatctgccttcttcttccttttttctatttctttggtgctcgaagcatcttatttcaggcactgtattgaatgctactcagaggtgaataaaatctagcaaaataagtagtctaaaatcgtttattaaaatagatacaaattttgtttaataagtaaatcataggcttcttagaaaataagcatgtgtttgaccggtaaaagtgccttaagaatggcagttctgaaattattgcccaggaatatcttcacttggtagtttaatattcttctagtactaattggaaattctgacttcagtaggggatttaaactggcaaacatgtttatactggttaatgaagcatgaagcagttatttccagtatattttaagcaggtgttccataactgctgtttatttttgccatttttgaaaatgttgaactatcctaattacataaatattttgcactcatttttcctgagcaatttttgaagaccagaaaatattacaaatcagaaaacttatgctaggtgaaaattaaaaggaaaggcagttaaagacagccaattagccaattattagacttgtttttaagaattatagcaaatttgttctaaatgcatgacacatacaaggtgctcaccataaaaaaaaatacaatgagaataagctataatgtatattaagaatttgcaatgctttttgtgaagtaatttatttaagcttcagaagcaccctgtcaggtatacattatattttatcatccattcatagatgagggaattgaggcacatggaagcataagaaacctattcacagttccacaactgaatggtagaactagagactgaacctatgcaattgccagagagctcttttagtagaatttttttgaataaggaaataaaagaaaatcattgacttattttccttgtagacaatgaaaataactaaataatatatgggttttgataatttttttttcttgcatgagcttcacaatctcagtcactcgtttgtttcacatttattgtctgtgccacttgccacattgaaatttatgtgacataggccttgccaagaagttctcacattgttttgaagaagactgaaataccaataaataataataatactcttttgaaggaagaacagttaaggcgttttaatgatcagtgtgagttgatcatatttgcctttaggtgaatcagtctagctttcagtgtggaccatggatttaatgaaaagatgggaggcaaggtctctgggactgggtttagaaagttggaagacaggtgatgaagactaggagggaggatgagcttgaattgatttaggagataaaacacatatgatttgggagttgactttatgtgtatgtttacttgtttatagcataagttgagggtaaatactaaactcacttttggattatttgaggtcttgtgcctgtggatcactgcaaaagttgaagattagtaaagggtctgggatggagataaagaatttttgaatcatcaggatatatgtaaataactaaaagcctagggggagagttacccaggaagagtgtgtaaagtggaaagagggtgcaggttagacctttgggattagggcagaaattagagtgaggcaagtgaggcactggcctgaggttcaaaatataaggggctaacaaagactcagtaatctagaaaaacaataataataataaatatatataggcacacacctttttccttttgcctcaggctccaatgtggctcagcatggtactgaacgtagcatggaaaaggcaggcagagatgagaatttagctataagcactatgagaggtgagatgagaaccacaagagcatagtaggggacttccatggaggaaggatagattaatatgtttttctaataatatttcttatgttccaaatacgtttaatttttatacttttggaaattatacttaatgtttgtcttgtctgctggcaccatttttccttctcaagtttacatggctattaagagatgaaatccacttaattagtacaactagcagtcaatctcattcacgctttcatggatagccagctactgggatctgttaaatttgatggagaatatatgtccctccattgacatatcaaattcacaatatgaatttttatttttaagctccaaagtaaataaacttttcaccagatacccagtaagaaagcaatacctgttctacccttgcctcctgttatatgatatttgaaaatactttctcaagcatgagcttgcttttttgattgttgacaattattttcttccaaaaatagacagtagttgagtttctgaaataaaaaaataaaaacagattctttgcaactaaatacctctttcagtatgtgaaaaatgcagtgtttgtatagagcatgcagatatccaactagaaactcaggcatgcaagtcacgtgacctcttttattttcttgtaactgaacttaattctattgtaagtatctgtgagagtggaaacctgtgtgtcacttgtagtattcatttttccctgcttgtccccctcaccccttatttctgcgagctgatacctaagttttatgagggttggtggcaagtgtgggctgtgaggtaagcccagctgatttttcatgccatcttcccactggtcaccatcatggggactttggagtcatctttcattttcattcattagaaccctttctatccctcacttctctactactttgaagccattcttgaaaagatgacagtcattctgatgttccactcaacactggggttcagagaagttcatggttcaatctactctcccagggcttcgtttgtcgagtcacagattctccatctttcatttacccacacctggtatttgtcagccctctgagaatagcctaaggagctgggcattgatcctctttctccaagatctgccaatatctctgggcccttcactttgcttttggtcctcattttgtctctctgtccattaaatatttatatagactgggtgggaaggatgggagtggaggaaaaaagttacttttaacttatcacccatttcctcctaaatccactgtcaatcactgaagtcctttcaatttttctgaaaacgtgacttctaaaattctaagtccaaaagaaacaccctttgtttctctgctttctgtagttatattatttccttcaagaaatgaaaacccagtggcttctctgcctaataggtataaatttctaggtggaatgggaagggatggtagcaaaactacaaccacctcataaagactgattttgaatttgaatttatcatgaatgatgatcatctcctgccctctatccagcaagttctcaaatgaaggctgttggagtggggagagatggcagagtaagttcctatttgggatgggaaagattatagaaaggtaggcgagggcaggcaatgccagaggaaccccatgttgggaagctgggacattacttgcgtgatcctaaaactgagtgccaacttaaatgtagtgcctcagtgcctcacttacttcaccctgttactggcccaaagggcttccactgtcctggaggtaccagccagcctcaagacccagtagtgtctccacaggtgtttaaacttcagtagcaactgcaaaaccgcagtagcgacccagatggatttggatgtccaggttgagtcagaagtacttgctggctcactctgtgggatttcctggtcattacattaacttctgaattgcactaccagtcatgacgcattattgagtgttttggaacacttgataatggtatgattttactgtgaataatatattactaaatatattattattttcctatccccaagttaatttaactcaaaattggtagacatttgaataaagagatcagtttgcctatgacatcttgatttgagaaaaaccccgtattcaactagttctgcaagtaaattatgtaaacataaatggcatacatacattttaaaaacaattttcctgtggcatttgttgagaacattgcaatgaattagaaaaataaaagtttactttgaagtaagtatattttaagtgatcattactgggcaatagctttcttatttctaacaaatgttagatattattaatgtgtaaatttaataattttgcgtgtgtgtcttaggaaaattaaagaaaataacactttaaagaaaatgcgagcttaaaatttcagcagagggaaaaaaattagagagggaaaaatatactgtgaaatgtgactacctagaaatcccttcagagtataaagctcatttacacatattgtagaccttgtaattttgaagttgaggtggagtctttcattgtatgaattctgacatacaacaggtatttattttaaaataataactggctgcttatgcaaaggcattttgggtagaaagtttagagtctagttgtagatttcaagatgggaacagtggaaaatctcaattatgcctctcttgatagctacattcactccatagttttaatgcccatctatgtgtttattaacagccaaatgaatatctccatccaagatcctgtctgtatccagatgattcttatgatagttccacctagatattgtattggtttctgattatgactatgtcaaaaaccgaattattcatgcctattcctgcctggcttttcttttgctatgttggtagcaaaaataatcactttgtcatctaggcaagaaaactcagggcaattcttgacactaaaaatgctattatcaacaacactgtattgtaactaacatagaataaaagaagactcaaatgtataacatacattcatttaatatttttatgccatttgattttcatttctgcatgaaacaatgaatcattatgtcattgtggtacttgccatatttgatcaattctctgatgcatattttatcacagtttcacatctctggaattaagattcattttatagttaatctgataagaaagtttgtatcagtttaattagcagttttttgttgttgttagtatataaaaataacatatcttaaaaatctctgttgtctttggcactataaaataaagcatgtacagagagaaggcagaaaatattttgaccgaagcaaatgttctccaatttttattaatgttgttggtagatgtgatagctttccatagcactggaaattcatgaaaaggaaactctttgaaaataaaaacataggtatatgaacaatagtcctagtaactgcaagattgcagttcaacttagtttaggataattttgtcttgtatttccagaataaaaagcaattcctctgagtgtctgaatcacatcatttttaaggattctcaaatatattattttcctgtcccaaattaatttaactgaaaatattggtagacatttgtatagagagatcaatttgcttatggtatcttgatttgagaaaaaccctgtatgcacctagttctgcaagtaaattatgtaaacataagtggcataaatgttcatgatttgtaaaatatttgtagttctccttccttatgaatttatgatatgtttaatgtacacaaagcatttttgagtatctgatacaaatacctaatttagattatatgattcagtttctcatatattctttccatctctgtgctgagaagcaaatacatttcactcattttttctgaagttctatgatgtagggagtgcatctaacaaaggatttagctgtgtgacacagtgctgtactctgtaacagtatctcaaataataccggtgataatggtgatgatgaagacaatgaggatggtggatagtgaaccaggctgtttataataactaaattagttgatgaacaactctatgaagcaaatattacttcatgcatttactccttatactccctttcctgctttatttttcttcatagaacatattgccatctaacatactatttttcatattttacttgtttggttgtttagtcattttctccccacgagaatgtaaggtctgtgaagacctattttgttcacaactgtatcttcagctcctgaaatagtgccacacatgtagtaagtatgcaataaataacaattgaatatttactgaaatcttagtgtgtgttaaacactgcttttggtgctgagaatacaactgtgtactttactcttccaaaacttatattctggtggatgagaactattactgttgttttgttaattattatgattataatcctctttttattaatgggaaatacgaagcttggtgaagataagtgaattgctcaatctacacatatataaaaatgtattttgatattcttttgaagaatttttatgtaagttttatctactaacatacacctagatttctgtaagaatacaaagtataccctgaaacagcaagtaaaatatgaagctattgattggtttccgttgtttatatatatatatgaagtatgaactgtgagtattatctcctgaatatttttgggcattaattcaattgctggaaataagttaccttctggagtaatgaacccccttaaagaattaatttattgcatcacacttttcagtatttctgtaacaccactacatataaattatttcactttgaaacttatatagtataaatatttgaatctaaattgtacatatttattaattactaaatattaatggaagatctaacatgttccagccactgtgataagtcatgggaaagggacaaaacggtttttgcccagacagctaagtgggcatttgcacaggtgttaacctcatttcacgatcaagtttcgtcagtacagccttccatgggagttacagctgaagtactgtagcctggtctcagaattcaaggttggcctccctgaggaaccagaatttaaactgaaaataaagatgaaggagggaaggaaggaaggaaaaagaggaatttcacgagagtagaaaacttgtatctgaaagtccgaagatgggggagcatactgattgaagttaagggattgaaacggtgtcagtactgcatggctgaagtcgtagactggagcatgaagaaaagtaccaagagatgatgctgaggacctctccacagagtagtgacaatgatgatgatgataaatatttttttctcgaaaagttctatagtctggttatttcattgagaagtgcatgttatatgttaaaaaggcacattctttgtttgtgatatgctgtaatttagagttttgatatatattagtatccctctttaaaagtatgttttttcctagtgcttcattccacacatggaccagtgttgtcagagatttattctccaggcagaaatatgtaataagatgataattgactaaaaagaagaaaagtgttaactcttaatttcctgaggctgttacaaaaatgctttgctttaattatttatttcagactgattgcaactttctccacatccatgtgacacacaaattaaactcgtttgtaattgtcagccatcagccttgttacttttattttgttcttcactggtttgaaattttaataatggttaagcagggtgctctatttttttaaacaactttatggttaatggaatatagttatctactcagggtttaaactgaactggaaaaaactttcccctgtgtaaggtatgtttcaattagctttatttgcaaaagaagaaaaattttcccttcacagcttccttatctttgaggttgggtttttatgagggcaggcagtggaacccaaagagctcagttgtcagtagagagtttggttaagagagtaagctctagggataatctgcttagctccaattattggttttgccatttactagagtatgaccttgagtaaatttctgattccattactgtctccatttcctcatctctaaattaagagaataatatctacctgatagagtaaatgagtcaatgtgcatagtattcttaaaatcgtggttggcatatatataaccttatgtaagtattattgcttatcattatcagcatttataagggggatgctccgaggtttctgttactacatatggaagcacatcatgatagtggatagagaacaatgtatatggaaaaaccatggagaagtactgagcagcaagatactgaggatggtaatggaagacagaatatttcctctattgcccagaaatttcctagtagcatatttctacagaaacagaaagaagagagagagaaacagccacaaaaatttttttgagcactgtcttatatttgcatatggatggattctttttctgtgatttttttttttttttgcctgtatttctcccttctccaaaaagcctcaacatgatgccttggtcttggagaatttttatcataggatagaggtttgtattgtcgtggggaattccactctggccgaagctctcttgtgtgagctcctgcagggctactaactgctaacctgaaatgtgttccctctcttagaatggcccaagagtgaaatatttattctccgtgtctgacaaggaaatttctcttgggagaagaagttgttcttatagactacgtattagtccaagaatattgagaagggatccaaaagatctggaaccaaatagattgaatttgtttacacagaaaatctttgcataatcataaatattaaactggaattgtatgatgtattataggtcaataagtagtatataataaagcagatgtgtgttaagactatttctatgaaaacaaaatatgtatattttaaaagatattaatgaagcatattactgtatttgcaaataagaaacatctttgcatatgggaaaatacagtgctctgaacaaaagaaatcagcaaaattgtctttagagtctaatggtatattttacctttgcaaaacatttatttggtgctcatagcaaataaatatgtgagttttgctgttttcccgaatgggcatacaatggcagctgtctttctaatcgttcccctattcaaacactaatcggtggaacccacgtaaaatgctagaggcctgaataggtagacaatggcagcagcgtttttaatcacagtcctattcatgcactaatcggagtgatgattaaaggacattagagggagcactttgacatctgatcctttgaactgacgtctgtgcaggctgcactccatagagctcacttggccaaactgatttccttaaataaagtgctgtgatttccaatgtaggaaatattacattagagcctattgaaatgattaggaattgaggagcttttctttaggtgggaatgtggtgtatgctgtatactcacaaaagtgagatcattaatattgcatgtactactttgaatatcagggaccacagagaaatagcatgagaaacgccttcctgcagtcatgcacttaaaatgaatatgaacaaaaatgtggaactctgctgtcatagctctccgttattgaagtttatgaattttgaaatatttgtatttttatataacacgataaagatccacacatcctaactgcatttcatatttttgttttcattaagccaggatatttttaatgttacctatcttgaagttgctttaattacaaaaaaaatgtgttataccctatttgcatggtcatgctttgattcagtagtcattagtgagacagaatggaatattttattttctcttttctttcaaatttctaatatctatttagattttactaacctattccccagaatatttcatgtgatttatcctaaaaatgttaatatctattcagcatttgcaaattgaatcagtagttaaaattccaacatcaatatttgaatatggagctccaaatatcaataactgtatatactacatttatgtgtaatgtatgtaggggaagaaaaaccttttcctttaacctcttatgttcagtggctggggcatgtgaattaatctgacagaagacagattgacaggaaaacatgcatacacattgtatttgatgttcatattttaatttatatgtgcacaagaccttcacatgaaagaaatgaagacagaaagaaggagttaaacccaggggcttacataccattttaataaagggagataaatcgtgcagaagtgataacacaaaggaaaaggggtttgggattctaggggtgataaattgtgggaagataaatatatgagggataccaatggaagataagggctattttagcaaggtttgtttgtgcaaatccatcttggtgccaactttctgtatccagtgataaaggattgttctcctcctggtatggaagaagggaggggaacaccttcacaaaaggaaatttatgtctgcttttaggcagatagggagagagcaaagagcaaagagctctttctgcagtttgttgtttcttaagtgctttcagctcaaaatggtccttataccaaggtgacatattttgcggtgacattctgaccccctcacatacagcctctttggattgtttcctttgtttattatatttcttatttataggattctttcctagaagataggaatatttatcacaaattctggataaatttgactgtgatgtatacttctgaaggtacctaccacacaaatccacaagtttattggcatagacccttgaagctttctttgtaccacctaactctggccctcattctggccacttgaatctgatggagagaactgaccgaggctggggaaatcagattctctcctagatatctatgacaagagattctttttcattctgggctgtttgagcaggaataaaatgaaagcttggtgctgcagggtggccattttccacttgcaacatgtactgaaaatcagaaaaggccaggctgaggagagagaagatagaggcagtcatagaaaaagaagctgcgcaggtttctcatggctttgtgtagggagagttttgcaactttgtgttttgtgagatactcttggatagactctttttattggcttaaactatgtaaatcatgtttgagatatagacaaccaaaaaatcctaaggagcacagtggtatatgtcaagttttaatgacctagatagaggtgttttatttttatgggatatgttaaaattacgattaagttgtgtgaggcagtagggtataatataatcagctctgactcagagacacatgcccaaactgaaatcgtctctacatttactaacttgatcttgggtgtgattcttcaccttaactagctagctctagtttctttcactgttaaatagaaatcttgataattatggtaatctaactacattattttgagagttaaatgaactgaggaattttaaaagggtataatacaaagtttagcacatggtaaatgctcactaagtagtactttttattattaatattttagttttacctaaatattggtaatgactggtaattggtaattcagatgattaatcatttagctttgatttcttcgaataatattttatcttttagtaataaattacagatatcatttgaagtcttttgtgatagttcttgttatcaagatagtatgttatcaagagtgtatgtgagaacccttcctttatggcctactgtggccccatttgtcaaggtatttaatgccgttgactccatttagattctgacaacttttacactttttgtttctcttcttcaattgttttcttcaaagatttatggttttcatgatataaatagtttaactccttggaaacatttgttcttaattatatattttttagctacttgtaaatgggattgttttcttgatttcttttttttttgggtggtttattgttaatgtgtagatatgttactgaatttagtatgttgattttgtattttgtaaatttacagaatttgtttattagtttgaactatttttggtgttggctttcgggttttctatacataagaccatgtcacctgcaaacacacaactgaaccttttcctttacgttttggatgccttttatttctttctcttgcctaattgctctggctaagactttcagtactatgtaaaatagaaatggtaaaagtgggtatccttgtctcgttcctgatcttagaggaaaagctttcagctcttcaccattgaatatgatgttcgttgtgagcttgtgatacatggcttttattgtgttcacgtacattttttctacacctaatgattacagtatttgtataatgaaaggatattcagttttgtccaatgttttttcctgcatcaattgagatgatcctatggtttttgtcctttattctattaatgtggtatatcacacttattgatttgtgtatgttgaaccatccttgcatcctgggggtaaataatgcttgattatggtgaatggtccttttaatgtgctgttgagtttggtttgttagtgttttgttgagtagttaattttgctttttcatttacctaaaggcttctacaactcaaatctttccttcatttcaaagcagttttcttctcgtatcaacagtggcataacccacaattattcatatggttcttccttttttgagtacataagacagaagatgtagaggagtgttcactgcagactgaacggttggttatgagaactgaggtccagagttaggacagagtttagaactacgtgagctcttaataccaatatcagactgacagaagcaggcactcgtttaataaatttattgtgtttatgtttgagatatggaggttctctaaagtgaccctctgttatccatgtctaatgacagtattgaactctaatattctcctatctgatgtctctgcctctccccttgtcctcagacattaaaaaaaatgcaactgtattattattttgaaacctaaaatagattatgttttccattgtcttcctgtgtcactcagaataaaacctggtcctattatagcctacaagcccctatcctcatctcctgctgcttgttttcccaggctcctagtcactgtcttctggcttccttgatttttcatgaacacttcctgcggccttctgcctcaaggcatttgcactaccttttctttatgttgttttatatacatactgcacttccttactttcatcacatgctagctactcagtgtgaattttcctaacacgcaacatcatatgtaacattcatcatccagcattccttattactcctaaccacattttatttattactcctgactacattttattttctctacagaatttattatcatctctatctttactgttttgcctaatgcctctttccgtctctagggttcaagtttcctgagagcagtagcttagtcagttttgttcacaactgtaacttcagggtctacaacaatacctggcacctcgtggctacttaaatgaatgaaacaaagattccagagactaaactatgctactatctcaaatctaatcaatgatataaaaaatacagtcacacaatataaaaattgaagttcacatttaaagtttggtttttcaaattcatttgcttctttaaacacatccatcagtatctgttgtcatacctctaactcattaacagaaggccagtaaagaagctgtcttgtggaagccatgcttagccaccacatgagtaattgctctgcacgagccgtcctgtggcatctctcaactgaaccgaaagtcttccacttcaaagtctatggcaaggtggttaggagaatgaatggaaaatagaggtttattttagatatacttttggaattagtttttgaggatttatcccaatgctaagtaaggaagttatctgtctgtggccatgtaactgcatgcatttccatctcttctattatcaaattagagaaaacctcacaatatagtaaactcttcttaattcaaagataatttgagttactagagggtagggaattgtgtcttagtcttctttgtttcacctatgtgtatataaccacttatagctcaatagttcaatgaataatgaaaaaatagaagttgtattgtatatattaatttcaaatatatgccagtgttgatattttcaattcatttaggtacttgtttgtattaggcttcttttaaaaacctggggttttaggcagagacatttagggcatggttcgatcagaattgctgttgctcagtcttcatggtctgcccatacagttctgccaattacatattcatagtataattggcacataattgttattgatctttacgctcatttgagatctacctcttatactgttaaacacacacatttactgttatttttagaaaaaaatttactgcctatatattgtgagaagaatggaactgtgtggttaatcagagggtgaaggaggatggcttgaaggaacagaacaagatgcaataagaaaatgtagatggaaagtctatggtaacttttccatcacataaatgaatgaatacccagtattgaataaatcatggattttaggtcttaacattccatattctttgaaataaattattttcaaatatccccagagatatttccatattttcagaaatattatcttagaacaaccacaagcacagagtatatagaagcttgagaacacctgtggtgagaaaaattaaatgcatctcatatggttcagtcaacaagcttactctgcttgttagagctgtttattttaaatttcctataaaatccaaataataggcagacaagtctttacctgaccaacttgttgtgtaagttgtcttatactgtttgattctcaaaccccctggtgagaatgtcccaaagcctatggaagaagcagacacatacaaggcagtagacattttttccctctccttctgcagcaatatttcctcctctacaaacacatagcctaggtttgttacttcaaaaaaaaaagtgaaagtatgttattacaactagaagcattcacagatataaccagctaaataaatctcttgccctcacctagaatcaggcttcaaaaacactatccattctctagaaatgccaggctctcatatcttactcttaaagccaccataatgtggctttcacctcctctgcaccggtgaaactgctgttatgaaagtttcaaatgacctctttgttactattaataaatctggtgaacatatttccatgtgtttccttaccagaacttcgtataatttggcactgtggataccttccttctcgaagtatttttcttcttagaacagcttctcgagtcgccatcctcactattcagtattccttctgcccatctcttccttggcctcagtttttatctaacatctgtcttaagctttctcttatcaagatttattatctacagaggtgtggggggaggaggggagagagagagaaaaaagagagagatgcctactagacttctttcagatgtaacttcctttcttccaaatcaattccactccttagtggcctagagtcatctctttgactcaggcctgaaaacaatcaccattcaaatatgtttactgaatccaatcttgaccttcaggcttcaactaagatttcataccttctggaaaatgaatctttcccaggcccccagccccctgagcctccctctaatatagcccactctgcccgcttctgcttttctttgtccttttttctttcaattaatcaatctctgttgagggcttattaagtgcctagcactgccttaacatttggaaaataacaaaacagaccaaaagttttgcttcatgggactctcattctagtcacggaaagacagacaacagacacttataaataatcacattatacagttttaaaacttacttatattgtattaatattgctcgtttacttgtcttttttcccaaggatataagttcctttacctactaagttcctggcattttattgtgtgcttaaaaatatttattgactctagaatctccctttcacacgaaatcagtgagtgctcttgccaaattaggctggtctgtattccagggttttatataaattagctttagtccaatgtcaccttcatgctttattaagactctagagataagttgcctctggacagatctatattactgtgttacatgcattaattattttatttttattctagtttgaagggttttttaaaattggttgctctccaatattatatataattatatatcacattgtaacttagcgttataatgaattgttcatcgtataaagacttctagaaaagtcttctgctagttgttacatacaaggcagaatttaactgatttgtgggcagtacatattgatctattccattaattttaatgaatgcataatattctataatatacatatgtaattatatatttaatcatctttttctaaggacatttactacttctgagtctttaccattgcaaatcatgtgaccgtaaacctctctgtatatatcttcttatgtatatatctgcatggttctctaatatagcttcctagaagtggaattgttggtttaaacagtgaatgctgacaaattattctctagaaaggcattaccaatttataatctcccaaatagtaactgctgtttcccttccctttttcagacctttactttatagatataaatgctgttatgtgtgtgtaattttttcatattctgatgatcatatggcatttctttatcaaagaaaggggagggtaacctctgaatctgtggcctaggtcatgttcctctgctggatgccctcaatgcataccatatcacattttatcctaatgattaatatcattattattatatttcactattatcatttcttgctttaacagtcataacttcttgagtaaaatatatcactaagattaaaaaaataatgattacagcttggataggtcttgggtataaacattttctcattttattttttgaaaagtatttttcgtattacagttttgcctagtagatattcgagattgatgtgatgattttgtccaaatgggcatgtttttcctgttgctatatttgttatcattttctcattcacttacatggtagtgagaaagtatagaataattgccttttttgaattgactataaaatgtttttaatttgatataatattaggtcattattttttaatgttctaatgtttattgagagtaaagtatatcccctaactgtgggatattatgtttgacatataccaattaatttgagtttttgagttacattgtttaaacaatactgtcaggtctctgtttgaacaagtcatatcacacagtgtgcacagtgtagataaggaagatgaacaataaagaaataaacaaatagacaaaattttagatactggtgaatataaaatagggagaagtaagagttgttgactggtcagggaatttaggttggatagtctccaaagaggtatcttttgtcatacttgggtagtatattattgtggcttttctttttgcttatttaatatattttttctctatgcttttctctttaattggatttctcagcttgtgtctggcttgtttctccttagtgtatgtttgaatttaaatataattccaggtgaaaaatgtagtctattattgatgactggaaaccatttaaactcatagtaataaatgataaatttgtttctatcaagtgttaaatgcttttatgagtttgtttttaaatctttttactgttttctgttttatcgtacatatactctggtatattttattgtcttctgtagtgatttaggaggaaaattcccctttaaaaaataatagtggttatctttaagaccttattaactatgtttaaactgagattgttctaattttctaagtcagtgattaaataatagtaaggattttaggatctacacttctattcatgaatattttcattgttttgcatttcttactttatgacatctttgttttatttacatttatacatttctcctggtacatatgtggaaaagagtctttagagtgtagggggtcatagaggctgcaaatgtagaacattgtagcagaatgtcaaattgtttatgctatttatacttccacagcaacattttagaaataatcttaatccctttccgcattgtctccaacaattagtattgtcatcctctaaattttggttcacgttggggtgtaaaattatatctcaatacattcataatttgacttttcccaaattactagtaagggatgaatctaatgagtttgaacatcgttttatgcttagggctttgcatgtttctcttgtgtgccataactccatgtcttatgtccatttttttgttgttatattgtctttttattattgatattgaagagcactttatataacaaattatataatttttacctttatgtgttgcaaatatcttccctcagtttgtggcatatcttttcactctttttaaattttgatgaataaatgttcttatttttaatttggttgaatttatcacccttttattttacagttatttttttttgtttaaaattcattgaagttatatctcaaaatgacattttcccactacttttgtgtaaaacttggtaagtctttacaatgatacaaagtctttttttcttcctgagttaaggagcatcttcttttgctatactcagcttactgtttctgcatcatttgttatgttttattcttttaagatatccactatccatgtattgaatttcttttactagtacaaaatagttatcattttcccttaatttattttatgtctattttttgcggtgtattttgagaaatgatctcaaattgatctgtgatactagtaaattgtctttctgtctgtaacgtcagttctattttctaatgcttacaaaggatttatgtttctattattgcattttagttttctataagtgcctttctctcatcccatcctcatcttatttagctagattttatctcaaaagatatataaaccttaaaaaatgttgtcctgatctcttttttaagtccctcctttttttttaccctgtagctttttatcgtttgagaggacaaaacattttctttgtgtattaaatatctttagagtaatgctttccaatgtttcatataatgtgatttttttaattactagagttgtttttatatggcttttgttttcagtattttaggttagaaatagttttagccattttctgttaactgactttgtatctattatttcagttgcaaatttcagtttctggtttgtcatttgtatggaatgtcgttgtgcactgagaatgtcactggttatattttatttttaacttaaagatttgtccagtactcaggtgcctcatatttactggaatttgtgtatttaattttttactttgtgcataattctctgctatgtgttggtttccactatagatatgttttatttcatttgttttagaaaatttcataataccttaataccttatgtcccacagtaagctaattttatgtttttctcttttatactttttagtacaaatatggtttgcatctctttgtaattgttttcccgtagtaagtaagatatgtttaaatgtgatctcaaaaaatgtttagaattttatttatctgtgtagagacagggtcttgttcttgggctcaagtgatcctcccatctcagcctctggggtagctgggactataggagtgcatcaccacacccagctaatttttgtatttttagtagagacagggtttcgttatgctgcccagactgttctcaaactcttggactcaagtgatcggcctgccttggcctcccaaagtgctgggattatagccgtgagccaccgcacccagcctaatatttagaatttttatctcccatacttatgaaaatctgaggtatctcgtttgatctatcagagaaaaatatggaaaaatatcaaatggttacaaatatttatattcataatgagccaccacacccagcctaatatttagaatttctatctcccatatttatgaaaatctgaggaaaaattattaaattgttacaaatatttatattcatagtggaacatatctttgtcatttatatctttgtttacatttataatgagtaaatacgtgagtatttatttttatttttactattattaaataatgagtaaaagaaaggttttgcatactagtatactaaagagacttagagaaaggaatccttgtcgttgcttgtcttgctggagcctgttgacttcagtagtgatagcaccatgttcaagagaccaaagaagagacctggagctagtgaaggacacatagggtttaccaagagaacttacatatagggtggtccagtggtggtgggctgtacaggagaactgctaccgcttgtaaaaaacatgcagtttatatagcattttcacttagcgttctccccttagcatcctccatctgacaacttttaacccgaaacaaagggccttgatcccctgtacagcccatgttccccatgaggggccaggttcagatgttctttatagataaggaatgaatctccaggttgatcattcctggattccttagctcagaactccaaataaatattagttattgctttcagatgcatctgccatacgctgctctttattgaaaagggtggtgaatggtgttgctagacaacacaatcataccatagagattcttttttttaagcttacatattttatatttaaaaagagtattgcttagagttatttgtgtaataggcaaacagacagaaatcttaaagctgaagaataaaacataacacagaaaaatcacttatttttaagaacaaagaaggaaatgattcaaaaaggagggaaattatcaaaaattaccactagaaataacagaggagaaaaagttgagtaaaaatttgaaaaccgagtaaaattaagtagtagttaaattaagttctatgaattgtaaattcatagaactgtaacatgacatgttatgctgaatcaaaattaagtactactgctacataatatttgtcaaacacattctgcatttgggattaaagatttcatgtatatattcattaagcatatattatgactactattaaaattgttttgacagtagcaaagatttgataatacttaattgaatgaagtactaggtagtaatgcctattttttccccaaaggcttgtatgtttacgtagtttcattttttttaaaccagtttattttggtaaatatattagtatcataacttgattaaatttagtctttggtatacagaaataaagtttgagtttcaagcatcttaactgaagatttccctgacaaaattctgattacagccaatgttaatgggactagtcaaacaggaaaaacagatgtactatctttataatatctggaagtagaagaaaggaagcaatttattcatgaaattcacttttaaataagctgcatttattaaaacactatcctagaattgtaatcctatcaaggtttcctaattacttaaatagccataacacaataaaacaaaaaatcataattttgaagacacttgttgtgtttctggattattttagcagacttaacaaaaacacttgaattcgtggcctacaaatcaaataagattgaagcaatttagttatgcacttcatatataaataataatctaaagttataaaatattatcttacagattccagtcctatcaagcttccatttgagccactgtataatcacttaatagcagaagaaataaaagggaagaagttaaaattccttaagtaaagagacgagaaaagcattttgctataattctgaatctttagaaacagactcattggaagaggatcaacttatgtttcagaaaaactcccaaaccaacatttgtttttcctctgctctcatacaacacagcaatcattcacacagaagacttgtttgaccaagaagccccatacaccaagcagtagacaccagttgagtctcttcctagtcagactaacattatttacctggagatagtgttagattgcacaagctgaaggctcaggcctcgagactgcacccctttcagacactagtatcaagtcgggtctccagaacttcagaccagctagcttcaaattgagattcccatgaccacctctttgggtttgactaatttgttgaagcagctcacaggactcagagaaacacttgtttacacttgcctgtttcttgtaaatgatattacaaaggatacagatgaagagatgcatagggtgagctacggaagaaggggtgtggagcttccatgccctcgggaacaccaccctccatgaaactgtatgtggtcagctatgtagaagctctctgaatcctctcgttttgggtttttatggaggcttcattacataggcgtgactgattaaaccatggccattggtaatcagcttgtccttcagctccttttcccatccttggaagttgggggatggggctcaaagttccaatcctttaatcatggcttggtctttttggtaaccagccttatcctgatgctatcagtcaacattaatatacaaaaagaaagcactttggagattccaaggattttaggagttgtatgccaggaaacatggaggaagatatatactccatgatagctaggaaattgactcacttctatgtttaggctattttcagtgtatgtcttttaagacatatactccatgatagctaggaaattgactcacttctatttttcaggctatggggtctgaagacaaaatccagtgctggtattgagacccttcttgttgtcaggggaagatgtactgggcaaggcaagtttctgggaaatagggttcttggagaggttcatctttatagaataggaggttggggagaggatcctcttctcagtacctgctactggggatccctttgtaatagctgccgtttaacagaatgaatgataggatagattcagagcaccagaacctgaaccagaaactccacatcagtgggagagttgagcccaaaggaggtctgcagcatctgccaatgccagagataccaggagaaactcagttttgcgcttatggaggacctcctatgtcaggagggagtggtctgttggaaggaccctgcttatgcagtcctgagcctgggctgggtagtgggtggcatccggtccatatcacgcatgaggccttgcatttgcacaccttcacaacttgatactcctccttcatcagagatctggttagccagagtgtgccctggtggtcctcagaagtctctgctaaatgtttcacttggaatatcaaggatattaggatattttttgaaacatgtaaattgttaataatttgtcttatgtgcaggcattttgttttcttacatgattaaggtttcactcacacaacagaactgtcaacctgttatttgagtattttgctcattgaaaataatctggctttgataataggccaatgacctttttttttctaaaaacttttaggcttatattttataggtgtccatctcttcacatgcatgactgatcttttcacctcccttgggaagattctcctctatctttatggggtaaacacagtctaaataggatattttgtgaaaatatatttcatttctttgattcagttcaagaaggacttgaaatttccaccagcaattttgcctctcctttctgtgtgcgttttcctgttagtttgtttctgagtgcggtgaagctttcccagtttgcagacttttaatatgacctcccctctttcagttaatttagtgagcattcatgttttttgaatcaagattttctaaataactcagctccattagtaagattcttcaaaattttgattcatcttctaagatgtctccgtttctgttgcatttttatatccaagttcttagcatccatgtcgtcgtctccaagaacagtagcccagtctctcacctttaacttgtgttcacacagaagcttgatcagacttgtcatattttagaacttgtttcctacacattttagaattttctagcattttattctgcttagtatgtttgctccctcttcccttttccactcttcagcttcttgtgaaagcagctctgtgtttccctgaagattggaatttttatccgaagtgtctttcaatgctgtctgaagttgttcttcattgttctgatgtatttcgaaggctgttttggttgcagctacgtgaattgtgtttcgatgaatctcctaaaaactgaaacattctgtctttaagctaccaacctaaattgttctaaacatttagattttttttggtccttttctgagagtctttaatataagcccaagtaaagagttggggctttctagtgctttattaaagatttccagtttgtgaatttctaataatttgttcttaagtttgtcttctaccaaagttgatttaaggccatttttttttgaatgagacaaatctcataaatatgttttttcttctaaagtgacaaaaactccagtagtctgttctttgtccctacttgcatccagaaatctgcagggacctgtgcctgggcttagggcctctggcagcactaccgtcacctgtcatagcagttccaggaccagcttgacacagagcaccatggccaacaacacgttctctgtgactcccgaggccactgctgagctatctcaggtcgccagaagcctgcctaccactatgaactttcgagaacacacgtatacaattcttctctgaaccgaacaagtgcctggcaatgaggacagacctcagtggaggttgggaaggggaagcaaacagtagaacacagctttcccacctccttcacatcctgacactcagagactataatagaatcacctggcccctgagatatgcaggaggctgaggtgatgggcttagctgatgggatcaaggtcttgtcatacccataaagcattcatgggttctctgttgggaagcataaactgcgttggatttgcatctcctaggcttggccagtgctcctccttctcttaataaacttttcgttctgtggccatggacatctcaccctgctcatgatgggcacaagaatctcctgaccctgtaccctcttttgtttgtatttggctggtcttgaatgtacataagcagggggtatgggagtggtttggaaggctgaaccaagagtttcaacttacttcactaataccagctttcaaaactaaggaagagaagtattcagtagaattttcaaacttttcacgtatcagcaatgtgctatctaagttgattttaaactcttcctgaatgtgataaaatgttttctgacacaaaagcctttctacatgctagtgttcagaatcttaaactgggggcatttgatactgaatagaactctctctgctcccatggtaggagtgttggggcacctgagcttcttcccagtgtagtggatggctctttgaactataaccatgtattacataaatgtattatatgttatttttagctactattgagtatcagattgagaatatgcagtaagctaaataaacttttggaaattgatgtatgatattaaagatgctgcttattaaagtctcaacatctgtaaaaaaatctgcaaatacagatattttcatgaattcctttgcagaaatctcttgtgtttctaaatttatcagagaatcttgcacatctctgtctttgctccaaaatttatttgcatagaggcttgaaaaatcaagaaaaaaaggcaaacaattaaataatatgaatgttttctttttatgtatatattttctggataatagaaatggtgaattggtatttcctttttattctgaagagttaacaatataatcagcagtcaaatgtgtgagcaacagacaggaagatgagacaaagcaatattttaattctgttcctataagaaatgtcttttcattttttttcttatatgagattcttttttggccataagtattttttgcaaggatgagacagatttgcctccacatggactggtttattataacattttcttttaattgtctgagtatagttttgtaaagcaaaacaatactggaaagtgggagaacactatttatgttaactacgcaatcttagacaagtcacttgacttctgtgcattatctgatgatctcttgttatctgatcatgtccttcatgtctacttcctagtaaaagtgttagtctgaagataattgaagatgatgtgtaaaacattttggaaaatactaaattttaaataaactgtagctgttaatttattcatatggtttaatagatttactgaaaatcttcatttgggtaatattctagttatagactctaggccacatgtagtgtaatatgtatcacacttggttaggaacaaaatcagccttaaggttgtgctcagcaatatcataaagactgatgtttatcaagtaagcccacatttggcaacacaagcttaattgtttttatcagagcagttcacctgcttcagaaacttagtatgacaatacccagagagtttattgaatgaagatatgcttaagactgtgcataactgaactaacagcatagaagtttctgaaggattgatttaaatataaatcaataattaattcagtacattgatattgagcgttaattcaggaaactgatattaccatataataaactatgatagaacaagcactgggttatgcaacagacatttatacatagaggacagttcctgccctcataatgtttagtgcaggagggagacctacagaatgctacagtaaaacaagagaaacaacttgacacatgcccaagtgctaggatgcccttctgtgcaaccattactcagaatgggctccctgggtatcaggggagacttctgcctagaagtgatgtcatgatacaaaggggtttggatattgacagccaattgattttcaataataaattggtgaagtatccctgagggaaatacatctgaataagtcttgctaaagtagcttccagtgtgccagcttactaaattataatgaggaaaatgtgtatgagtatttgaattgtgacgaacatcattttttgcctgtgtttcagcttcatggggtaacacatcatcattataaatatgttgttgatttaacctgagaaatcatcatccttgaagaagaaaatctattgggagtcaaattgtattcagaaagttgctatatgagcatcagatcagttgaatttgagtaagacgaaaaatagttggcattatacaaagcagtttaacaatggaaatcactgataaaaatgcagtgttcattgctcaatggctacactccacttgtacaatttggataacatcatcattaatacaataagaattactgtaatagattccatgttattatgttttattcttcagtttaaagatgggaaaactgaattttggaaaactaccagctctgtgatgttgaggaggttacttcaactgtctagtcctcagtttcctcatttataaaatgaggatgaaagtaatatatactaatattagtaataacagtaaataataactcttatgtatgtgactccttaggtctggcacataataagcactgttatgttataatagcactaatcaggtatgattatcccacctaagagaaaatagaaagtaaattaaaacagaattcaaatgattagtttttaatgtaaggatttctgattttttaaatctaggtaatagctacttgaaatttcctagtgctggtccttgaatgcttgaatggcttaatttccacattctttcatttggtttccttcaggcatcaggtagctgcactttctttttctttctttctttttttttttttttgtaaattgcacagtctctggtatgtctttttttttttctatactttaaactctagggtacatgtgcacaacatgcaggtttgatacataggtatacatgtgtcatgttggtttgctgcactttctgcctggttcaaagatgcaagctttaagcattttcttttttacagtcctggttttcctgaattaaacacaaacacaaacatgtagacaaatgtagacagaaaatcctcatgtatagtgcattataattgatagaaaactttcacatatatttgtttagagcctagagcccagtttctttttttttttttctttgctactgtcaccattagccaaggtagaaatttcaaaagttggcctggtatttgctgagtttggaggactagggttaaatatcatatttggacttcgggacagaaactttctgtaaaatgttatgattatgtagagatttgaaaagactacataggggaggtccgaatgcacctgcatatttaaattataactatattttcttgaatttccgtgatgctgtatgccattcatgtgttttacctttatttgaccttgaccttacatgcactatgtgcatctaggagatttaatacatatagttggtgaaaggaataaagaatgaagtgacatattacactaacataaaaataaggagaatcctaatctgacctcatcataagcaatactttccacttacttatttgaataagagtattaaataaagggcaacagaagtgacatatatatatatatatatggtaattagacaatgataatttatgttccaaaattataaattgttagaaacttatcatagtgtataaaagtctaaatgaaaatgtccttccctatatatttttgtattaatagagattatggctatctgttcttcaaataatatctccttgagcatcattgctttgtgaaatgacaaaatattatgacatatttaacttatgaaagatcctaaagttctgttttaccctcagcttttcatagtatgtgttactgtgttttattacatagacaatttaagaaaccagaggacaattcatttttttctgtgaagtagcaaattggtaaggaatcatgggagataatatatcatattcttaaaaaggacatgtgttttaaaaatcaccattgatttgatttttaatatatcatttatagaacagatggtggagttatagttataagcaatgaagtacaaaaatcaccttgctggatggtttttttgtaggcaatttgctcgatcaaattaagttggaaaaaataggtgaccgaattctatagatgacactattggtagttttatttttactgtgatctcctgtgtttttatctgtcatgattgcacagcaccctttatattcttcttcttctcatttttccttctattcagtcactctggcattctgaggctgatattttagatatttaaaaccggattctactccagaaaatccatttgttttaaagaattcatatgagataaaaggactgttgaatcaaaggaccaaatagttcattaagaagcattgtaaaagtgaataatgtactaataaaaagtttcatacttcattttcatatctaagaatttagttaagcatatcttaatttatttctttaattaatacctactttagaagttaagtaacagagaaaattagagatttaacctacattttaccatttgcaagaaaggtacaaaaatattctataccagctgtaatcatgcatgactttaatcagatatttggagacctatttcaattgcctgcggtgttagctattcaaactcaaaatattctgtaagattcccttataacttgagaaacagatgactcatttcccttagacagctcagcttgtgcaattttagctgtggagaatgagctgtccattattttttatcaccattctctgctgaatgcatttgctctttcttcctttccattgcttgtgtttgtttatctaatttggattattagcatgccataatggtctataattttttcccctcagtcatttacttctcaggcaggaaatttcttagtgctcctgaggacaacaacaacatgtgatattttgtttttgttaaagtcacaaaattaaaagtttagaagacactcatgtcttcaggaaaagctctattcaaacactgctgaggaatattggccagtattgtttcctgtaattttgtagaaataaaatttgtaaatttgtagaaataaagatagaactgatctttgtgatgaatggcaagtgtggcaaacttaaaattaatcaaatatcttcctttatttttatcattattattaaggttctttgaaaattatgaaagataatacagttcttatttgtggagtgcttggagtgtgctggttctggtgccaaacttctaaggttcacatctaggctctgtcagtttctactcaggaaacctaggcaagtcatttaagctccgggcttccgttttctcagctggcgaaaaaaaaaaaaatgaatgtagaaatggctcttttacagggctgttgaagtgtttacaaattaagacatataaagcacttgcttagaacaatgccatatatagagtaagaactcagtaagagttaactactaaaggatttttagtgtacagaattcaggaaatacatatacatagaacaaaagcaaatagaatcacttgaaatcctaccacctagaaataagtcaataacattttgaagtgtgttcatttaatcttattctatatgtctatatttttatttaaaaatgagattgtagtgtatattcctagtttgtaactttgttcatttaaaataatatgcaaatgttttgcataatcttgtattatactacacattatttaagtgacttcagtatcacaataatatggtaatttggttatctaatgctctagagctaatcattaaatttttatacagggctttttttgtttgttttgttttttgctatcataaccaatgcctcaattggtgtaattgtaatcactatcatttcacgtatttaagagtatttccttaggatatatacagattttctttctaatatttagatttcagtcattacttacaactcagacaagcttaaattgatccaatttcaaatgtttggagacatatgactcctaatctccttataatacacagaaaaaaatcccgaaacctttcttcattgttttcctctgaaaacctttgttctttatttgagcttctctaaaacaagtgtaatactcaagatgctggttaatggtgccatgcagagggagattctgcttatacttaattatacaacataatctttcctttataagtgtgatgcaatagcactgattcatatcaaattaagcattattgtatataataattgtgcttgatattttcatgctagatacgcataaaagaaaactaatacatctgttgccctaataacataaaatataattgcatttcacagtccaacttcctgaatactctaaagtaacactttcacatcctcttaaaagatgaactgaatttacttcacttcactcaatatgacatttttggaaaatagtcactaaaagtttcttaaatgtttttaaatagaagtggtatttgtgcagcctgcaatcccagcacttttggaagccgaggtgggtggatcacgaggtcaggagattgagaccatcctggctaacacggtgaaaccccgtctctactaaaaatacaaaaagttagccggccgtggtggcaggcgcctatagttggaggtactagggaggctgaggcaggagaatggcatgaacccgggaggcggagcttgcagtgagccaagatcacgccactgcactccagcctgggtgatagagcgagactccgtctcaaaaaaaaagaagtgatattttctcttgttcgttagaggggtataacaattttcattaacattgaatattttaatattttaaatgctatattttcaccttagtttcctattattgtatgttctttgtgggtttcaccatttatgaatataaaacaatcatgtgctttgcattcacatagcccatccttttatttttaaattctggcatttgatatagagatatagcttgtgtatgacagagtaagctttatttggttatttttgattctgagaatcttttcctttaatagaaaagtttaaccttatttttaatttacatatttggacttgcattcaaatgctgtattagctcgcagcccacccctacaatgtatatagtatttctttcttttgttgtttttgctgaaattttaagtttttctcctgattaatgtcatacactatattttaattctgtaagtacttaatattaaattttaaacataattgaattgttttttataattgtcaataagtatcagagtcaataaatagagtcaggctccattgagtcccttcatttaagcagataaaattagcatgcctttattccctgcctgacaataccttctgttattttgttagaatatgcctgtgtttgaaatgtgttctactttttattttttggcactaggaatcctttttcaaagaatgattttaaatatttttattaagcttcataggtatgttgaagacataataccatttgcttaagtttgtaacacttttatttttcatttattttcagtttgtatgttacatattccttctatttaagaaattatgtaaatggagagagtttttgtttgagtaattatttgacgtgtttttgtagagattatattcttattctttagcagtcactgtattccaaatttattttgtggttcctgggaagaaagacagttattttgaggaaaaatataaaactccatgtccagttctaaattcacatagtccagttctaaattcacatagtccagttctaaattcatggcaatccgttggaaataaatgactgattcttaggtaaaagttccaaagtgtaagtgggatttgaaggtgaatagctaaaaatgatacctggggcagccatccctccctccactttatggttttgaatttcacaactgaaaagtgctgtttttttgaaaatctgtacttcttactgaatatttctgttatgaaaacatacgatgaactaatgttttattagttgtacattttgagaagttaaacataggtgaacaaataatagtcattaaaaaatagaaagtatgatgtgattgttttcctatgattttaagacaatgatgctacataactatttccctgtaaagacttcatactgtaatttgaataaatgcaaacattatcattgttgaacaaaataaacaaatattgtttcttctttatattcataccaatctcagtacttcacttctaataccagatgtgtggggttttcccaccccaagtaattctccagttctctgaggacaccaactaggtgttctgcaacttaattctgacacgatctacctggatgtagcatcacatcctgggggttatgggctcagtcccacaagacttcccccgagtcagatgccaaacacaagtccaggctgtctcttgtgtctctgaacaactatctataaatcagatgttgcaagagcaccctccttaggttcaatcatttgctggaatggctcagagaactcaggaaaacagtttatttattagattcccagttttttttaaataaaggaatgcaacataggaacaaccaattggaggagatgcatagagcaaggtatggggaaaaaagacacggagcttccatgtcctgtcttggttgtgccaccatcccagtgtcacgtgatccttgaggtgtcacttcaccagccggaaacctctgtgttcaacaacgccttctgcctgagtattgcccatgccacctgggctcattctgcccactcggcccagcaggctgttctcggctcgcaccaccagtctggatcccatacctgcccagggcaagccagttgcagagtggcaagaggtgtgtgagtgagtgagtgtggggtccacccattgcacacagccagggatgcttgctgctgcagcagggtgggcagctccaggcactggtacaggtcccggctccatgtgaggctgcagctggatcagatgtaccacatgcggcatctgctgtatgcacccacacgtggatgaggggaatgtgatggtgcccggaagcttggaaatgtcaggagccacagagccccaaagaggatgtgacagccctggatcaggtaacccctaggtctggcctccctgaagggccacagctctcctctccttcatgtctcccacaacctggcgagcagtaggaggattctgtttcagccctatttttgttactgctctttcattcccaccatttggtgggtcctgagttcttgtcccatgtccaggaagaatgaggtacgcaggctactggagggagagcaaggtagaaaggagcttcactgtgtgacagaacagtactcgagagacccatagtggttagcagctttccacaggcaggtcgtcctaatgagtgtccagctctcagcagaaaggagacctggagtgggtagcttctttctgtaggcaggtcgtcccaactagtggtgaagacccaaattgggtagctcctttccacagctggttgtcctgatgtctctgagtctggctgagtccagagtttgtatgggcttcagaagggagtaagtgtgtgctgattggtctataggtggctgtgggcaggtccagaaaaagcactgtaagttctaactccagggactccacctggaactgacagtccagccctcatgcttcaggaagtccctggcttgaaggtggggcttcactggggacccgcccctttccatgcttgaggctgtctgcgtattgctgccattgatcaggtaatctacagtgcccaggctatttgtgccaagagtgcctgcaggcccatgctgagcacccctcagcaccccctgctttccactgttgttcatcggtacccaaagtccagaggggcacaaggtgagagacagctggcctgtcagcactgctgcaaatgtgtgcacacccagccaggttgcgacagcacctgggctcaggcacaactttgctccaaaatcagagcaggtgcctgggtggggagagaccaggtagtgggagcaggcacttctgagactgcaggggcagtggggggtttcccaggcccctgagaaggcagggttgcccaggtctggagccacagctgggtggctgcagccgcacccaagagggcaaggctcccaccctgccaactcagaagtgtgtggggctcccacctgtacctggctcctgctggccctatggagggtgtagcgctggccatgcttcctccagccatacctccccagctgcagctggtgtcttcacagcagccactccagatagaccaccgctgttatcaccagcacctccacatgttcactgacccaaagctctgtgagcccctttcttttgtttttataagggttacattatgtaggcatgattgatcaaattattggtcatttttaactcaaacttcagcccctctcccttctcctaggataggggatggggctaaaagttccaactctgtaatcacacggttgattgactggcaaccagcccccattctgaagctgtacaggagcctccaggcatcagtcatctcatcagcatacaaaaagacacttacgacttctgagattacaaagcttataggagctgtgtgccagaaaacagggatgaaaaccaaaatatgtattttttattatattgcagtatcaccatggtttggcaagattctctgtgatctgaaacctgtctcctatttttccttctaccattatgtaccttattatcatattttaggcatactgactctcttttagggtctttgcagttcctttccctttgttaagatcttgaaaatgtcttccctgaccattctgtttgtaatagatctttatttccctatcactttattctcctttctttccctgtagtgtttaacactatctgataaactctgatagtatctgaggttatcacatagtgttaaatgtaaacatttgaagtatgtatattttttcatattttaaaaagatattttaagtatatatttgtatcatctctcccctattcattaaaatgtaagcttatgagggcagatgcctagaatatttagaataaatatttagaataaactctaaaagtattgtaaatttttttctaggaaattcatacagatcaaattcatacaaatgctgtacatatgaaaataattatggagtgtttagagtattgcttactaaattaatgaacatttgacttcttatggaaagaaacatgagtatcctttaggtattccatcaaacaaggtcagtctgattgaatgctataaataagtgttaaagaaaaccaagttcacatttctaacttgtctaggaaaataaaatttctcacacagtcaatattgtaatgtccactggggattgttcagaaggctccatagatgatggctttgggccagacaatcagattatgctaagggaagttaagataaaatcctgttgcctatactgaagagaaacatattatttgctatgaggtaaaatagcctcttctactaaatctgaatgttctagtgagttgaagtgttatttatattcaaaagaacatatagataggtgtaggggtgagttattgctatagtgagaagctgtaaagcaatattttgttgattatggtaaaaattggttaaatgcattgggtaacttttccaattttaagctcaattaataagaagggaaattgagaccctgagtaggttttctgagataggcgtctgtataaattgagacttaagagaagtcaggatgatgaaggaaggctaaaagattggattgttcaggcttgagactagaagagtggggagttaataacagtctttaaggatgaagggttcttataagagaaagaagactagctgttttccatctccagtgagtacagaacaagaagatgggatttaacaaatatttattgaacatctccaccaagtgcagaacaagaggatgggaagtataagtgctttagatgagaactaaaaaatgtactaagatgaagattttaaatccttgagaggttatgaattttgttttttagagatcttttaaacaatatagattttctcttcataactttataaataggcactagtgtcaattcaccttaacaaacgtttattgcattcttaaagccccttccagtttaatgatttcagcaatgtgtcagtgaatagagggctgataactttgtagaactagtcaacatttaagctgtttaaaataataatcgtgatgttagttataataattaatgaaatcagtagaagagtaaaaggtattaatagttgcatttagtagaatcattatgcaacataagttcctgtatgaattgtagaaagcattgaaatatttggattactcaattgtattaaaatgtcttctgatagaaataaatatatattagtgagagagaaaatcaacttgaatgccacctagtatgatcttcctttgaaagaccatttgaaaattaagctctagaatattttcctctctgcaattaacatatgcactgacaatttaattttattatacttgttattctattgatgattgtagccaatatttaattattctaacaaggataacaatatagctattcagttcaagttgaaatatttaatatgtttgataaaaatgttactttatatatcgccaaagttgattaaaaataaaattaaaatatgcttaacatctttccctgtgtagcaagtcagtttttaagaattttatcaacaagggactacatatcaaattttccagtgaaattccactaatagtaaaaaaagaagcctctgactactagagaagatccaggcccttagcccacaaaaggcaatatctatgaagtctttatttaattttaataataatgcaaatttttattctacatataatatattttttatttattccttgaacttctagaatgggtcagactctgtttaagcccttcagatacagtagtgaatgaaatacaggaaaatttcttgtctcctagagattgcattctattttaataaaattaataataaaaacaaacaaaaaataagcataatgttgagtatgttagattcctataagatttgctcattttgacattaaaatgatatatgaattttccatatctgggaacaaacattttttttttcccctgctactccctttaggtaaattggtgggatactgtttctatgatcctgtcaggttcaggaaactggtttaaattaaatacttatgtcagatattcatttcagcaatgaggcgattatcattcttgagctgtcatagcattgaagattgcatacagtcatgtggggagagatgccatcagtttcctttttcactgcttgtaaaatacatcaacataatcactagtaagagatactcagaattaagtcaaagaagcagtacagtgcaatatttccaggctgtgttgatagaaattttgataagtatattttttgatgacaagttaagccacttgtggattatgatgagatgaaagggtcactaatcttttggtcaatcttctcttgtctctgtgataatctcataaaaggatcagttcagggaataatgatgagtgataatgccattaattttaaaactgatactgtaattttcatcacatgtaaattatctgagccttgcaatctacataatcaactctcttcattcaattttcaaatttcattttcattgcagcattttggtcatgtaccataaatatactgtttctttacattttttaaaaaatgaatcatgcccaaagttgtaagaatactttaatgggccaaatgtgcaaatgtctgtgttagggtgaacaattaacttaagttgttttacttgtagtttttaacctctgatacagcatcattttttcttcatggagaaaaattcttacacctacactttcttccagtgaaggtcagaagagcaaactgtccacattcatgcccatttgattaaaatggactaaaagttataattttggaaacttcgtatgtatataattcaactgttttatcactgaaataaacctattgagaaaaaataaactcttggagacaaagtataatttgagagtgaggctgttgttccttgaatttggaaagtggccaggcctagatgcagtgaaatcccctcatgcttctgcctttcatggatttcacatcatttgtgcacataactccattcatttttccaattaatgtcatattttttaataattaaaaagaaataagacaaaaaacttaccctactgatgttttcttcacatattttaattttaaatatttgggaaatgaagacatcataaaaaataatgggatgaaatggtgaatgtggcaaagaataaggaatattgttgatattcatcctttaatcccagaaaaatacagtatctagttaacctccattttcaaccagttattcagaaattatttctatgtattacattttatggtttagacttagatgaataacaaccccattttccgcttggatgcttcactttggcccaaagcagattcaaccaaaatattacagcactgggcttaaaaaattactcctatttcgttgattaagggagagggtgttctgggtttttttttgtcgtgcatttaaaaaaacactttataattttcaatactttattgttgtctcctgatttatattttgatgctatacattttcctctaaaaatccactatagctttatctcaaacattatgtcattttttggttattcttaatatcctttaaagagaaacaacaaactattgtgtggccaaagttactctacacaagtgaagggaaaattattgagaatatatttatgacataaatgacaaaaatggcaaaggatatgaataggcaatatctaaaaataaaatgtaaatagccgataaacacatgaaaagatgctccacctcattagtatccagggaattataaaatgcttttcagtctccaactggcatatgtaggagattaataatgtctagcactggcaaagtttcaggcaactaagctctttcatacattgctagtggattgtgaattactacaaacttgtggtgaattgtctagtaatgtatatcaaaatggttaaaaaaagatcctgtcattttcaccataatttatcccctagtaagagaagtcaccatcacacatgtacaaggatatattatagcattattcctaacagcaaaattctagggaaataaaactatgattccatcattaagaaaattgttaagtaaaatatgtaatattgagaagtttttggaattttatagtcatatttattgacctggtggtagatccacctgtttgtggtacacacacacacacacacaaagaattgctgactgatgtttttaagtaagtagaccccactgagaaacaagaagtacacacacataccccacacaaaaagctgcaacataaaacgtgttgtgtgagcatggaaaactatagaaaggtagtaatctagctcactggagtagaattagatgttaggttggagacagaaaattattgttacataactttgtattcagttcttataaaagggcatatattacttttgtaattgaatatattaagatttgaagttaaaaaattaaaccatttacaatatgcgtaattttcaacatgctttatatattggggagtatactgtgaaaggaaggaaggttaatagtatgtttgttactaaaacgttttttaaaggaagtggttttggaaagaagtggatgtattttgtaggagaaagttttgtttgctggttggtttaaccaaggtgtaaggaagtctgatttaaggctataaacttatttttcagaaaattgattcatgaggatctgcggaaatcacggattctagttcctatagtccctgttgttctagcattggccctgttcatttgatgtgattgaaaagtttatgttaacttcagtagtaatactcaagttcttttatttttttatttatttttttttttgagacggagtctcgctctgtcgcccaggccggactgcggactgcagtggcgcaatctcggctcactgcaagctccgcctcccgggttcacgccattctcctgcctcagcctcccaagtacctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagttcttttatttttaagttacatgactgtttctactccgaggaaacacacaattggaaagaacacaatattgagtaacttgaaaaatctgactctgttgattacagttgatgagcaaaattttaaaacctttttccaaaatagtttccgtgaacctaatgttctaggaaaatatattctgtttttcacttgtctttgaatacccacaactctgagccacataccgttgctattatatctggatttatatggtttatataataaacctgagtttgatatgctacagcattaaagtatttagagaactggatttttttatctttgtgaattctgaaatgcttgatagtattagaaacatactaaacaaaatgcttagctaatttattataaagactgctgtctgagacttgtttttaacatgattactgagcttgcataaaaattatatttctggtctaatctgtttaaccagagaaaataaaagcatacttataatttttgatatttggatgaaagtcaaaaaattcttttttattttgtatcttctaaaatgagggtcaaaattttatatacttaataagaaatatagaaaattggatagtatcagatgataagcaacttgatatgtatttcagacatctgtgtttcaagtgtctgtgctgttggaataaaaaatagtgggtgccttagaattctattcagatccctgcttctatttgcctactatctgctatgttagatttttacctaattaatatttttaaaaagtcattatcacattcaagcatttggtttttcaggatggagagtttatgaaaacagagtttatcttttccatattgatctatttattgctaatacttacaattttagaattgataatcacttattattctgggaaatatgaattatttattcggttccaaacttttgaaataactgtctggtgttttagaaaccagaaacagaaattataataggagtttagactataatatattgctgcaaggataattattaagggaaaacacagctgacattttctgatttatgcacacaatcagagatggagtccaaggactgtgacataattatcttcatgctaacaatttttgtaaatctcttgacagaattttagctaattttaaaatgccttctgaagattagcacttaaaattgttggggaaaatagcacaatttattagcaagggtataattgtaaaccttctaaatactcattgtgaatatcatttagacagtaactcctgctttagcagctggtacataagacacccgtttatggagtcttgaaacaacagagagtggaatctaattaaagaggattacatgccaaagaaaaattattaaaaacagactaatagacaattgttatgaatttagaagtctctgccaaattctctttttgatacaaattcatgtaagtaactgtcaagtaaaagcctttattcctccaaaaccagaaggatattggaaggctttatcttttgtgacttaaaaatgattgcttctctgaattttaacttaacacaaaaacttaaatggttctattaatctttcctcatgtattaaaatgcacacatgtgcttttaaagataaatgatcatgaatactattttaggttttttatttgatatctatctagtaccaaccattccataactgtgtacagtatatggaaatcttaggcatattttttctttgtaaacaaaaatcagtttatcaatttaggcactatttattgagacttatgttaaattggcttgcatatttttctttgtaatgtacatttaaaattcatgatacaccaaagattgttaatttttagagccctaatctagtaaattccttgtttctgtttgaactgacccactccattgtgatctcaaggtttttttttccaatcagagaattgaggtagcttaaggtaatacatattcatatgttaattgttttttaaacaacgtatttttaaaataagtgatccttctaagtatgttctagagaaaagactgtttacatctgtgagtttacctggtgtctaactttaatcttacacacactgggtggtgttattacagtacatcatgcactgcattacacagccataccatctaaatagacttttctatattttaactagattaagcatacattaaaacttgatttccaaagactaagaataacgtgttttctgtgttactaataaatgcatgaacaaaatcactggattgagtaaatgagacatttaacattcttaagtgagtgatagtcctataaacatagatgaaaaaattaaccatccaaaattgagacagaggaacaccactgatgttcaagtagtaacagtggatttatttgactttgccacccgcaccccatccctgataccaaagttttcctcatttgcttagacaccacttagtctagcagggattgccagatgcttcagcaaaaactccatcaaggacaagggattgttttaagtttaaagcctctagattacatcaaattttttatccttatagggataatatcctagagagcagttgtgtagctgtggtttccctgtggtggtaattaatttagtggagatgggtcagattgttcagagcttaaaggtgagcaggcttccctggttgaaatagtagattttcatttttaaattgctcttggagagccttccctcttgtcaagattaagtgagtaagtaaattataatggcttccaaaatagtaaatatcaatatttgtataatagtttgtggttggcagtacatgggacatagaactccacaatatatattgaaataatgatactgtgtttcatttgattatcatgtaaaccatatgagactcaatcaaaatataaccatacattatgcaaacaaacgcattgtaattttaaatatgaaattatgattaaaaagcaaatactttatcctgaactttgttgacctctcatagatataggaatgaattatcagcaggtaggatactgtagctaaacttttaatttatctcaaaaaagtactaaaatattacttaattcttactgtgtatgagagatgaaatcttaaaatatttcaaataaaattaacatactttcagactatgaaggcagaaatgagattcattctatcttttaaaaatatgtaataatgtttgaacaatgtatatattttcacatacatgtttttatttactttaatctttacaataacactttgagtggataatattactttcatcatcttcattgataccttcattttatgaaggactatttgcagattgagatgttaagcatttttgtaagaacacataagctgtttagttgtagagatgaaactcaaaaacaaattttctctctgcatagctcctacctctcctactgcattatattgtatttcactgtgactcatataagattctcctagacagggcctgattgtaagctggccacaattagtgaaatgacattagctaaatatgattacctcttaatgttccctgaaaggattagactagttaagacacaccaaagggaaaagcaattatctattgaaatatgaatctcttgattagaactggaaatcatatattgacagtagaatgttcatctagaattaaaaaaatatgaatatagtaattatttcttacttgtacttataaagaacttcagcagggctagttttgagacttcttgttgagtgcaaaaattaagatacaacattttccagaaagagtaagttcacctaattgactcatttttttttttttagaggaacctagaccttaggaaattctaactacatgagaaatgcatgtacttgtattaccttttcccaatttactttatgtcctaaagaaaagctttgtagtaaccaacattgaactgccttagaattgtagcagtacatgttggagtgtgccattttatttaaatattcctcatattttaaaatatgaaatttatcattgccttcataagagtggtggtttcccttgtgataattctctgaggttccttcaaaatttagtatcctgcaggttttcaaccagctgagatttgtaattattgctgatatatcactaatacatggcaatggatgtgaggcctatttaccttataacagttaccctattgaattggcttttttttttcaaaataaggagttaaaaaaaaggttttaaaccttggtgtctcaatgattagcatactatctagcacccattatgttctaaataaatattgaatgaatgaatgaatgactggttttcatttctagcttggcaacaggattgacttttgtgtctttttttaaattagaaatttgatgtttgaacttaagatgctttattgtcaaacagcaatagaaatttgccaacttttggaccccttgtttcacaaggttcttggactactgattatatttgtaacttccgtttctaagctgtctaggtccattgtgaaatcatcctccctgatactaaaatttgttgcacatagacgttgggccatagatgggcttcaggagctgtattggcccactgaaattgtatatagcatagcatattgtgtacttgtgcatatgtacttttgtgaaaatgtaattttttaaggaaaaggatcatggttttcattatactctcataggagtcttatgaccaaaaagtttaaaaaaatccataaagactttcttttactttattattcataaaaatcacctggttaaacatgaaaaatgcacatttttttctatttcaccatataaaatctgatccattaggattgagttggggttcatggatactcttcttctgtttattctttcctctttttccacctttattgaaaacgtcgttgctgaatgtactaatggatttacatatattacctcatttaatcttgttgatagctctagaaggtaagtatatttcacgatgaggaaactgagttaattaacttgcctaaggacttagcctgtagacagtaatggtaaggtctgaggctagagccaattttattaccttagccttccccctttttttctcttaatctggaaaattgtaaatcatttcaaagacaggtttggaagtaacaaactcatagtcatctcttgttccaagagaattatttcctttctctcctctgtattcttactacatgtgagcaagttgaagtcttgtcttatttaccttcatatccctgtgcatagtattattcctgacatgtaatagattttcaagatttttttttctgcactgaaatttaattcattaactcgagcctttgttacttagtaattctgagacttaaactccagtagctatgccattaactctttgtgacttttcatttgttaaaattggtttcctaatttattcaatttaggtttgtatataaattttagatctgatttagttttagttatcataattataacataaaaattcagtcccatggaaataaagtcctgtggaattatcagtgatttgttttatttaataatgtaatttgctagctgttcttttttttttttttttctttgcctctttccacctccatccagaatcagtaggtgtttggttgaattttgtgattttttttggtataatttgagcaaagataactcagtgaattttatttaaaatcctcagcgttctgaaatctccttgtatattattttctttcatgtgactgttggtgttctacttgtttcattatacttttatagaatccttaacacagatgagatataaaacactatgaaatctatcacagttgaaactctagaccttccctcaacccatggggattcatttggcaggaggccaccaaaaccagttctttttgatgcttagtttccagtttctacttcaattgctgccaaaatctgaacacttgggaatttaattgctcattatatttgtcacggtggtgtcacagacccaaataaagactgttgcatgcaaaatatttatgggtattaatttggcctaaatgtgtatattggattccatatttttctacattataaagtatagcacttccagacagatgtagacagaatcctgcaagagcttctgctacatttgactctgctagtaaactattttccatccagctcagtatttaaatttgatgacacctagaggaaggcctattcagaactttattatattcacttatgcagtttactctttagaagcggactcgcgaggagtttgagtctggctctgaggctagactgcttgggttcaaatccctgctttatcccttgctagctgtataaccctgggcaagctttatcttaatctcccctgtggttgtttcctcatttgtaaaataggaatacatatggttgtcatgcagattaaatggttagacttcctagaaaaagtacctaacccagagtcactactcaatgttaactggtttactataattaatacacacacacacacacacacacacacacacacacacacacacaatacattatatattaaagctataatgtgtaccatggttgctgatacaaattgttccgaattttcagttttctaccaattaattagagctaacctgtgcctgttatattacatggcatgtctggtcggcattaaatttagtacctttgtgaccttccatttttcctgtgtattcccactttcttgctccacattgtctaggctagcaggcctgcgttttgttccagtattttattactaatcactgattatttttgttcttctgcttgctgttctcaggagtagtttgttcattcattctctctgtccccttttctctttttatctgttgccttttcctttcttctgctgtgatggttgtaggtttctcatgccattatattggtcaaaggaaattaggaggcacttggagggtggaaatcacaagccactaccatggataatttttttgaatttttatgaactttcctatcctgtaaagtaagtcccctatgtgatacttaccactgaaatcgtattctgggacagtcctatactaacttacagaatccccaagaatgaataacttgttgattacaaataatttacagtttttctcagatccatgttcatataaagtgggctgagaacagattttgattggaggccgctggctcaattttacctgcagttgtctttaatgttagagaagtgttattggtggtaaacgtgacagtgaatctgtttgccctttactcagtggatatttaatgcttacttttatttatgagaagtttgagcagataaagatgttagttgcttgaaatacttattctatatggcaagagcctaatattgtctgaaatataattcaaatcatgtgtctgttacttagtgcttctacatatggttcttgaagcataaaaaatagatttgatttcaatttctgtatacagaagtatttttagtcaaggtaatagttaactgtttaaatgctacagtgcttacttatttcctttgttgttctgttgggtataataaacttcatgcagacacaaagtgtaaaacatggagcatttgttcttctgttagttagcctaatactcattttgggtttcccattccacatcaaggcagaatatgccattttaaccacttcctgataaaattattattaaggttgccgcttctactcattatagtgaaggtactctgaaacacggtatttcagctaaatcagaaatttggctgtcttcaattcctggcatcactgagcgctcagtgtggctactcagtgtggctactacagtctctcagtgtccacgtgtccactttctctctctctctttttttttttttttgagatggagtctcactctgtccccggctggagtgccgtggcgcgaactcagctcactgcagcctccacctcccaggttcaaggaattctcctgcctcagcctcctgagtagctgggactacaggtgcacccaccatgcccagctaatttttgtatttttagtagagacagagttcaccatgttggccaggatggtctccatctcttgacctcatgatccgcccacctcggcctcccaaagtgctgggattacaggcatgagccactctgcccaggcttctgtctcttattttaatccaagaatgtgtttatctcctgtctctgtggctagaaaaactagatagtcaagtaatcttccaaccctgctgtttatgctaggaatggaccttaaaaaatttatgtccaataattttgttatttctttaattcttttatgaacttgttcctctacagtggtggaggcccaagtaaagttaaaaattgcagtaggatacacacatatgtttattgaggcactattcacaatggcaaagacttggaaccagcccaaatgtccatcaatgataaactggattaagaaaatgtggcccatatacaccatggaatactttgcagccataaaaaaggatgaattcatgtcctttgaagggacatggataaagctggaaaccatcattctcagcaaactatcacaaggagagaaaaccgaacacagcatgttctcactcataggtgagaattgaccaatgagaacacatggacacagggtggggaacatcccacactggagcctgtctgggggtggggggctgagggagggatggcattaggagaaatacctaatgtaaatgacgagctgacgggtgcagcaagccaacatggcacatatatacctatgtaacaaaactgcacgttcctgtaccctagaacttaaagtataattaaaaaaaaaagaaataaaaaaaagattgcagtaggattggcaaagaggaggaagctgatgaggaatttcagggccaaaaagaaacaaacaaaaaattatgtgtattttttcttaatggtctcaatcaacaacatttataactttgagaaagtttttaaatttcttaaacagcacacaaaaacactgtacttaaattagaaaactaacaaatttgatctcagctaagcagttctctttattgaaagacacttctaaaaatgtgggaagataagacagaagaggatacttttaatgtatatacccaaaatggactttttgaaaaatatataattttaattattgtagattcattttggtaatttcaaagattttaattataacaacatataactgtgtgtgtttgttaaaaggatctttgccttaatttgacttagttttaaaaaatatcaaggttaaaaatagtggtttatataccaatatatttcaaatcaattcattcttatacattggacattattaatataatttctgtaattttgtaaaattcaggatacttattcaagaatagaaagaacatattaatactaaaattttgtcatttagtttttctttctgtaaaaataagtaatacactaaatctagttattttatcaactaaatactagtaaattccataagaaatctagggtgccaaaagattcatatatatatgtatataaattgaaaatttctacaatttatgccctcaaaacctattcgggttctctcagattaagtgagttttaagtacgtataattatatttagaattgtagtaaaaattttttaaagtacttttagaaaattcagtctagtattgctattttaccaaaaagtagaaacacttatgaaatttaaactgcttatgtcatatttactcaatcttaaaattcttctaagaacctgatctaatctaattttcacctaattttaagattttaactttagtttcaagtatataaatatatatgtgcagttgtaaatattacacataaaattgttatttaaagatctgattataaaattttgattcaaaaattttgaaacttttattattatatctgtgctctatcccttcatcttagtcaatgctagcttatttagaacttggtatttattgtatactgtttatggtgatcaaaaacttaatggttttctcttttgagtttaaattggattttctatacttaagattattttagagaactaatttttattcctccaaacttaagaagttttcctacttttataaattcatttcttctgtttatccactttgaaaaattgataacgaaactccactttgaaaaattgataatgagacttctgtgacagctgtatcataaaatgtttttattttgttactgttggatttaactgtcaattttaatgaatgctacccaattaaagtggtatgcatatttttcatgagtccatgatcaatataatcaattacatttttgcataactgcatagatacaatttttctcaggatcttagagaattaatgcaatttttaaatatgttgcagaattgtgagaagctggagaataattttgatgacatcaagcacacgactcttggtgagcgaggagctctccgagaagcaatgaggtaagtctgggtcaccatagcaacagtcacagatgtggtaaagaaaaagtcattcttcattatttggggaacaaatgagttcattgccaccattcagctctgttctctaaggtattaatttgtcagtggagagacttcccttgaggctgtactttggttttgaagctgcataaatgttaagcctcagtgcacagtaaaaaatgtaaatgtttaatttgttacttaaaatgcttaaggggtgtcttgttttatacttatactaaactgtgtgattgaatgaaaatattgttcatctaaattctgcctgtatataaagaaataaacattgtacaatggtgctttaattgagtagtatttcctcctaattaatatttaatttaaagagaggtacttacattttcatcttctataacattttataggattatattatattatagtatttttagtgatttacatttttacactattacaaagcatataattaacttcctttcaactatagtggtctataatgagcctgactttttttcttttttcatttcttaacatcagtaattctgaatatttatatgaaattgccccaaatttgatgccttttaaataacttttagtgaagcatttttcaaatctatttgatcagaatcaagaaaggctttttattagacattgaaaatttgtgggaaataaaactcatcatccacagagtgagaaaacaacaaatgttagtagtcttaaaagttctgagcttgaatatttgagtagcataatttccaatatctttgtaaagaaagtgtatttatatttatttagcctataaaattaaaatatgtttttaaaatacgccttcttctatcttaatgctcatttttcaaggatgttaaggctaaagagattaaaatgagagaaaggataaacctaagagcttcctagaaaggtagtttagatacaattttgttattgctagcacacagttaccatatactttagtttagaagctgctctcatttagtaaccttccttttaccatgcaagcagcaggagaaagtaattaaatttaatagaagctgccctcattttgaagccacttctatttaaaaccacagggggaggtaattaaatttaatggaaacagtagcttctacacaaagatacatggtacttctgtatagatgattatgatgtcacaaaaagaggaataatatattactagtatgagaaattaccagctggagcaagtgagcctattttattgttaatgtctttactaataaaaaaaagagggaaaaataaaactgagtacacaatagagaatttgtatctatataaaatgcaatcagatattctcagaaagtttaagttattgaaaattttagcaaattaaaaataagttgtaaaatatttgttttggaaaaagctaatgcagaaattatgaatgaatttctaattttcaccatacatagtggtttatcctaaaattaccactgctataaatttaacattttttgtaaatgcttattatgataagtttaaatacagtaaacatgcatgccaatatttacttggaaaactgcagttattctctatatttttatatctatttattttgaagtaaatacatagacaaacaggaagacaaagagggtggcaactcttatgctttgaataaaagaactgaagaccaaaagacagaaagaactgaaaagaggcaatgtgaatgaaaaatgatgtgaatgaggaaaatacaaggaacaaggaaaggatatgtaatcagtgtaggaaatttgtcctcaagaaaaaaacaaattgaattataagaattaacttcaaatgaagagatgattaaattctgccaaatttcgttatacataacattttagaacataccaggatgtcctgttttttaaaaaactagagatgaactgatgataaaaacaagtattacctgcctggaataacttgccaaccacccattctatgagacaaagcagtagtctggataatttaagtgagaatttaattttatggcatgaaatgtacttgtttgcttaagttatacattttacttacacacacacacagacacacattattggtaatgtctggattcattaaacacagtggaataatttagtaattaatagcatacaacaatttagtatatggtgggtcaggtgctttttaaaatgtgttcggaatatgcttgaggtgaagacccagagactgagtatttcagtcttttccctggcccagaatatttcatggtagcttctctgttagtccattggcctggcatagcttggctatgggaccatccgtttttctttctttcttttttttttattatactttaagttctagggtacatgtgcacaacgtgcaggttagttacatatgtatacatgcgccatgttggtgtgctgcacccattaactcgtcattcacattaggtatatctcctaatgctatccctccccccctccccccaccccatgacaggccctggtgtgtgatgttccccttcctgtgtccaagtgttctcattgttcaattcccacctgtgggtgagaacatggagcatccctttttcttattagcttgatctctttagcagcccctaagtggctccaggtccccacagtggtgttcttgtcctgagtgtgtctagccaggagtaactggaacagagttggacccacatctgaagattgtcctattgtggctgcagtgttggggggcctttcaccatcttgggtacctccttatttatttaggttttactatttctatgagcttagaacagaaaagagaggattcttagccacctcatccagtctctctttctggccagtctttgctgtgcagtcttgaatctggtttcttgtcagtatccgagtttacaaatcactttagatccctcccatgcttcctcctgatcccagtcttgaggatgccctgagcctgtagccctggtgtgtaaaaaggacgaggggttacaaccttctctggaatatgctagctaaataaaacgttaaataaatacattaattgatgtagagagagagaaaaaaagaggattagtgaagatttgggttttcaggtgactgtgagatagctgaggttaactcgtgtaaatgtgcaataggcagagggaaaatacaatgcaacaactcaaggaaaagactgagagttgatgtgcgcatttgagacttgttagtattttgatacttgttgtagccaagggaaggcatatgatttccaagaatagtgcattgggataagaaagaaggagagtccagccagatgtctacgaaaatacagggcttaggaaaatacgtgccagaaaaaacatattttgggatttaaaattctgaataaccttctctaacagagtaagactagactgaaatataatgtgcctaagaagaaaaggacaggggaatggaattcctggccgtttttctgtggctcttagagacatctagaccaatgctgcccagacctttctgtgatgagagaaatgttctccatctgtgccatttagtgtgagagccctcagccacatatggccactgagtacctgaaatgcgatgagtgtaactgaagaaccgaatgtttaattttacttaatttttattaatttaaatttaaatacttatatgtggttagtggctgtggtttgttctgtgctgccctaaagggaagtttttgtgttgctaatatgacacttgactgcctctcacttaacagagttctcaacaatggagaggccagagtgaagctaaaccatgttcacacacatcacacatagatacacttactttcttagaaaactaatagtaaaaggtagatccataacctggtaatagatgtaaaaccaaaactaaaaagtataatttgatatagaggagacaaggtagctcttattttataaagacataatttatacctagaaagcccaacagaattaacaacaaaacctccctaagaatttgacatcttttaatgtgattgtattcaaaatgaagatggaaattcttaagttcttctgcgtgttatttaaaacaaatagtgtctgtaattgataatagatactataaagatctgatgaagttattatatgatgaagtaccccaagtagttcaggacatgttcaatcacccagtaaatggtataaaaggttttttttgtttgtttgtttacttgtttgtttttgctgtttggacaaaaaaaaaaaaaaaaaaaaaaagactttgtagtctcacttcacatggcccaaaggaaatttcatgcatttttaaagagctaagggaaataaatgaaacagtcaaagtccagtggaatatagaagtgacttttgagattgagatgggggaagagatgatacgctaacaagtaggtgaagaaatcactaagctttgattccaataataaaaaaaaaagcttccgtcatttgcaagaaaatggatcaacctagaaaatgttaatgttaagtgaaataagctaatcacagaagggcaaacactgcatgatctcacttttatgtggaatttaaagacgttcatctcatagaagtagagagtagaatagtggttaccagaagcttgggagagtagtgtggagtggaaatggggagaggttggtgttctatagcacagtaaggtgactatagtcaacagtaatatattgtatactttaaaataacgtgagaaaatttggagtgttgtcacaggagatggagactatcctggctaacacggtgaaaccccgtctctactaaatatgcaaaaaattagccgggtatggtggcgggggcctgtagtcccagctattttggaggctgaggcaggagaatggcatgaaccggggaggtggagcttgaagtcagcagagatcacgccactgcccttcagcctgggtgacagagtgagactccgtctcaaaaaaaacaaaaaacaaaaaacaaaacaaacaaacaaaaaaagacaagtgtttgaggtaatagatatgctaattaccttgatttgatcattacacaatctaatatgtattgaaacatcacactgtatccaataaatatgtgcaactattatgtgccaattaaaaacaaacttattttaaaaaacttatgcaaatggggacaatcacaaaattaaaagacatcaatgtactatattgccatatgtatgacagattttaaaaattgggaactcagtagataattggcaaactatgattaagtaacccttggaaatattcaactctaatggcaaacaaaaagtgtaaatttcacaaaaaatacaccaatctcttgcttattgctgctaatgcagtttggtgggaagtttttgagtgctagagatggaatagcgagacagccattctcacagatggctagagatggaatggtgagacagccattctcacattctcagaggattgaaaattactgctgcatttaaggaaaggattgtgtcactaagtattaagagacttaaaacaaacatacttttttttgtattaatttaccttctaggaatatattatgcagaagccatagaaattatgcataatatgaatgtgatactcaaattatggaatataaccctgaacaaattttacaggaactaattgtctaccattaagacaatagacaaggcaattatatgtatataacataaatatatataaatgtatatattacatataaatatatattatttatatattcatatttagaattttacaatatttataaatttataaagtatataaaatctgtgtatatatacagatatataatatatttatatttacagatatatacacagatttacatatatttaaaataaatctgtgtgtgtgtatatatatatagagagagagagagaaacaaaattgcttgtagaatattatctcaactgaatataaaaaatgcagagaaaaaataggaatgaaatgtggctattacatctggctggttggcgtaaagataattttttgaggcgtatgcttttccattctatattttctgtaatgggaatatattatgaataattagaaaaacagtgaaggaaaaatggagaaaactaaaaatatgaaataaatactggaatcaatagtaagaatcagatttgagactccaactgtaattttaggtaaattaattattttactcttacttttttgtaaaatgggatttaaaatctcctaggatttatatgaggaactaggatatagaggagagaatgctttgtaatttatgaaaattaataaaaataagatataaaatataatgtttgtatacatttttccttttaatgttgtatgtgcttacaagaattacatgtgtaatgtataaataatggaattcaatggagaagttcactgcagtcttagcatatagaatactagaagctgtatatcttgtccaacttctacatagtctattgtagtgccatgggtgtggaaatcttatacagcatttctgaaaatgataatcaaagaaaaagcattttaaggacaggaaaaaagtgcatcatctctaggtcaaatctctggtttatagtatgataatgaatttagaggtaaaattctcaacttcttttcatcatattctttctttatcttggttgattcaactctgtaatcatgccaaagggatttgatttctttactatcatattctgtacctattttagcccctgtgataaatcctgaacagtaaagggaaggatggggccacttttaacattgtgttgtatttttttttttttttttttgaggtggagtttcagtcttgttgtccaggctggagtgcattgttgcggtctcggctcactgcaacttccgcctcccaggttgaagagattctcctgcctcagcctcccaagtagctgggattacaggcatgtgccaccatgcctggctaatttgtgtatttttattagagatggggcttcaccatgttggtaaggctgctctcgaactcctgacctcaggtgatctgccctcctcggcctccaatgtgttgtctttttgtcccttttcagtctcacaggcagtagagggctatgggtaatagatatatgcaattggaaggtacttgaattgaataacttgagaaaaggtgacgtcagattctgaaaaagaagaggtacatatagaatatactcattaataaaaaaaataaaaatactattgggagttttttacagtgtatttcttaatacacataaaatatagattgttaatagatttatgagtatatctctatggcaagaatacaaattatttttggagtgccaacattgccattaggcattgttttatttgcagagcgaagtctattcagtgagatctgttatatttacattagtactataaagatgaactaccagtacagaatgtctctgaaatgtattctttttcgcttggctttatcacgtgttaagaattttgtcactagatggtgatgttgagttgcacagtttatctgtgctggcttttttactggtgtgtgtatactatttgtaggtgcatcataaacagccatttatacagagttaaatataaaagtatagccatgtaaacttggaaagtagcttttaagaggtctaacatttctaaatattatttgagtcaaaaggttaaaattgctttaatgtcattgtttctttaccttcaactcaaggacttttagaggtggaagcaatataaatagcaatctaactttttattgaaaggctgaggtccgaaaagagataccaagacatttaaaagaggtagtttttcagcttttcaggtatgtcccgtctgtgtgtattagcctaatgtatgtctttaatttcactcctctgttagtattcagtagtactggtgttgactaccatctgacctaagggttgtgttactactggaacctaggtattattttagctgtttatgatttgggttatgttaatattgcatctgttgctaaatataatggttgaattacactgatactttaactgatacttctacatgaaccatgactccgaggaagctgtgattagtaaaccatgaaccgagtaattttgttcctctgaataagatttaaagataataatatggccattattctactttatcttattcttagagatttgtgtgtgtgcatgtgtatgcatatttctatatgtggtatgtattatatagatattacatgtgtgtatatgtatggatatatttctctataaaatctcctctttgcagtcaaggaaaacttgcactgtgacagcatttggagtttggacttcccttgcctttcaggtgtattcattaggattacaaagatttaaggaaattttatggaattcttttaaaatagttaaaaatggaagagtggaaggacaaggcatgctaagtatttgagattagcaaattgattaagtagtttacaaagtaaatataaagctatgagggaaaaatcaaagtggcattgaagaagaatataaaataaataaaatgagaaagtattaacaaaatacttccagtgaaattagcaggttgtttaatagtatggaaagtaaataattttttaaacattctgaaaatgttatgtaatgatggaagtagtaatacatgatttaacgtttgtaacttttttttaattttcaaagtgttgaaaaacaaattcctttataatcagaaatgcccatgtataagggtatattttaactacttgaaaagtttgagcagtgagattggattcagaagcaatgtttcaactcttttctattttaatcatttctaaaattctatcttaattatgtttttccaagttttctatcactaaatagatcagcaggaacctcctgaaagccctactccccaaatcagcagagaagagtattctcttgtcttctatgcacagagaacatgttatctttatcatttctattacagaaaaacacatatttcaccatgtccagagcaggttctttgatttggtttatgccacctaacacatgaggaagtcaatcaggatgagtactttcagatttttttgaaatcaaaagacaaaagtgcatgattactttacataatcatgcacctgccctaataaatatcattgaaatacaggtcagaaaatatatgtaattagtcttatgtaatttttgtaatgtatgtgattaatttcgtgtaccttgagtaatatgaatgtatgtatatgtctttatacacctatatacacaggcacacacatggatacacacatttggtaatttatataattagtttcatgtacattttgtaatatgaatgtgtgtatatgtctttatacacatatatacacatgcacacacacggatacacacatttggtattatctgtttgccatgtaaattaggaatattacttccattcattcactttaggagtgagtgaaagcaagatttgacactcagtttccaatctcactgctcaaatggcccaaatataatttaattggggaaatagaagaaaacaattatattagctgttaccagtgtttagtaaaatcaaccatatggtcggcaacaatgcttctggattatttatggatttgttattaactgtcatttataaatacagaattctttcaatttagaatcttttccttcactttaaacttgaattagaattcaaaggtgagaaatattgattacataattatcaagtacaaatctggtgaaacagtagaaaaaatgaaatcagttaataggctaacacaattaattgttattaattatttatttatgaaatacattataatactcattaatctaagcattggtttgttccacctggtgcctagtaggtactaggtgacatttgttcaaacatagtatttgcagaaaatatcaaattaatattgcaagtgatagtttgatatttttggaaagataaaaccagaaaagaaatatgtaccattgatatacagaatgtatctgtttgaaacaacagcattggcaacagcaacatgagtaagaagctctgagccaagcaaggtcaggaaaaaactgcattttccccttagtatcaaaagattgtatattaaggactaggaaagaagggatgcagcttttgttttgctaccaaagaaaagtgcagagctaagtcgttactctagaatgcttatcattttagatacagactttgaatgagcagctaatagctaaaattatttaggagataaaaattggtactgtgaggattagctttaattttaagtatccataattgaagtgccacattatgattttaatgttatgataatcttgttaacaagctgttgtgtatatactatcatattttaatgtagttgcaaagcttaagtaaaccttaaagtaaattgctttttgaatcaggcttttacaagtggaaaattagtggtttacatgttttgaataagtattttgtaattatatttgtcattttctacaactaaagaagactaatagaatagatttacagataatattgtttataagcacgttggcattttttattactcgttctaattatttggtatatatgtcacaatatactataataaaatagctggccctatgtttttttgtaagtcatctcttctggaagatagacattgacatttagttataatatttctcatttctcatatatcagcttgttccatttagaagataattaatacaatttcttatccagcatttctacaggttattatgatgtgtactaaataccttccattgaaggtatttgtgtttattttattttggggaaaaaagtctcccattctgacaagttgtttttaaaaaatgtgttgcctcttttgaaaatcgagtagaagtaaggaaacattttattgtaaaaggccagatagcatgtatttttagctttctgggctacataatttctgtcacaactattcaattgtgctgatgttgtacaaaggcatctgtagaccatatgtgaatgcataggtgtggctgtgttgatgtggctgtgttccaataaaattttatttataaagacaggcagccatctggatttagcccttgtgttgtagtttgcagacccctggttgagagcaaacatgacttaagtccattagaagaaatttcaaataatgtttggagaaatatattaagaatttgtgattttctctgatagattaatacaaatactatgaagtccttccaattttatcaatgaacatgactatataacattactgaggtgccctatctactaatttctaggctgttctttgaaattgaataagtcacatttcctggattactctttcaagtaattagtgtgattaggaattaaacagacaatctagcttgtgaaatcaccaatatgcaacaaacatgagacataggtactagtgccactgaattaactagcattgattattcatgtttatgttttatagttaaaatgtggaataaccaccaatgaatcatttacattatgaaacagtataatgttgctcttagttggacaattagctttgtatagtatggtacttataaaaggacaacattgtgttagtttatttatgattcttttaagtagatgaatcatggtatctatactaaggcatatctatgatatctgctaccgattgaaaaaatattgattgtggtctattattttaatgcctttgtaagttttatacccatggaattatctaaagaattacttttattaaaaatttagtcaatgcatatttaataaattagtgaatcttgaatacttttcttgtagtctacaaagagggttttttgtttttgtattttcttttttttttctctttttttgagtgaaaggagatggtatataggatattctaagctccatttaaaaaatgtgtttggcacctgtagtcccagctactcaggaggctaaggtgtgagtaccacttgagtcacaaggagtatgaggctatagtgtacagtgtccacacctgtgaatagccattgcactctagcctaggcaatgtagtgagaatccatctcctaaaaaaaaaaaaattaaaaattaaaaatgtaaatgttcttggtgttttattgatgtgcaagatgttatttggtgacagctgttgtgatatgtgcagatatgcagtgaactgggaataaaccctaatttcaatggcttcatatggtggctggaaaggccttgctcctgtcaaaggccaacaccttcacttgtgatctggatcccatttcctctagtcttttcaaaagtttcccttgtgtaattactctctctctcctgaaacgttaatttttgcttttacatggttatttacatcttcatacttgcatattgtgcatcttaaagacaaacaaataaatgaaacctgtctacattttcctctccaggtgccactccattttgctcctcaccctcaaagcctaatgaaagagttgtcaataaaggtttttcattttctaatctcctggtctcaccttaatccactccacctggacatctcttgctgtctgttcagtgagagtgctctgtgttgccaaatctgtaatttgtacttgactggtctgcagcatttgcttcaattgactatcctttcttgaaacatttttcctcctaggcttaagttactttacatcattttattcttcccctgcttcattggccactccttttaactctccttggcagctatgtcctcctcttttcaatgtctaaatattgacatattataggacataaaattggaatgccttgtttctactattttctcctctgttcctaggtagttatcatttctttccttagataaccatctatttgatgataactgccatactttcatctctacttttgatgtctcccctaaaaaaacttcagctttacacttcaatgagacacttgacttagccacttcagtatgtaaataacaacccaaatttaacatatccaaaggtgatatctggatctggacttcttttcttttctcttctcttctcttttctcttctcttctcttttctttcttctcttttctttctttctttctccctctttctctctctctccttccttccttcctcctttccttttccttttccctttcccttttcctttcctttctctctttgtctttctttctttctctcctttctttctttctttctttctttcctctctctttcttttttttttttttttttgagacagggtctcactctgtcgcgtaggctgtagtgcagtggcacgatctcagctcactgcatcctccccatcccagattcaagcaattctcatgcctcagcctactgagtagctgggactacaggcatgtaccaccacacctggatagtttttgtatttttagtggatacggggtttcaccatgttggccaggctggagattcctggatttctcaccacaaccctccactgaaccaattcatccacaagtctttctatctgagtaaatggcagtagcatcatctttagttatttgaactacaaatctggaattcgtggaaaaaattttctctctcacatgcgcatctaatcagtaagaaagttgtataaaaattcctgttaaagctatatccttggaatctgtccagttttgtttctcccctgctaccctccttacctctcatctgaactactaatttccctttttacattctttccttaaaaatccattttccacagatcaccaggatgaaccaaattgtgacctttctctccaaaggcttgctattttacttagaataaatgacaaattccttactcctaacttgtcttgcaaaaacctttgtgatcttcctctgactcattaaccatatgtctaacctctttcagccttgctcacaaagcttctgaccaaccgtctttccatccctaaaactttccaggcttggacctgatgcttacctgggctccttcttacatgggctcttccatgccttgctgcttcttgctattcagctctcagcttcagtgtcatcttttccaaaagagatcaataaaggttaggtgaataaaaattgaatgaaagaggtaaagtaatttgggcatatggcacaaaattgaaggagccagaatttgaacccagactcattcctcttgcagaactcattacctctcagaaaattttaggggtgtgtgtgtgtgtgtgtgtgtgtgtgtgtgtgtgtgtgtctgtgtgtttcctatctaggccatgggataaaagtactttgtcagtacactttatgcacatattagagaaagcttcattaaaggaatacaggaataaaataatagatatcatgaaattatatacagatatttaaagatcagtcttcctaatgtttcccaaggggtctaggaaatttagtttaatttagtatgttttctaacttcaggcttatagctctgtcccactttaagggacattattttggctggggaatagaagtaatagtagtaattttatttagagatcttccataacatcaatttttagtggaaatgggtgtttgtcattggaccacagaggtaatactcttagttgatatctgtgctatgtttacaaaccaattatcttgctagcatctttctctatctttcaggagagtttagagtaattcttttttttcttttagatggggaaagaaaaatgatttacaataaggttaaattacttactggcattatatttgtcattgtcatattttttcttcatatttcatttcttcatcctcttagatgatgtttataatttcatattctgggagggaatattgcttgagacatttctcacccagaggtaagaattgggttgaaatttaaacagcttggatgaaaaagctgtttggggaatcagattttttttctttttagtagtgaaaaaatgataagaattttcttcctgtgaatgaaaataattactagttttgacacataattaaaggtagatgattgcatatgaggaagctatattaaataatttaaatacattgggtagccagttcgagccagtcactaccattaactgcagtctgaaagttgttccttgtatggggcattccaccaaaatgaaagtctattgttctttggcattaatacaagacttgtcctgcatttcatatttactcgggattataatctgttcatctgaaattttttgagaattgattgttctttcagtacttccaccaaagtacctgtctgtttttaaagagcatgataaatatttttgtcacacatatttccatagatgacatagttattgcagaagggtttcttgactatatcaatactaacgtatactctttgaaacctataattaatatgagcaaactaataatttctagacatacctgaatcattgtatgcctgtgattatgatttttctgcttgtttataaaaacaaatacattttaaatatgatgatgcccagaaatagagtattttttaaaatgccaaataatttaggaccatgaatacctctccataagccaagttttatattttgtatcctcataaatatatagcatagtagataaatttgacttgactaaatctagattattgtgttactgttagggtactcagtcttaaaaatgtactttggaaaaaagtccttagtgtttgaagacatacataaatattatacacacacattccttgcaccatgattcagattgaatatttttgaatggcttatcacatttcaggtttatctctaattatacagaaagtgattgtagttactaaaaacaatatgaggcaaatctttttctgttcttgatcattaaattcagttaatttatgaggcctgtcaaataccaggcacaaggctgggtgctaaggtataagaatgaacagccctcaattcctgctttcaaagcttagtgcctaggggtagatttactgtcaaaagaggtggttttttgaaagtatttagatggaagccagtgatgtgcataaaatgttttaagtcatcagcatgcatttattaattctaaaatcatgagggaagattaaagcaaaaccagtggggaagaagcagtgggtaaaggaaaatctgaaaatagtcacagctatataataactgatgaggaaagaaagaagttatcaccagaaagagatgactgttgtattgttttctaaaatttccacttatagtgattttctaatcttaatgataccttcaaatgtgtatgtatcacttttttatagttttaaattaatttatttaatgacctcagactctttatctgtgattgataattaaagggtattaggctttataagaactatttatagctaagagttacagtgcactatcatatacactttgaatttcagcctacaatttggagattataataggggaaaagttatgtatgtttgcaacatgattatgtattttaatatagttttaaattttagtatgtgtattaagatggaattaagaatactgattgattgtaaaactgaagtttcgaaacaaagttattttttatgtgcaaggggctgagatctaatctatgacattttagaggttttctttaagaaagaggggttattacattgaaatatttattgttttgagcaatgtttgtatttgtgaatactactagcatttatatctaagggatgactctagtttaagaattatagtgtaaggccattgaaggcacagtggcattgaacatttgtggagatactcttacacctggtttagtctttcaaatatttattgagttcttacatatacaaagtacaagtagaaactggagatacagttatgagcaaattttcatgagctttatcctcatgaaaattggataacgggcaggcaggtggcactgatcaaataaccacacaaatgtatataaaattgtaactaagataattctacaaagaggaagaagtgttgctaagagtgtaaattataggaagatttgacaggggagtcttcaacaaattataggaagatttgacaggggagtcttcaacaaagagttaatcaagctgaagtctgaaagaagggtaagtggatataggctaagaaaataggccagtgtataaatgagagttttctgatgtaaagtatttgtgggcatggggtagatgaaagtaactgaagaccaatatgaaaaacgcagagggtacggagttacattgtgggagatgaggttgaagctataggtaggggccaaccttgggaaaccccattgagaaattttgtctttatactaggagtatttcgtattactaaatactctctatactaggagtatttcgtatactaggtaagtatgtaaaataattaagcttttgagatatatcaccataattgtagaatttttaaaaatatcactctggctgaaataaaaaggttcagaaggatctaaaatgaatacagagagtctgcatgggagcctgtcatactggttttggtaagagatggatatgagagctctaatatggatattagagctcaagtaatgtgcagggattggagagatgtttaggatgtaaaatgtgaaggatgggagaagagaattaacagtcaggtctctggtgtaactggatggatagggaactgtattggtgagagtgtacattagtagaatgtttctttgcaggtttatttgacaatatcaaatttaaatattcactccctttaatgtgtaattaaagggaaaataggatgatatgctatataattatttaacacatgatgctgttttctcttcacatctgttgtattaagcgagatgggtaagtgccctttttatttcccgttgatgcttcttttttttttttttttttttgagatggagtctcactctgttgcccaggctggagtgcagtggcatgatctcggctcactgcaagctctgcctcctgggttcacaccattctcctgcctcagcctcccaagtagctgggactacaggcgcccgccaccacacccggctaatttttttgtatttttagtagagacggggtttcaccatgttagccaggatggtcttgatctcctgacctcgtgatccacccgcgtcggcctcccaaagtgctgtgattacaggcatgagccaccacgcccggccggtgcttgtttattttacctttctcttctggaaatctataaaatgtgattcccattatatcatattgcctgttacccatccttcctgtagacacctatggatcctttggtcacactcctcattctttataaagtttgtctctgggctcgctttgtccaacttttgtcctgattctttgttaattcaataacctacatagatgaggcgttcagtagctggcctctattccttcaattcttctccagtatttttggttctccaccttaacccagtcacctactctcacagttacctcagacacttaattctgtgatattgtgtatactacatggtacctcagctatcctgcatctccctgtgaccactgatttgtcttgtagttcaacagaagttagcttactcccaaattttaggtagtccttgactcttctagtcttttttaaaccatccctcgtattctacactcagtcaatcggaaactattgttgactctcctttaaaaatatatccaaaatattaaaagactgacagcctctaagactaccacttcagtccaagccaccgtaattgctggctattgtaacagctgacatcttgggctggaggtgtggtgagggtggttaacagaatcccaatacaaacttcagatcaattaaatgagaatcacaggcatgcatgaatcacgtgtctgtgtgtgtatgtgtatgtgttggagaggtagcagttagcatcagtgtttttgaagcatcccattgcagataatttcagaatgcagtcatggttgaagattactcttgtaactggtatccataaagactgttcttcacacaggagcttgagtgatcttttaatttggtcaaatcatatttctcttctgttcaaaacccactagtgatttcaaactgcacttaaagtcaaaattctgacaatgccctatgtgatcctgatcccctctactgcctccatgactttatattttagaactcaatttatctctcatatttagccatactggtctaaacattgagaaattaacacttcaaaataaccataggtcagaaaataaataatgggaaattaaaaaaatattttgaactgaacaatgaaattaaacatgaaaacttttcaaatgcagtgaaagagtcacttaaagtttatggcctctttggaagacagtttggcagtgtttttacaaaataaaattactccatatatttattatattttttaaagattatggatatataaataaatattttaaataataaaaagatataaaccccaatttaagacctggtaagattgggaacaaggcaaggatgttcgttctgaccagtgctttttggcatcatactggcagcactagctaatgtgatgagaaagaaaagaaaataaaggtgtacagtttgggaagaaataaatgaaactacatttgtccacagatgacatgattgtccatgtaggaaatcctaaaaattgaccaaaaaatttcctagaactaatcaacaattattagttccttactaataggcaaggttgccagatacaagattaatatacaaaagttaattgttttcatatatgtcagcaatgcacaataagaatttgaaatttaaaagataatatcatttaaattagcaccaaaaaaggaaatatttaataaatctcataacataggtacaaaatctatatgaggaaatctataaaaatatggtgaaagaaattgaagagaaacaaaataaatggaaacatcttttgtgtttctggacaggaatactcacaattctcaagatgttggttctttccaaattgttccacagattcagtgtaattacaatcaaaatatcaggaggttatatcttgcttatggacaaaatgattccaaaccttatatagaaaagcagaagactcagaataactaacatatattgaaggagaacaaagtctgagaattgacagtacccaaatttaagacttactgtaaagctgcagtagtcaaggcaatgtggtgttattgaaaggatagacacgatcaatgagctggaatacagagcccagaaataggcctacataatcaacttgtctttgacaaaggtgcaaaggcatttcaatcgataaatgatactggaaccactggacatacacatgctaaaaaaaaatctagacacactggacacagatctaacacctttcacaaacattaactcaaaatgaagtgtagaactaaatagaaaacacatgcctactatattctgagaagataacatagaaaatatagatgttattggatttggtgataacattttagatacaaatccaaaggcatgatccatgaaataaacaattgataagttagactttattacaattaaatacttctgctctgcaaaagacactgtcaaggaaatgaaaagataagctacagactggttaaaaattttatgaaagaaacataacagataaataaatgacataaaaatataaaaagaagcactaaaatccaacaataagaaaataacctgattttaaaatgggcaagagatctgaacatacacctcatcaagaaagatatacagatggcaaataaccatgtgaaaatatgtcattagggaattgcaaattaaaacaacagataccactacacaattaggatggccaaaatccagaacactgacacaaccaaatgttgatgagaatgtggagcaaaagggactgtcattcatttttgctgggaatgcaaaattagtaaagccactttggaaggcagtttggcactttcttacacaattaaacatactcttactatccagtccagcaattgcatttttggcatttacccaaagtaattgaaaacttatgtccacacaaaaacctgcacacggatgtttactgcagttttattcataattgttagactttgaactaaccaatatgttctttagaagatgaaagcctaaataaattgtggtacatccagacaaaggaatattatttagagttaaaaataaatgagctatcaggtcagagaagacatggagtacagttaaatgcttattactaaatgaaagaaatcaatctgaaatgattacacactgtattattccaaatgtatgacatcctggaaaaggcaaaactaaaagacagtgaaaatatgaggggttgccaggggtttaagatgaagagatgaataggtgaggcacagaggatttttaggagagtgagaatacttcgtatgatactatcatgatagatccatattattatacatttgtcaaaggccttaggatatacaacactaaaattgatttctaatgtaaactatgaactttgtgtgataatgatgtgtcaatgttagttcatcattgtaataagtgtagtactctgattcagaatgttgatggtgagggagtttttgcttgtgtgggggtagcagaaatatgggaactctgcattcctttgaattttgctgtgaacctaaaatattctaaaaaaggaagtatgtacaatttttaaaaatagtcaaaatatttgagtaaaaaatgtcccaaaagatgatatacacacatccagtagaaacctgagagtgtgctcaacatcattagtcatcaggaaaacacaaattaaaacgacagtaacatactattttatacccacttgtatgatgaatattaagaacactggcaaaacccaaattttggtgaagatgtgaaacaactgcattttcttctagattttactgttattgacttctaattttcttccattatggcaagaaaataaaatgtgtaagattatattttgaaacttgatttttgtccctgcatgtggtctattcttggtgaatgttttgtgtgaacttgacaaaaatgtttattctgcaattgttggatttagtgttctataaatatcagttagattgaggcaataggtagatttatctagctcttcagtatcattactgtcatttatttatgattctgatagagggttgctaaaatctccaactatgatttgaatttggtcagtttttttctttcaggtctgacagtttacattttatgcttctcctgaaccctcattcattttgtttatttctgtattttggaagcttctagcctctcttttttagcctcccacaaacctcttgaattcagtatgtgtccagtggggaaacagatgtgtttgttctcttaattttccaattataacacccctccgcctgtgccggtgatcattaaacgttttgctgatttctccttagcccattttaagaaagttctcctctcttaggaacttttgtttgtctacttctccttgctttctcagatctcttatgcctctaaaaaatatggtgttgtggtttatccagctttttctagattttagcagagagaacattcactggcctcctgtgacttactacattatgcctagaaggtgaaattcctttctgtgtctacctcagcacattgttttggtaatcaaagtcatggattgattgaatataagcaactacatatcattatgtttaaaggaagacaaaactgtgctttttaaaataatttactttctgttttgtttatttcaagcaaaatatttaacccactgtcttttttcccctatattttctttaaaatctggacacgtaagaaagtttcgtgcctggtcctgttctcactctatgttcatgttctattctttggctcttatccactgtgtgtatcagtgtctctcaagtctgtgttctctgccctagtcaccctcttgaatctcaaacttacagttttaaatgtttgtttgacatttgattgttcttcaaaaacttcagactcaacatttcaatccccaaattcatttgctttgccttttagttggtctcctacattcccagggttctgcatctggctctgtcagtgggactgactgtaatttttagtaagcctctgaatctctgtgatccttacttttcaatttatatttcatttaaacgaatcaaaatgtagctagattgcttgttttaacaaaatattttatcaagtgcaaaattagtatttatcttttttataaaaccataatagaattgcagctacctcatatgtaaatgaaataatttattactttggtaagaattagttattaattggtctagttaaataataattaaggataactttgtcctgtcaactcagttcaatgctcaaaagaataggtttacaaatcctaagagatgaagttaaattagttttaattgagctttttatgtgaccacttaaacacttacctatcctgaagtgtctgtttttacagctagaatatgcaacctgttatcttctaatttctttaattccctcttttctctggagagagttctgtatcattgagtatgctatacttgggtgaacacaatcaaatgactttgactttggtgtaggaagataaatatcaatgacatactgtagggatagataaactcaaaatacactgtagaatttgtctaattaatgttttatgaaataaatgttttcatttatttttcttaatgaaattgtatagcatcttaacatcttgagacttcacaaatagttttaggactttatattatgggaagtaatttgcatgattatgtttaattcctttcaattgtttcactactcacaagcgtgtctatttctgagaaaattctatatgtgtctttatgtaaagtaaaatcttttagtattcttgtagtttgatccttagtaagtggtgataatacataaagaacaggcattatttatataaatttctaaattgaatattatatcccactacataggctcttgtttttccctcagagatattcataacaaatgagaataagggtcaagaaaaataacgtttaatataacaacaaattttgtttttttaatagactgtgatgagacttttcattattcactagaaatgaaatttcattgctatttagcacaattgttcataaaactacttcgatttaaaaccatttaaatgaattgcactgcttcagtgacaaaatattttcaaagttattttcactttaaaaatggtcttgatattttaagtccaggtacatatgaggtggagttgccaagtattttctgaattaacactttaaattcatcaataaagatatcagcacttttcataaaagttatttgctttggtaaaactaaccatgtaacgcatggtaatatataagcataatgaaatataaccctaagtcatagtttacaggagtgaatttcaagactgctttatatacaaggaaattttaacttttcagccatatttcatttaataatcagaaggggaactttgtagtcttttaataatgaaatatatgctgttaatctttttcttaaaaaattggagaagtcacatttttcaaaatatttctcatctctctgttttttgtgtagtcccatttcatagatacttggatagaagtatgtgtgtccatattttcattctctgaatatacattcaatcatgtaattaagagcaatcaccattatcagtaattttaaaacacctttttgattaatgtctcaatttttttctgtcatactatttttacccatgacaaatgataattcaggaatatatgtaaaggaagagcatgaaacaagattattatagtaacttagtgatatattataaagaagagtatttcctgtagggtagtccaattacaaaatagtaaaacaggaacaaaacacaataaagtgtttttcctatttgtttcagtaagtttagcacagcaggagtcgtggcattcctcctgactggtgcgtcaaatcggcagtttgaaatgtaactgcaaatgggaattattttaaagacaccatatataagctaataaccttagccatataaatgagataattatacagtatttaatatatttagtttcttttcattgtaataatttcataccttcagtttgagagaatatgttcattttgaaagattaataaacttttatgttgaaggcatgtaagaagtaaactttgaatcatttaaactttgcctgtatcagttttttgctggtatctgtttcttgccagttcagtttagtttgaggaaaagatgttgtgaattaaacgaacagcaaacatcacaaaaaaattgacataggatccaatagaacttttgaaaaatagtctgaaattacttcaggacaacatcttggactatagcataggagaaaaaggattgattttgtggatttgtggaaatttgacacttttaatggcaagagatctaggttttagaaagttcaaccaaggcaagaaggataagtgggagaactgggacttctatactaagggaggataagatctcaaaagtcaggtgtctcttgacagtgaatcttgaaaagatatagttgggagtcttggtaaaataaatatctgagggatagatctgaggccccaaaaggaaaattgtgctttgagtagtacaagctgcttctgactctgtggttccttatatatttcttattgtgtaagtccaaagttcctactgcagaagaggtgaccctaaaacagtgtgagaatgtgctgagtgattgctggtagtatggagcattatacagtctgcaaatgtggagactgtaaaatgagttcagacaggaacttttagtcttgccctctgacattttggcagttcttattcaggcagaagaaagatttgtcttaattaaggcttatgttcatatgttcataattaaatagttttaaaaacctgaaagaatttgctagagccaactgtcagaattgtgctgtatccaactacaaatttatctggaaggcatttcactgccaagctttttgaatatgtagtctgaacagcgtgactctacgtctttacctcccagtcatacctcaacccactacaatctggcttctttgcatcattttttctgttagacatagtgccctttacaaagtaaaagctcaattgatatactgatgaattttaattttaatttcttatttatattttatatcctacttctaaaatattaaaaggagatatgttaagtttgtatgaaaattagacactactagtcaaataataaaataaataatctttatcacattttaaattaaacaattgagacaagaactacagaaattggaaaaaaacatgctaagcagtgaatagttactgcacatggttgaaatttcaataagggagaggaggcaaaccataaaacagtttcacagaatacaggaaaaaagaaacacgagagagaaaaataatgggcctttccatttgctgatccctctgccctcagatatttgcatgcccccagatacttcctctcatccttcagttctttcctcaaatgttaccttctcaggttcgccttttttggctaccatataaaattggaattcaacttatagcattaacacttcttatccatttttctaatttatttttcttctgagaacttacaactatctaatatactatatatcttacattttaaaaatctttaatgcatctctctcagtaaaatataagctcgtggcagggccataattagtgacataagctgtatccatttgaggagtaggaacagaagctaaattggtgttttggtcagttttggctgctatagcaaaatgccatcaatggatcgcttaaacaacgaacatttgcttctcacagttctaaaggttaggagtttcagatcaaggagccagtagaggttcttggtgaaggccctctttctgactttcagagtattgtcttcttgctgtgtcctcatatggtggaacgagattaactagctttctgtcctctttttagaaggacactaatcctattcatgttggctccaccatcatgacctcattacccaccaaaggcttcccactgggattagggcttcaacatgtgaattttggtaggcacagacattcagtccataacaattggaataggttgtagaatgaatggatggatgaatgcaaagaaaggaaatggagattgtcactatagatgacaaactttttcctactttttggctgtgcagaggaggaaggagatgtaagactcagggagaaatgttatcagattggaacaatcaaaaataattaaatggtattaaggaggctccaagaaacaacagaagagatgaaagttaaaagcatttgactctacagaaggtggaaggagatggaatctagttacacttgtggggattcctgtttactgggaggagggtcagaaacagcatcatgataacagacagaaaaaaagacagtggcagttacaaataggtccacagagatggtggcagcactatttgggagtgccacttgaaaactttgttttgtcacagaagtagaaagaaaggttatctggtgaggaagaaggaatggaataggactggcttggaaattggaagagaaagaggaaagttttaatgagttattctggggaatgggagagtgggagtttgaccaaagaagttaagttccattgctgtgcagtgttgagagctcgatctgtgacagaggttagaccatgaggctagttttctgcataggttttcaccgtggacatggatattttcatctagacttaggatattctaagaaaggcatgatggaagaactgcaagggggctctttataaagagttatttgaagtgatgaaaaatagaatttgaacagtaaaaacttgaagtaaatagataagaaaaaataagagaagtcaataataataatagctataatttgttgctcacctactatgtgcaaacaacttttctaaatattttacatatatttactcaattcttgtgacactcctatgaagtaggtattattacttaaatttaaactaccattattactctaattttacagttaatatgaagacatctacctttatacaaaaaataaatggcaaatatggaatttgaatgtttctatagtctagttcttgtgccttcgctaaaggactttgctacacagagatcctgaggagcataaatatcactactaatgggggaattgaacaagtgaaatgggaggtttggagatgtgcattggaagagatgatgattgaattagaaaattcagaaagaacacactttaaggtaacaacaaggttctgttctaggcaacgtgaactttctttccccctgctaccctccagtggaacaattcaatgctgcaggtataaaatactttacctgcatttattgaagattatctttttcatgtatcatttttgagacaaaaaaaagttttgataagacattgagatcttagtaattttgttatggatttttaagaaaatggattaaagtattctcagtgaaagctccatgggagagcatcttgaggtaacagtctcaagaaatgggtcagactgggataaagaccaaatcacagagtagcaacatatgtttatttcaggttatgatagatcacataatttgtacttcacctttattatttcagataactagcatggagtttcagaaggtgatttttttttcaggatgaaagcttattcatgcgggtatatctttggctctagaaattactgtcatatactcagtaacctttttgaaaacttgctgattgatcatacaaatcagggtcatcatttgtgtttctcaagaaatactgaagccactccaataaataaacttcatggtaacttgttgtttttacttgatgtaatgtgactggctaaccattgtataatgtctctgtgcttccattttgcattctatagggctagaggaggtgtaccactgtggaacagtgtacaggcttccaggctcaccttgatataggaacaagcttggcctaaagaagtcagtgtggatgaagtttggtggagggagatgaattacaagactatacaggactcgtttccttgccatagaaaggaatatgaattttaatttaatgataagaagcaagtagagacgtaatgtctacccctttttataggtataaaatggagattcagaaaggttccataatttgaagatgggagtctcataagtggcaaggctggactttatactcctgtctgcctgttacaatgcctattcttttttcaataccacctttattatctggtacatagatacttaacaaatgtttctgaacatatatgtgctctgtgatacagcagatgaaactttaaataactgaagtgaatacatttaaaaatactttagatgcatttattaaaagataacaataacaacaagctttattttgatcatttaatttttcaataatgtgttaaatactttgtatggattatcttatttattcttaataacaatcctgtgaggtaggtactattattatgcccatattgtacgtacatggacaaatatcttcacctcaatactgtgaggtaggtactattagtatactcattttataataacaaatattgaatatttaacaaatattgcaaatctatacttaaaatgggtagaataatagtacctgcctcacaggattgaggtgaagatatttgcccatggtcatacactgagtaagtgataaattcataatagcagaaactatttcactatttgcttgattgtcacagggaattctttgaaaccatgtttatatttgtggttattctgtgtatgactagatggttataaaagtttaaaaattaatttcatagttcacatttttaattttctataacaattcagagagactatccagacatatgaattaggagaataattctgaagaaatagatgacacagcaaaggactctacatataggttaggaccatattcttgttgggaagatggccaaaaaagaattttgaggatattttttcaattatttaacaaatattgaaaatctattatgttccacttggaaaagaaagaattggtgggtaggagccaactaagatccaataaacttttgtctgtgacttaactcttctgaagttgtcagaacgttatgttccccagagttagttgttttggttgacagaaatctatgatatgccaaataaagactttctagttactattaactttgccttgcatgtagaaagaaaatattactcatcagaacttatcataaatcttaggatgcagtcatatccctacatatattttgattatttcaaaatcaaatatatactttaaaaaaggcttactatgttttgaagggttcatattttttttctgaaaaatggcaaaatagtgctggcctcatgatgcttggtttagtacaggaacatacatactaatataaacagtatgcccagccaattcattatcatcctggaactatattcagcctggctactatcatgaaagatgagtagaagcagtgagctggcaaagctggcctctgcctctggttgttaagctgttggcagctcaggatgcatgacctttcaaatatacgcttctaattcaggacttcttatgatgtcatgtagttatgttcttcccttttagtgtattctctcttcaaaattctgtgctgaaaaaaggaaaaaaaagaaatgtaagctactatccttttggccaaatgttgaacttttccttctgtaactttgtaggtaggagacagcagagtaactgatcttcctactgaaatgaatttccttgagcaaaattatttcaaaaaatatgtctggtatctttgtttatacctcagggttgccgagctgtcagctgcatgcctgcttttcattgaagcatatgtatatttgtgtatatatgtgtttgtatggcttccaatagcatagtaataatttcaggggaggaaatagaaaagaaagcaagataaatgtattacatttttgtatttcctccttgcatttttttaaagataagactctgttgtaaaatataaactggcaatttgatcattacttgttattcatttgaactagttcagtcaacagataatggacagtgaacagagagacctcttttggtaagccatgtagtttttccaggggtgattgttatgctatgtgtatttagatagaagcttttccctgtgtaatcagcttgctgctgcccattttactgccaaacattccttctctatggtagcataatactgttaccaagggaacagcttatggccgacacatacagtagtgccacaaattaatttcacagttatcaggatataaggtgataacagtaacgtgagctactgtgaaattaccattgttcccacagagttagtgtaattattacttttgtggtaactaagcaaataattcacatcactactcctggatgtttgttctctcttctctgtctcaccctccttctttgtctttccctttccttcctatattttcctcttttgttgattcagactctctccctgagtctcttttcacaattaccaattaatgtagagtattttttatattggcattaagaaagagttttattgaagtggggtgaaggcatctcatatatgtaactcatgggcataattaggatgttcacttctatcaaagatataaaggactaaaacagtgtattgagaggatacattcaatttgtgatcaatgtagactcagagattccagttttattttcatagaatgttaacttcatgtgttgaatagaaggatcagtttaatgtgattaaaagcagtggagaaaaattaacttccctaattagctgtgttgcttaggacaaggaaaacaacttagctttttagtacttacatctataaaattgggataataataatgcctacctaacagaattggtatgtggattaaaagagatatgtgtgaaagtgaattttaaactgtacaataaaagttttaagctattatgatcattgtcatataaatggggatacatctgtaaaatggggttaagtatattcacctaacagaattggtatgtggatgaaaagagatatgtgtacaaatgaattttcagctgtacaatacaagttttaagctattaccatcattgttatattttaatggaggcatcttttgatgatagcctaccctcattatcagaaaatttataaggataattcaaaataacagcagtaacacagggaagaacactttttattgcattttattataataaaaagagtgtttcattatacctagggcacaacaaaatgagatgttatcattataaaataacagtaattttaataatgaaattttccagagaatgagtcatattttttattgtttttattgagtatatgtatatgttaattaaaatttcagcattgaaatataaaataatataggagtgtgtatagtatgtccattattttttaaaaagctacaatggtgagtacatgtgaaatatgagttgttcactatgtcaaaaagtgaagttgctaagacaaaggtaaaattatagaaatgagtttatgtaggaatgtttgtttttaattgcgtcaatgtgcattatgatctttagtctccattctatgttattttgcttttaaaacgtattttatgtattctgttagcaagatcagcatatagctaacagttagtatcagttactaaatgttgagtagttaattatgtatttatttatcattctaacactataaattatacacttttagcagttagaaaattgatacatgatagaataaaataatttgatgaaatttgtagctaggcatatttgttgaatgaatgaattaaatatggtgaatatgtagtaaactgcctcccattgctaaatgtctttttagagagggtaggaaattaaaaataattattttctcatgtaaatttttctgccacccattttgaagttacccaacactggtaactttacataaagaagtatgactttaactggactctgtgctcatcccattagttaagactgctttctcacattattattattttggaaataagtaaaattatttttatttcctactcttatttgttctctacaaagaaaatctaatgtgatctacaaaaagatactagaacaaacaagattaggtatattgcaagattgatatacaaaaatcaaatatattctaatcactaacaacaaacaattaaaaattaaaacttaaagcaataccatttaagatagcataaaaattatacagtactagggataaatctgacttgtgaaagatgtgaaagatatgtgtactaaaaatctatgtaccctgccctgaaataagtgaagcatggcttcccactttttaagtgtgaaataagcgtggtgacttttttccgaaaagtataatatgtaaagagttggaaaagagtaactttacagaagagaagcctgaaaaatactaactagccaggcaatcaagattgatatcaatggtagtaagtcatgttgataatatgtacccttaggtgaatggaatccaggtcaaacaagctttttaaaatagagatttaaaaacaaaacggaagtaatatatgttaactgtaaacatctatgatcagtctttaacgtttttaatttgcttttctataatggtgaatgatgctgaatatcttttcatgtgttttatgccatctgtatgtcttatttggtaatgtgtctgtttaggacatttgtttattttttttggtcggcttgtttctgttattatttatttttgagagtttaaacaatattatggattcaagttcttatcagatatgtgccttgaaaatatttcctcctagtatgtgggttgtcttttcattctcttaagaatgtcttttggccttgcctggtggcttatgcctgtaatcccaaaatttgggaaggctgaggttgatggattgcttgagcccaggagtttgaggctagtctgggtaacatggtgaaactctatccttactaaatatacaaaaattagctgggcatagtggcgcatgcctgtagtcccagctacttgggaggctgaggaaggaagatcacctgagcccaggaagttgaggctgcagtgagccatgattgcaccacagcactctagcttgggcgactggagtgacaccctgtctcaaacaaacaaacaaacaaaccaaacaaacaaacaaacacaacaaccaggtgttttaaagaacagaaattgttatttttgatgaagttaaatttatcaatttcttgtgctatgatgtgtattttggtgtcatatctaaaaaaatctttgtctaccctagggttgcaaatattttctgccatgttttcctctagaagttgtgtagttttgtgttttacatttggctctaggttacatttcacgttaaattttatatatggtatgagttatggtcaaagttttttttcgttttgttttgtttttgtttttttcatatgggcatccaattgttttaacaccattgtggaaaagactcatttctccacggaattgactttgcacttttatgaaaaccagttgtcagtatatttgtgggtctctttctggactttgtattctgtggcattgatctttttttctatattaacactggtatcatattgtcttcacagttagtcttgaaatcagttagttatagttctcaaagttagttttcctttttataagttgtttggctattctaggtcacctgaaattccatatgaattttagaataagtttgtctatttttactaaaagcatctgctaggattttgattggggctgtgttgacttgatatatcaatttgaggtgaatcaccatcttaacaaaattgagtcttctgacccatgaacatagtataactttccattttgtaaggactttaaatttttttctcagcatggtagttttttaaaacatattttaaaacttaggaatagttttagggttacagaaaaatagcagagacagtacactatatagagatttcccacctacaccaagtcagtttcctttatctttaacatcttatataaatgtgctttgtcaaattaatgaaccagtattgatacattattattaactgaagtgcatactttattcgtatttcctcagtttttacataatgttctttttctgatttagaattccatccaggataccaaattatatttacgtgttatgtcttctgaggcttctcttggctgtggcagtttgtccaacttaccctgtttttgatgaccttgacagttttgaggagtattggtcaagtattttgtagaatgtgccttacttagaattcgtctgatgttttcctcatgattagagtgggattactggttttgggaggacaagaactaagatgaagtgtcattctcttattttcatgaaattttatgggcgttttgatgtgattgaggcttagtttcatcatctgtaaagtggagataatgataatggcatgcagtaaacactaagtgagaaaactatgtgtgtaaagtatttagcattaagaagatctgatgcagactaaagagctcagtagcggccaggcgcggtggctcacgcctgtaatcccagcagtttgggaggctgaggtggacagatcacctgaggtcaatagttcaagatcggcctgaccaacatggtgaaaccccgtctctactaaaaaatataaaaattagctgggtgtgttggctgcctggaagcagagagaattgcttgaacctggggggtggaggttgcagtgagccaagcttgcaccactgcactccagcctgggcagcagagcaagactctgtctcaaaaaaaaaaaataaaataaaaaaataaaagctcagtagcagtatttttctctttgggagatgggcaaggccatatgactagtttggcgtcaggagtatctatgattaaggtcttcttactgcactgtccttccttgtgtctaatgggcataccaaaaatagttgttaatggaaatatcttcactcggtactgcattatgactatgcataatagagttagcaggtgaaaggttctcttagaacaattaagaagtatgaatccattccatcagctaaagcatttaaaaatatagtttttttttgtaattggtttctcaaactcaaaatattatgagcactctgcttcgcagagcaataggatattgacaatatttgggtttttttcttttttacccattactaacttcctttctatatttctacttctttgtcttttcctacaatgtaacataaaaaagatccattacaatattggtgcagctaaatatttgagtgcacaaattttagtgatcagaatagctttagacaggtgtataaaatgcttgttttttctctgtcctcagtgtgggaaactgaataggataaattaggttagtcaatacactagcatttaattattctttttctcaaaagaaagaagtttttaaagtagtaaaaagaactgtatctgaggccagctgattcacaaccagaccatcacatttagttactagacttaagcatggcttctctggagacattctgtgttaccaaaaatgcaaattactccttcaaaaaatttacacatggtacaaatttagcacacctgtagtatgaatctacattagaccacaaaacttgttccaatactctaatgctacagttgcaaaagcacatcattatggtttccaaattaagcagaggtttcagtggttttaattttgtgaagatgttttccttcctgaatcatattgtgagtctagtagttcttaactgggggactgggtgttcctgtcttttggaggacatttggaaatgtatggacatttggaaatgattgtcacaatgatttttaggttctctgacatttgataggaaggggtcggaaatacaatacatcccacaatgttgtggaaagcatttaataaaagggaagcattaaatatttcttaaaaatgtgaatcatgccacttgagaactgtgggtaatcctgatgtcttatgagaaaaatctgtgtttatgtacattatgtattaaactgttatttagacataactttggatgaaccaactgccttttttcttactgaatatgtaaaaattaataaagaagctataagctcaacagaataacttatctattcataaaatgtctttcaatagtttaatagataactggaaatttatttttgatagcagcttatactaaagcaaataaggacgtgaaaattgtagataatctttaatcatgcttacaaatttgattaaaatcatctgttgattttttttcctaattgaatcttttgaactcaacagaatgtctttctagtaattctactttttccaatatgtgacctaacatgagcctagtcttttgaagaattctaaagatgagtgaaaaagagatgtgaagagagtaagaaataatatccaaatggtgagaacacagaaaataaccacactgtttttactttttcaacatatggtattatccacattttgcagaaaaatagaatgtattcaagcacgttttctgagacaaatgtcagaaaagtaagagaaccatataaatcacattgttgcagactattctgtgccctccatgaaaacattgtatttttgtttgaaatgtgtaaattctgtagaaaatcagttctctctagggtcgtctggtgtagaatccttctgggctttgtatcatccttttcaatatgtttaagaaataactattagagactaaaatattagtatcattcctctctttcttatgcaagaaaagtgacctcttttagcagcaacttttctgtgtaaaaagcacgtgatcttgaagtcagctgggtccatgaagagtattcgttttgaacctaggccaactttaagacagaattgatcatttttctccaataccagaaagagtttgctcttagaaaatggtaagcagtgtggggattccagatgatttcttgagggaggtagatgaaaagtttacaacgtaggtcccaggtttctgttaatgtggctcctcattagacttgttccttccccaaagctgccccacctcccacaaatacctcaagtgatgctttgcggtttttctctgttctttaacttgatatttctcccttgcaatcttgaagggcttcgttttttgtttttcaaaaccatcaatctctaagtctatcaaagacttaaagcagtatataaattaatcatattgtgttaaagctgcatgctaataactagctgagatcagctgtactcagaggttgagcattttgatttgaggaagggagctgagtgatttgtggacacggagtctttcaggaggtatatctaagaagacatatttattttattcttaattttgttattcaaatactgcttttgagaaaattatgaagtagcaaaggaacttaggccagcatgaggtcatatgggcttggaaggaagtgtgggaggtgagaaaaaaagcacagaaaaaacaaggctatttaaaattttccttatcatctacaataaataatatgacttattttctgagggtgaaagcctaaaattcattttcataaactatttcccagaatttaaactactagaattcaccatgcagggttttgtatcttactgatcaatagtaaacatgcaaataatagcttgtgattcaattttgcaaaagaaagaaatgctgttaaatgattgatgctcccagtatagtcagaagccatatcattaaactgtgtctcatataaagcatttctgagggagggtcagctcatgtgattagttatatttgcttctgaaatatgtaatatatggatagtgctttcaaattttaatactgggtaattagtagattaattttatactcaaattagggctgttatgtggacattagccagattctgggtcactatgaatttattattgaatgaaggtactaatgtgtaccccagtgcaggttatttcttgggttaaggttttattcagccacaggtgtttgcattaaacagcttgttcccagcactttgggaagcctaggtgggcggtagatcgcatgagctcaccagtttgagaccagcctgggtaacgtggtgaaaccccatctctacaaaaaatacaaaaattagccgggcatggtggtgcatgcctgtagtcctagctactcaggaggcttaggtaggacgatgacttgaacctgggaggcggaggttgcagtgagccgagatggtgcctgggccatagagccagagtttgcttggaaacaaacaacaacaacaacaacaacaataagaaaaataatacagcttgtatttttgcctttgcaatattattcaatcctggatgagaattcaggggaattgcctttctgtcctttattagctgattagccttgggaaaatcaggttggattctataggcctatgtactccttgatcacttttttctcacttcatgttagttatcaattgctacataatcaaccattccaaacctcaatggcctaatgcaataacaacttataattttttgcaattgtgtcaattggctggactcagtgggtagttcgttggtcttgcttgagctcattcaaactatttcagtgatgtgggagcgccgctgatgctggcaggaccaagatggtctctcatgtagttgacagttggtactgatcgtcagctaaggtatctggcatctttcttctctctcatatggcttctcctcctttggtaggctaaactaatatcttacagcctagaggtctggattctaaaggagcaaaagtggaagttaccaagcttctttaaaaccaggttcaaaactggtgcagcatcacttctgccatcattttataggtcattggaactcacaaagtagtccagattcaagggaagggaatgaaggtcccaagtctctgttaatgtgcctcctctgtagctttgtttcttccccaaagctgccccacgtcctgcacatacctcatggattgctgttgcagctctctatatatcttcatgggataaatatcacggacatacagggatgggagggtttattggcaccatctttgaagtaaagctgccacttattacaaataaagtagttttcacattgtgttgcaatggcaatttaacctgtctacctctctactaccgtgtgatttttctagaggaagctttattactaaatcttgtctcttatatgtatgcagcaggtgaccaataaaggtcaatggtagagtgatctttatgttgaagttgttgattatggtaatatcaatgtttatatatgcttatattttagcacttacatgtaaatatcttcacctcttttcagaaaagaggattttgagtttaacttagttttcaaaagtgctctattattgttatagccttgttcgacggaacttctgtttgttcagaatttcccttaagatttagctttttttttcttttttatgaacaaatggaggacatcataaaaattgcagaaggatcattattttaaatggtgtgccttagacttgcagtctttgccaagaattattctttaaagtgtttgctacttctctgcctaacggtaagttgaatcttgtaaatagacctctttcttcttcttcacgtattacagactagcaggggaactttgccatggatgactgccattattctaaatgcaggctagaaatgcaggttgacaatttaagccagcagttgtgatatagcatcttgaaacttctttatttccaaagtgttttcattatgatctatttcactgtttaggataaaagtctcacttatttcattttactttagatgttgatgcaattgtggcttattaagttatgctttcaaatattttcactgccaatatcaagtatcctactgggaaatctgtgaaacaagatgagaggctttattttctttctgaatttaggtattatttgtgtgcatatataacttgaaaattgtagtagtattttctgtaattgaccaaatgttcaatttttttcattactattgtatggaaaataggagaatgcatgaatattttaaggactgttcttagttcacagtgacctgtggttttttttcctcaaagccagagaaataaagcataaaatatgaagcaatggctaactagtctagaagttaggaacttccatgcaaaaggagaacaatttacacagttttctccctcactagttatgtaataattagctttttatttccacccaaattctttcaggtatatactatattttaacaagctttccctttgcaaatttttgctatttttaggtcaaacaaaataagtaataactccttgttgccaagataacataagttaactcattgccttcagaatgtgtaatttaatattggccttcagaaatcacactcttcagcctaaaaatagtgctgctctttaggtgtaaacttcaggtgtctattctgttttattcagagacaagctaataaaatgacttatacaaatgtctcctcaggtagggccctcatcttgtgtgtgagcacatttccaggatgagaaggataaatattgaatggatggtcctttggtataaaataagataatctttgatagatggtggttttagatgagaacattacaataattcagagtggactaagcacattttatctttgtgctttaaaaaaaatcatttgtaaggaagatgtcttttgcgtaaaagtgaaggccaattacacgtcacaaatgtccacatttttacatatcacacttgttttcatctgtacgttaaaagaatccatgaatttcatcagaaatataaattttctagggcaccaatcatcaagtttgttagaattggtaaagtgttggttaataataaacatgtaaaagagaaaggaatgcttttctaaaagttgcccttgttctttttagagtaatgtgatttaattgccattcatcttctgattgtcttaaattgcgtattttgggagagaagttgaatcccttttctttcttttttttttttttaatttggctgaggcatatcgttgacccaagatttaaaggccaaattgggaagatatcattgcagtcaagagtcagtggcccggccggacgtggtggctcaagcctgtaatcccagcactttgggaggccgaggcaggcggatcatgaggtcaggagatcgagaccgtcctggctaacacagtgaaaccccatctctactacaaaatacaaaaaattagctgggcgtggtggccagcacctgtagtcccagctactagggaggctgaggcaggagaatggcatgaacccgggaggtggagtttgcagtgagcggagaatgtgccactgcactccagcctgggtgacagagcgagactccgtctaaaaaaaaaaaaaaaaaaaaaaaaaaaaaagagtcagtggcccaaaagaaaaaaagataatctctcttgtggccagcataaagatctattaataaacacagggtgtgtgatgtgcttgaaactcactgcatatttaggttctattcatgtttggagaactgctataaaaacatacggcattgaagactgttgatggatgagtgtcattgcctgttgaaagcttcaaatcacaaatatgtgtgtaagtaattattttcttccatttgtgaaataccactttaaatatatattcaaattgaataatatgcataacataaaacagtgatccaaactgatttgtatgacagtatgaagaacacacagatagaagaaatctgtgtggtgcatgttgtatctcagggagatagatttttacctttctcatattcagtaaagtacttttatatgttatacattatgaaaataacaaatgaaatatgcataattattaaacgttcaatggactttgtggtgtttgaagcttatacaaaatgcaagtatattttgctatgctgctatgtttttctctttctacaaataaaagtttgtattagctatattctcatttaatgattttactaaacaacaggatgtgaataattttcattagacagcaaagattaataaatttatttgtgtttattaaaatcagaacaccatgaaattataaaaaattatattttacaaatagcttattgtctttcttgcttttaagcacattatatcctcacacaaaagtaaccagggcaggaattgttttcctagcatctgtttgtcattaaaattcttctggacataaaattttatgtattggctacctttgttagtgtctatttaactgtataaaaaatggaggccttaagaagttgatatagatgacagtccaaatcacagtctcatgacaatgtcacattggataactcaggttaatctggtaatatgcatccctcacatgtttttcacagtagttagaagagactgtctgaaaaggaaataggagagaggtaggtagatttgaacacagatcatttatgagagagagtgcttccatagtgcctgtgtggagtaataggaaatataaactggatttcttttcttggtaaagtaatcgcctattttgttaaatgagaaccacccagaacattttgtactacacttcttcagaaagatagtttagtcttataaaactacatatatttacatttgtttaaaacacttagagacttaagtgtgttctcttgttctttatgtcctcttcatctagagatctacttcatatatcccctagagcttcttgccagggaagcttggttactaagtagatacctacactctcaactgttggtataaagcgctgagaaattggttttatttacactgtaagagtaatttttttttttaaaaaaaggaaaagcatggcttatatctaaggaaacactgttgtttggagaggtaatgaatggcaattagcaggaatcgtcatgtctcccattttgctttttagtattcctcctatgttgaacgctgacagtctctttggaatagaaaatcaaatgaagtcaagtattgcatattagatggctgataatgtgattcatatctcttataacctattacttctattactaacagcaaaaagaaagtgagaggataatactgccagtgtagtttcctccctgcttattaagccaagatatgtgtactgcctgtactctgaacttgcctctgctgaggtagcatctattgtcatgggaaccattattttattggaagcatgagagatttcagggaaaagctgatgctttctgttaccatgatattgggttagacttgggatttagaataaattactgaccataagaaaggtgtagcctttctctgaatgagttgtcttccgaatctgcaactttttttgtcttttccagtttcatgacctctggtaaatgatgcctccttactttgattaaaaataaaataacaaggctgggtgtggtggctcacaccttgtaatctcagcactttgggaggccaagacaggtgggtcacctgaagtcagaagttcaagaccagcttggccaacatggtgaaaccccatctctaaaacacaataattagctgggtgtggtggtggatgcctgtaatcccagctactcagaaggctgaggtgagagaatcacttgaatccaggaggtggaggttgcagtgagccgagatcacaccactatactccatcatgagtgacagcaagactctgtctcaaaaaaataaataagtaaataaataaataaaaaataaaataaaataacaaagctgtattctttccttatttggaaacatctccctgggaaagcagtccctacttgccaaacccgataaagcacatctgattttctgtggtgtaagtcatcttgtataaaagtattactttaagtaggatgatcaatacctattcctgtacaactagggcatggagttctttttcattttggaggaggccagttatttatagtcatgatcattcgaataatagttttttcaaaaatccattttttatccttttctgttcaacagcgttggctctgtaagaaatagaaaggggacatttgagagatgagtaacacagggattataacagctagcatttggtgcttctctccaacacactcctaccccatgctttcagaattctccagtgcccaccacagtattgcacattcccctaggactgtgccttcactatgtcggctcacatggctcacattagggtgaaccatggtatcaccctgatgataccaccacctgatatccagagaatactttctcagtcctgactcctacagacaaaagtaacaaaggagtttgaccatttattctgtcaaaggtatcaaaggaaaataatttactctttataaatgatttaagacatttgattaatactattaaagatagaagggattgtcatataaagtagcactgaatttgtggtcaatttctgagttgtttttcattcactggtcttgcctttatactacttttactttctgtgcttttactgaacgttttaaatctaaacagggaaatgaataaaattagaatacagtttagtaaaatgggaagtaaagtgagtatacatggcagtgcccccagcaaatgtataattcttagtcctctacctgcagatagggaagagctcactgtgatggggtcccatgatccaggaaaggcaactgcaagggatgtggacttctgtagaacatgctcaaagcaaagctgcagtgactgctgtctgttgtgctgcaaagacagctgtctggggccacagaagaaaatgggatagtgggtttgaaagaaaggcaaatctgtagagaaatgaagataacagaggtggtttaggctggtagctctgcgccgtgatttatgtaatgtgaagtgaaccaggcagtatggacaaagcatcctccacagacctttgtttgcagtggtttaatcatgtatctattagtgtgagaggatgaggaagagagagaacagaaaaaggtgtctgagtttacttcctcaacaacttaaaatttatctttctgtccctacatggttaccttgtactaataccttccagtgttgcacttttcggtctaagagatttaccaaagaataaaggattggaatgagacacaggcctgacgctaaagtgaatcagtcagaaccaccatatcctgtttctgtgtgatcttaagcagctttctcaacctttgctaagactcagtcttctcctctgtggacatgcatggtgtggttattgagctaagctgtatctaaatttataagcatttgaaatattatttagtgctgattaaccacattaaaatgcattattggtatagaaaaaatgtgagttgacttgttaaaatcatttgtataatttttagggtttctttagaagataggtaaataatgtctatcatttaaagctgctaagaaattatttgtaccacagttttggaaggtgtgttcatggatactctcaggaactcagtgatctttatcacatcattaggatcacatatacatttaggatgtgattcaggttgatataaatcattttgtttcagaacttgcagggcattttttctaccctaaacaagactctagttgttaaagaagggtttaatgatgttgaaaggatgtctttatgtaactaaacatgcatggaacatgttatacagtaggtgctcaatggatgcatatatgtagacatacaagaatggatgagcaaatcaaaacattccctggggcatctcagaaatggtaatgcttacactctaaatatgagataactacatatgtctaattttatcaaacaaatggtggtcttaaaatcataggtaatttttgtaccaaaagtataaagcaaatttattagtttttacttttgtatacatttacaatgaatatttcctcaaaatgtttaaacatttatagtaatcacatacagtggatggaaatagaactctataatgaagatacaggtggaggtttagccaaccatagcagtgtagctaagactgctgtatcatgagtaatacagcttgttttcttggttttctgtggctgtgtgctccaagcagattgccccattaactgtcgtgagagttgcagttgtagtcattctggacattatgaagcttctagaataatgcctgttagttatttgttctgctgttatgttaaagatacgttcatattttcattgtctttaccttgctgtattctcttaaaaatatgatattgtctttatctgaaatagtatcaagcatctttagttttctttaaatgtcagtgaaattactctgcaaattgagcgaccaaatttttagtggtgaacacccagagatccatgcaatacagtttatagtaattcttcatttgcaatttgacaagttgcatgtttccatctggcttcttttcagttaaaagaagggacagaatgaggttttgtagagtactacttgcttggtagaacttagaatatacctccttctgagttgacagctgttgcagtatgttcaagaagtatccatgatttcttccctgtggcgtcaccaggtgctgtagtgcctggaggagttaaacgtggcactagcttttacagatgtcatcattgttatccacatgtaagaactctcttgattaaaactttgggcaaacagcaaatcagtaattaaactaagcattatgttattgtgcatgactttttaaaaaatttattgttcttttgtccatgaagtttaaacaagttttagtgaattttcagtgttcatgacatatggaaaagtttactgaattgtcaacttttttctcaaaacaacaatgtcgaagtcttaatcatagcctttatttgttcatcagtttctaatttttccccatttatgatttaactgcaactgagcattttactgaaatgtttttgttagtaattctgcttaattcgaaaagaacacaaaggtgattacaaaagtacagtacaataagttaatactctttttcctcaattccaagacatcactgatttaaaaattgcttttgtgggagaacacaactgcattaaatgtaattataaaacataacttgattttagaagcttcactgaaatcaaacaatgtagaaattaagttatgtaagtagccattatatattaggcacccaataaatattagatatctctaaaggtattttttgtcacaacttatgaatagacaatctataatttatcctagagatgaagtaactgatcatggccctacagctagtaaaagttagagttggttctagttgttcaacttctaaattcttatctttccatagaaacaagttgttacataaagtaaatggtactaccaggccaaagtgaaaataaggccaaaaaaaaagatgcaaccaggagtgataatactgtacaaaatgcacgccatgatttcttatatacttgataaagataaaaaataaattattctgtaagtactttagcaactaatgcaaaaagggaaacagagaacccattacaaacatgaatcactggatccatagagaagaataaatcagttcctgtataaaaacttcatgtttcatggtgcaatggaaatttctactgtggatactcaaaaagagggttatatgtagacaggtactttattttgtagtagtagtaattttgtagtactgttttattttgtcttcttgtaaatttcacacactagtgtatttatgtttacagtcttttttcaattttagtctttattttccctgtactttcttcaaatctaagctattgcagcttgtaagtctttgtgtgtgtgtgtatgtgtgtgtgtgtgtttgcaaaattatagagacaataagggcaaatacttgaatataacttcttaaactgttattggaaaaatagattctaaattttaggttacttgccagcatgtaatcagttatatgcctgattcttggatttaaaaatccttgtgaaaccatgtcaaaattattattttgttccaaatctaaaaatacccttttaaatgtagtgtttttctctcaggttgctttcaatagagctaataacttaaaaatctcaaataaattccagataatttctagacattatggctatattcctggtgaaggtttatttttataacagaatattctgaaaattaagatataaaaagaattgtcataaggtggcagtatgtttcaatgctaaccatcagtatagaaagagagcttgttgaaccaagtggttccttagctagtttgagctctgtatgaaaattccctgtagattttttttgaggaaaattgagcagctatttcttaggtaatatgtgtgaaattatcaaagatactactcttttgattttcagtattacttactgctgcataaaataaaaccttttccttcaccctagctatgcctatatatattgatacagcaatgaaaataaatgccttttgttatggtcattgatacatttaagtagtaagtgagtttacatgttttaagatataacattttaggttatagtcctgttgaatattgtgtaatagttataactttgactttggtagcattgaatgcagaagtattttggcaggatttaataaatagcattagtctatggagaagtaatagaatttaagctttttaatgaaatagagtaagtttaatttcttaccttctcactcattagctttgcaaacttgagctagttacttgggctctggattttttttcttgttaataatttagagataatataatgtttaccacacaagactgttgaagaatttaatgagatgatgtttatgggtatgctttctaaattttgagatgttttctaattattattataaccaaataatatattaactcttccttccctcccttcctccctccctccctccctctctctctctctctctctctctctctctctttctttctttctttcttttttttttttttttttgacagggtcttactctgttgcccagattggagttcagtggcggagccttgactcactgcaatctccgtctcatgggttcaagctgtcctggtgcctcagcttccctagtagctgggactacagacgtgtgctaccatgcctggctaatttttgtatttttagtagagatggggttgcaccatgttggccaggctggtctcaaactcctgacctcaggtgatctgcctgcctaggcctcccaaagtgcttgattacaggtgtgagccactacacctggctcctatttctattttctgatgtaatcttaagagaaaaacttgagggttgtcgcatttatttgccacatgacaggttagtacataatggctacttcaccacacagtcaagctagaacaaaaaaccaaaaagcatgtcttgttcatcatcaaccatatatcaacattaaagcatttttaaatttcctaccaatattatgtgcatggaggaggttactaggacccagaggacatgatatctgtccttaaatacctttctgtttggctgaaaaaataaaactagataagaaatgggaagacctgtgttctagggttagctggctttgaaatcttgaataggtgtcaaaagttctgtggttccagtctctcatttgtacattgaacttgatcatctgtaaggtcccttctggcacttttatccacagaatattttgtgttatgaatttgctaataagtaagcaacatacagtagattttcaaagggaagagaaattagtgtggccttgagtatttgcagtctctttggccttatttgcaagaaacagctttgtagttgctcataagtgaatggatagtcattttcatgactaaataatcttgtctctatggtaagtgaaaaaatatacatacataacatttaaaagcctggagtatattaattttttaaaagttttaatgttataaatgatctgggtgaaaaagcgaaacatttaaaatttttacaactaggtgttaggtagtaaataatgaatactcagagaagaaaagacatacagataaataattgttgcagttattagtagttccatcatggtaaatgatatccacacttcctatagtatttttagataatttcacttagagtatataacttttgtcgaaaagtttgaatactactttaattaaaactcacgtttgtagctttgcgcctttatgtattctcaaataccctagaaaatgtctaaacttgtaataacagtaacaactaattttgacaattaataaagtcctaaagaaaaatacactaagtatacatcaaaaagaatttccataagaaaactttaagcaggtttcctatttttgttgtgctccaaattgttgtgctccaaaacgtagactgcctaagaccaaggaaggaaaatgcttcaatactctgcctctgcctggagaatttacacttgtgttaatgaggaagctgagtatcagtttctctgtcttttttagattgtctgtgcaaaacagaggactttttcctgggtctccactacttcttcttctacatgcaggcagatgttgaaaagcatagaaaaactagagagaacgtcttgggaaaataatccaatcataagacctttttaagaggatcacctcaaaaaataaagacttgcaggttgtatgatacagatgaaccctggtagcagtgcctgcaactactacgcactatattctaacatcctggagcatactgaaaaatattaacctttgtgataacttcagagatatggacacaccttggcgtaattttaggacttcagcacagttcatgaaagcatgacttctttgaaaaaggagcaaaatatagactgagataaaacaaaggaaagaggtaagacagaattaagaatctaaaaacattaaataaactccactttgcaggcattcatgagtagaattatagctaaagaaaaatacaatcagtggtgaaaaaagaaatttgatcagctcttgataaagcagatgaaaatgataaagcttaaaattatgtgagacactctgttgtactatcaaatgctagatcttattcattctatgtttttgtaaccattaaccatccccacctttccccacctgctttccctcccaaccttatcaaacatcacatgtagcctatacatatatacacctaatatgcacccaccgtaagtaaaaatgaaaaaattaacagaaaatgaaacacatcatagaaaattatttttaaaattctaaatgtaaattaagatacagtaatgtgagacaaactcagtaatattcaggataaatgatgacccaatgtgggatttcttgaattcactaaaaaactatttgcattctagctatggtatcattcaattttctggaaatacagcaataaacaaagcaaacattgcacctgctctcacaaagatgacatcctgaggaggaagacagattataaacattaggacacaagaatatatataatatgttgggagatgataacatgttgagtaaaaacagagcagagttaagaatcgagagtagggaggcagaaataggtataccccaaagagaaagttaaataagtataaccaataatcagagatgtcatagaagagttttttctttacctgaatgtataactccaaatgatttattttcctagtttactattatctagtcaagttattatactacagcaattaagaaaagtcctgccaataaatatgtaggcaaaagggacagataggttaccaagagcagggggggaaatttaggtggcttcacctattcacttccatatatcagaagataatagaaaaattttgtctgcagaattttaaaagaaattatgttgtgggctaacagtttcacgtagaggcaagatagttaatgtatgttggtatataaatatattcttagacattcaggggttcagaaaatataccatttatctaacctattaggaaaaaaacctggaaaatattttacacttgaatggaaaacaatttagaaattgagagtacaagtgaatataaaagacaaatatttttaaaatagtagataataatatgagtctggcaatataatgatgataatctacatataaaccccagacactgtcacaaacctggcattcatagagcttctttcttttttttgtccctactccagtttggcatgcagtgaggtgacctttgaggatgctatttctagcaaatcattgatgatgatttggacattcaaaaggtttttcccttgtatgttttcaaagatgttctttaaaatgttcaaaatcgtcaaaccgtttcccacagtactgatatacatgaattttttttcctagttctttcccagttaccaactacttcagggtagttcaatttaggtgctgtttccgtgtgctctccagaagatactttttattgcgtatttcacacttgaaactctcagtagaatgtgatttcatgtgttccttaaaatggcaaagcaatttaaaggtggctgttgggcatggcctttgcatgctgtggacatgcccaggcacccgagatgggaggggaaagagtaagggtagatacccagagccatacttgcctgtggctttttaggtagaggctgagtcggtgtacctctacaggtggtctgatttgcacctttggcagctgagtgaaatgctcattttacctagtaacattgccacagcctctagcaaaactcttaatatcataaaggaagagataagagcctttcaaacagtgagagagagacaagagacgaagtctggggtgtttaaccagcctggttagggtggttaaaactccatgagggcaaacagatccttttactcacaggaaagagagagaggtggcagtgttttggaagagtggcagatcctacagttttgcattcatactctccttccaggatcctggatgagccccaggtaaaacaggaaacgttctcttatccccctcacagggcatgcaacggtggtgtggcttgcttcttcattgtcccaaagctcaaacccctagggggagcatgcatatgggcaggtagtggggaatgtggaccccacggcagcatctagggttgggtgtttacggctcccaaagctccagtgaacgtgtgttacagtgtgctttcagcttaggtgtccacaggcagcttgtgttaatcagcccaattagaccttctgccttatcacaaggacagaggggcttctttctgtatcctgggttcttgccttagtgtactgaaaaaatcagatcacatgtgggcttggaagatgggtgcaaagttttttattgagtggtggaagtaactgtcagcagatggatggggagctagaagggggatggagtaggaaggtggtcttcccctggagttgggcagctcagtggctgggctcttctccaaccaccctcagccaaattccatgtaatccgcttcgttctgccatctatggccgtgtcgttctgccatcgatggcaaacacagtgtctgtcagtgtgtttttctgctggtgtgttccactcaatgtccagctgcctgtgtctgtgtgcctcctcgtgtctcggggtttttataggcacaggatggggggagcatggtgggtcagagtggtcttggaaaatggaacattcggacgtgaaaataggagtgctgttctcacttaggtccgtgggccacaggcccgagggtagaaccctcaccggggacaatgcccttctctgccagcacttccctgcccttctcctgtatcattagtaaatatgaattaaacttatttactaatatcctaatatgtcttgtggaaataagctcagaggaaatatatattcatgattaagagtgttggaattaaatttcctggattcaaattttacttgaaccactttctggctcagttgtctcatttgtgcagtcatttgataaatagcattagcctcccaggattgatgtaagaatacataagttaccctattgaaaattagcggggtataggcattgtaagaactcagtgtttatttcagagccattgttagagatagaataaaactcacacttcttccatagggctctgaaaaagttagttcaaaacaaattttaaatttcttagctagctaattatttagattcctgattttctactctccaagtgaatctcctgcagaggccatgaaaaatcatagaggccatggaaaatcatctgtatagagctctatcagagaccatccatcctcttcagaaatctggcctctcagcttttcaactttattagaagaaatatttctattctttgtaagtttacttttaaggtatgccttcaatcaaactagtttacctccttcagcaccttgttccctcatgtatatgtttgtatgttgttgttgttatgctagattctccattctcctctacttaccagtttcctccatttgtaagcatgtatgagattcttctatactgaatatgctttggctcaattttcctgttctccctagttatcattctacttaaattctttctttcacaagtcagcctattttgaacaaatctgcacacacaaacaatgcatctgtttcctcatcaaatgcttacttccaacctgtgaaattacacttctgccttcaatgtgatctattgaaattatacttttatagatgactgtggagttctccaaattcaagtggcttctctacagttttctgtggagagaagataggatgagaggtggaatactgctgttgttaactgaacaggctggatagctaacttttcctttaataaaagaaagaaagaagtacaatttctgagttctttaaggtcaaacatggatttgactcatcccctgctgtatcctcatgaccttgtgcagtgcctaagactatggaggacactcaagaagtagttattgaatacagaggatgctgagtggcaaaattgagagtcttgtcttattttctccattttccttgtattccctgatgagaatgaggaagtcagagagtagtttaaagagataaaaaaatttaagacaacatcattgggcagaaaaagtgagaggactttgataaataaagatttatcttttatttttgtataatatgataaagaatacaagaaagaatattaataccttttacttatttttctacttactaaattttatagccttttccttttattaagaaatggaaataagttgagcataagaaaagaccatgtagcagataatattttataatatattttgtaagataaaacaaaaggtgctttaaattattagactatgtaatcaagcacacaagttattcattttgaaacagcaatggcttttttccttatccattaaatatgaatgttttcgtaattatttagaaaatctgtggggctaacgtactgtctatcatattgacagatgaagtcagaaacattcttaatccccaaatatgggttatataattagttttaaagaagattaatgcattcatctagctgttttgaatcagatgtaagggaatatggtatcatatacaattattattcagaatcataccatgatttaattttctttctttagaatgtgtgcttttaaataagatatactgctttacagtaaaaatatgcttttttgttaatttcatctccttcatttatttgaaataaatctgtatgcatgtctttttgtgcacatatatgcatgtctctataggatatattactagagatcaatttctggttaaaaaggcagaagtattttttactagaaatgtgaaatagctcattgaagttgatgcagccgctaacagcatattaaagtacttatttctcatttactttccaaaattaatatttttcttttttctttgtaattgagacaaagtctcgttctgtcacctagactggagtgcggctcactgcaacctccactaccccctggcgcatgccaccacaactggctaatttttttttgtatttttagtagaggcggggtttcaccatgttggccaggctgacctcgaactcctgagctcaggtgatccacccgcctcagctccacaaagtactgggattacaggcataagccactgcatccagcctatttttctttttaatgttagcaaatttcatgctagaaaacgtacattttgatttaatttccttaataactagattacacattttttcatatgttagataaacatttgaattttttcacaatgactagtttataatacttatgatattattgtctgttttagctacatatgcacaaacacatcctgtgtatatgtgtgcacatatcattttaagattataataagatatattaaggaactagtaaatgttaaaaaataaaatatttgaaagagacgtgtgcagcaaataaattgttacaatgaaattttttatttgcaagaggattatgaagtttcccaatttaatgaaataaaagtaattgttatattatctagtcagcctgtatggaatctatatcaaaaaacacttacgcaaacttagtatgttttctagctactcaaaacagtttgaaaacagtttgttctcatgtacagtgttagtcactacagttattaatatctttacattccaaacagtttttctcctttacatgcagagcattcactattcaaaatttttttttcccttttcttatttggaaaatcttggtactcatagaaaagaaaatatggaaagtttttttaaaaggctttgagttttgttattgaattaatttattgaaaaacattgggcatttctttgtttacattacctaaatcataacatcttatttgtttctaacagctaaaatcagtatgtgctgtcatatatcatacccctgtaaagtggccaaatttgtgttttaattaaataagacttttatgaattaattgttgcgatggtaaagtcatactgataataatctttacaccaaacaactaggacatgcgagcttcaaacttaggcaggttgcagtttagttgtggatgcacagcatgaacatattaatgagcactggccctttgcatttgcagttccttctgccaaaatgcccttcctctcagatctttcattgaatggctttttaatatcattcaggcttagtgtaaatactggcttcctatgcaaaagcctcactacctaatctaaaggatctcttcttctataaatcagtctccaagttttttgtttatttcacagcacaatcacaggtgaaatcatcttgattattcatttgttcactgatttgttcccatgtcctcaccaccttatattcccaccctaaatggtacttccgaagtggaaagataacttcttttaaatgtttcctataattttctattttatttctttggacagtgatttttaaaataatttatggagataatgtttgcaaatttttaagctgttttcacaggtagaataagcagctaatatgttcaagtttgatagtacatgtatttatattttaacagaaatatttctaaatcaacttcacatttcactttgaaatattttccaccaaatattttgagggctagttctgagatcttgtcctactctttgaaaatgtttagagtgaaacgaaactgtttttctaatctaaaaaacagagtgttttaaccaccacaaatcatcttataattatttaaaatgaaatcatataatggcaaatgttttccagcatgatatgttaaatggtgttacacaactcaaatacatgatagagattattctctggttgaaaaatgttaaaaatagtgttttttcaaggtaaagaagaagcctgttaccaccttgttgactattacttttccattgccttagaaaaaaatgtataattgtatccagttcttgtattctttgggaatgaaaatcattatgccaaagaatactttattccttccaaaatgtccttttctttcctgtggaatactgctacttaatggaaatctaggcaaacccagcaatttctaaatagtttgtaaagaatctgggatattctgtcaatagaaagatgaatagctatagaaagtcctcttataagttatatcttagtaaatgcctttctttttgtaatctcatatggaaaaccaaatgaaattttcacttttaaatttaatactcgagttttttatgtgtttttttctttattttgtggagattttttgattatatcgtggttaatattataaatataattttatttcccatttattttattgccaaaatatgacaaatatttattgtatcttaaaattgtgttttgtaaaatttgttttgctatatttaagagctctctcatttagccttttcatttaacctggtagactaatgtgggttttttcttatttggaaaagatgcattttgaaataatatttttgggtttagaagccctacatgcatgaaaatcagtttttagccacagcaaaaaatgtggagcatttatgcatcttgtagcagaaatttagcttttataattgaattattccaattttcacatcacaataactgttcacctatctaaattacaaagaaaatgactaagcttggaatgtgaaagaatacttaaagttcttacattatcatcacagatcttaatgtatcttctaaaatgacaataaaagagaagagtgaatttctttttctgtcaatcagtgatttgtgtgaaattcttgcctatataatgatgttgggcaatgcttgcaaaaaagtgtatttagaatcaattcacgttgaaataaactctggcaagggcacattcaggacacgagttcgtttttcctgggtcccatgtctatggcctcattataaggaaattttttaatttttttgtttaatacacacaaagatatacatacagacatacagcaactttcagaaacctgtatattatatggctccaagtatttaaaaaaatcaagaattatttgggctgcttgctcaagatatttcataattaggaagagatacatgtacatatttatgagaatactactcagattcccaaaactttcgaggacctgattgctgtctctctgggttatgtccttctttacttgagcattgtaaacttattcatggaaacatttaagtaaaaatcagatactcttctattgcagtagtggattttctattaactttgacaaatctcatcatttccttggtatgttggcaggaaaaacacagtcaagttgaaagaacctaaaatgattatctagttttggctctatttaaagagaggattgctgaaattaattctagatatttaaaacatttggatgttagttaatctgcagttgatatttgcaggggatcattgcatgtgttaactgctgcaaaaaaaaaaaaaaaaaaaagccagccccaaactcagtggcttcaaataataaacatgtattattacttgagtatacttatgcatcctgtcagggctgaattgtgtaggttgttctgcttatcttgactgaactctttcacacatttgggatttgctgcctgtagagtagtctggtagatttggctccatcacgtggactcttctccctgtcgtctctcatcctccgtcagacaaattaggagtcgctcacataggaatggcagggttccagagaggaaacagaacatgcagagtttcttgaggctgaggttcagaatgagcataccattatttctgccacattctcttggtcaaagcagtttgtctcagtttaaattcacagagtagggaaaaagcctaccctttgataagaagagctgcaaagtcccattgcaaaggttatgaatacagggaagggtaaaaaaatggactcattttgtctcaagtctatcaaagactaccatccctggtctcagttatacatgtctctcctaaaggaaaaaatatgcccaatccaaacccagaaattgaatccagttctaacatcatgttaattccagggtctcctatactacatgaagttctgatgtggcttctcagatgtaactccaaaaaggggaaaaacaggagctacctagcaatcaccgatcagtagtaattctgaaatcatgctagaaaaatgttaccaagtccctcatctacagaataggaaatgtttcttaaatcctgcctttgctccttgggagtaacttccctgtttattttttcacatggtacccttttgctctaccctctatgatgaccttcgtagtctatcactttcctgggccacttctgaagaaatgttctatttggcacctgattagttttcttagacttattctttcctatagaaagttgcagacaatttagttgatggctattttacctatgaaacttactgtaaaactttgtgtgttttctttaagtctggttatactctactctctgctgcaaaatccatactacaattattttcaagaatgcttctttgtacacacttaactactgctatttagggatttgacatttgtgggaccactctttaagatttctagaagcacccttcccctttcctttcccctgttgggcaccacttaattctttcagaggtgttaacaaagggttttacggccacagccttaatttgatcatagtctttaagcctcattttacatgatcttttgccaaatgggaagactataaggaaaaacaattttattttccaactcagcaatccttggcctctctatattccctctaaaatctgcttgcaaatgggtgagtgctgttttgattctctccttatcaatataccttatcacatgcaataaaaccaactgacattctgaatataatatctaaaaacttatcttaccatacttcataaatccattaggtatattatcttactttaaatttaccacaggcaacagttatttatttattttttttgagactgagtttctctcttgttgcctaggctggagtgcaatggcgcaatctcggctcaccataacctccatctcctgggttcaagcaattctcctgcctcagtctcctgagtagctgggattacaggcatgtgtcaccacgcatggctaattttttgtgtttttttagtagagtttctccatgttggtcaggctggtcttgaactcctgacctcaggtgatctgcctgccctggcctcctgaagtgctgcgattataggcgtgagccaccgcacctggccacaacagttttacatttgctgctgcataacacaggtcaccattcttccagcacacatgatcatttcattattcagcctttgataatagttcacttatcgtctttttagcttttgcatcaattatcagcctttgcttactacctgatcctagagccagtgccacatattttaggtttgtgttacatattattgtacttgtagacacagtctttcatcaactagctgttgttgtagatcaaaccactcccaacccagtggcctagaacaacgtgcatgtattactgctcacaagtctaagggtgaggtggacagtcctgcaggtctacactgggctcaactgatctcagccaattttctgatgacttgccagtgcctcctaaggagtaaggctgtcaaactattctgttcatttcctaaacccacctgggaggtgtgagctgttaagtaaaaatggaatatggaattcctggggtagattctctgtgttgactgtcctagctgctgtcttacatagctggttctgtgtcctgtgagcttatacctgaatagctccagtgatctgcctcagagtaatggctgatgggcacagtgctctagtagcctctctatatagccttagaccaaagaaatatattaaacacaaatttctgaaaatactttgttgataaatggattagatatccaagcaatgaaacataaaatagaaaagcatttccttccccaaaactctataaacaactcccacaatgagtttatgacaatgcttgaaactaaaagtaaaactcaagagtgaaggcgttgtatagaattaaaatctgtgactgaaaaaggtcaaggcatttatatttttaagctttagaaagagttggtcctcttaatgtttaggaaatgggcaataccattatgaaataaatatttaaagaagattggcctggtagtaataggtagattcaaatggaagaaatacatacaaatatgtcaaacatatgagaatattagttcacgtagaacttaatcaaagtatacttaaactataacatctcattgatttattccttaattcattcaacaaatattcattgaatgtataaattgttgggcactgttcacaggatgagagatataatataaattaaaattaacatcgctttcaaataattttcagtctacagggagaagtacgtaataaatctctaaaacaaatatggtacgtaaaatatggtgaagctatttataaatcagcatttcagatcataataaagtattgttaaagtttattcttaggaaaaagatattttccctagagtttaaaaattctttaaagtgtaagttaattataaatagaactagtttacttcttttcacataaaatatgggaactgaaaattggacaattaactttgtgtaaagtgataaagttaaaagtttatttttttgcttagaactgaaagacaaatgctaaaaagtattcattattattaacttgaacatgtagtgcagatgtaatgtcacctttgtactaaaccagaatagatagttaaaatctaaatacagatctccttttaagtgttttggaattatacaagaatttctgagtagggaatgggaaaatattaaaaatctctgtgttgggaagacagtcattttaccttatactatattttaatttcctagtgctagaattttatggatctaactatgcatttataatttgtttccttctttattctccaattttctcttttcttgtttttctctctttactttatgtaatcttccctccttttttcactttttgttttatatttaccccttcatcggttttatttcctattcagtttgctttgacccttgtttcctctttatcaactttgtctttcctcccgtctcatgccatccttctcaccacaaaaggttctgtcagcagtgttattattttttgaatacagtgatgacatcctacttttatgttcattctgaattaataaaatatgtagtaactgttagtgcaaacaattgtgacctgactggaagaaaacgaaaatccttgaggatgttttcacacacaataaatgcatactaattaagctagtatgaagctttacattcagagaaaaataagattcataataaatgtttggatgaatattgagaattttgatgccttttttattttaaaatattcttttcaaataccctaacataaatcaaaaataatcaaattaataaatcacaataatttaaaagatgcattacctttttatatggtgcattttacccctatgcaagaactattttaatcaataggcaagattattcaggtgagttcaacaaatttgaattcctactgtgtatgacaaactagactaggaaacaagagtatgttgttggatataatagttaaaatcctttcattttcctttcttgatggaggagttcagagaagggataggtcagccttgatggacacaatgaaggtagattgggtgtgcttttgccagaagaagaaaactaaagggaatgagagaaacagaaaaaagaggaagagaaggtaacaataatttaagaagtttgtattgtgcaattaaaaaaaaacattggttgcatgtataggcactgagtggaagataaattagactttatctacaataatttgttaatctaacatttattaatcccctcctattaactgggcactgtgctagaaatataatgatacagaaaggaatacaatatgggccctgctctgaaatgattttacaatttagtagggggagatagatgtgtccataaattagtttaatcaaatatataaacagaaaagtaaggcacaatggaggtgttggtcttttctttctcagtcaagaatattaggaaatacctttcatgctgggtgttaatgaggatagcaaaatatttattggacatttactactttacaaacactttgctagactctgtagagacttaatctcctttgttcctcataataactctaggaagaaggagctttttatgccacttaatacagattaagaaagtgaggctcacagcagttgtgacgacgcatatttaatatgtagaataatcaggatttgaatctaagtccattttacttttaagagactgctatttctactaccctatttcgggagtgtgagcttgatttgacagttctttgaaaatgttatggctgctatgcttaaaacaaattggaggtgtacatctttttgggaaaaaaagacaattatattctagtcaagaaatactgaagttctctgctaagtagattggaaagaaaggatgaagacaggaataaatgtggagagagaatctaaggttaagaaggagaggatttagagaatgactaatcaagttttaacaaaatctaagcagttttaaaatataaaggttgacttaatggagttacagagaaaagcagggggaaataattggtctctttccattccttctatcagctatttgttcatgactttatcattccttggcaggactatgacaataacctgctactcattccttatactgacaccagaattgagtttctacagcatcctctgaataataaccttaatggctctcctttatctgtacaataatatctaaaattcttatcctcggatataaaggtgttaatcttgtcactctgtggtacattttatatgagttctccagtaacatattccaattcactaaatttttctctgactatgtcctctctggaatgtacctcatcttttactttttcatttcaatcacagatttttctttttttaacttttattttagattcaagagtccatgtgcaggtttgttgtttaggtaaattgtgtgaaactggggtttggtgtacagattattttgtcacccaagtagtaaggatagtacatgataggtagttttttgatcctcaccctcctcccactgtccaccctcaagtgggccctagtgtccttgtgttccttccttgtgctcatatatactcagtgttgaactcacacttataagtgatagcatgtagtatttgattttcttttcctgtgtgtgtttgcctaggataatggccttcagctccatccatatttctgcaaaagacatgctttcattctttttcatggctgcatagtattccatggtgtgtatatataacactgtttaaaaaatccagtgtagtgttggtggttaggctgattaaacgtctctgctattgtgaatagtgctgcagtgaacatatgcatagttgtgtctttatggtagaatgatttatgtacctagtaataagattgcttgattgaacagtagtttggttttcagttacggaattgccacactgctttccacaatgattggaacaatttacactcccagcaacagtgtgtaagaattcccttttctcagcaaccttgccagcatctgttactttttggctttttagtaatagctgtaatgtcaggattttctatctttagaatttctgcttggcttattttagtaccctccatttctctttaatttctgctcattttgtttcatatattctcgttttgtcattaagggatagtagtacctcctttcttttcttttcttatgagaattttaaacagtaattttaaagacgttttcagattgctcctttttcactttgtaataaatttgtttcttgtaattggcagtcttctttggtattagtttttccttgtatcattttagaaattttgtgaatttgtgcatctacggtgattgttgtgtttatttgtttttatcttgatgaactaacaactctgtgattgcctcaacatggactttaagccacctgatgtagaaccatgtcttaaactggtggctctgggagtagtcccattgataattgtgttgatgttttatctatggaaaccacacgaggggtggctggacctacaccttagattcaagctacatctgtgttggattcctcctttctctttggcatacggttttatattatcctaattagcacgactttcagtgttgttctaaccccttgcatgggaagatcagtcctatccacctggcccacgatttgaagcaaggagcttaactacagtcccccacctgaggcaggggacgtttggtctcaattacactagcagagttgattctaggctatctctgcttgcttcagaacctggagcacttcagacctgtagtttcagttatgcttgctaccctgtgtctttgtttcttctctgatccctgaagtatctcagttgttctttaggtgccctctgtactttgacattatagtcgtccaccaaggttctatgatccccagtgatactgaaatcagctgatgttcaagtccctgatataaaatggtttaatagttgggtgtaacttacacacatccttccacatcctcctgtatactttaaatcatctctagattactcatatacctaaaaaatgtaaatacaaatataaatagctatactgtatcttaaaattcatgttatttttattgttgtattgctattttttattttttgaaatttatttttgaatattttgctttacagtttgttggatctgcagatgtgaaacccactgatacgggaggatcaactgtatatatgtggggtgtgtttgtgtatgtgtgagagagagattcaaatatggctgtatatttggaatgaagatgggcttccaataaaagttttacaacaaaattcttagaggactagtaaaactgagttccaatacagactagaatttcattccagctaccctctctcaggtatctgttatcctaactcttccgaggaacagagattttccctgagtgctttacgtacttctatattctatgcctctgcccattctgcttcttccaccaaaacacctccttccgttctctgttgaagacatcgttctttaagattcatcccaaaagccactttctatgggacatttatcttgtttcttcccattcctttctgcgtgtttttagagtcttttgcgcatgcttttagtttatcacgtcccatatatccataaatggatatttaagtatttgctgtccaataatatggttattgtgtaagttatggatcacattctgatcatctttgaaactctggtgcatagtatagtgtttgtcccattgtaagtatctaggaaatgttcaataaataaatatgtaattattaagtgaattaaatcagaatcatgcctttagtaacagtatatcaatttaggacaacaaaaaatacataaaagattgtagaaggtggcaatacaatgtaatatttatttgttttacaaatattcatctaaaacaaagcacagctgaaaaaataccagtactgaatggtttctacacaataataaacaaaaatttgcttgtcttctaagagaaatatttcaatgttactttggataagtgctgttttccactgttatgtgtaacttgatggctagcaggaaaaagaaatatcaaagatggttgtgaggtcagaagcagccatatggataaatttgttggattgcctaagagtcggtgagcataatattaaaagctaaatgggcagtaaagactcaaaagccaaggttttagcaattttaagaagcattaaccagaaacatgaagggaagtaggacaagaggaataagaaatctgacctaatgattagtcaacaaatgccttgggctcttagaactttaagatatttagtgaaatatttctgaacaccaatgcagcaaagctttgttttggtaggatgcagtaacgctggtatacagactgggcagcaagtaagcaaaacacaagccaaaaaatttagtcccacagaagtacactgcaggtaagttgttggtggaatgggcatgaacaccagcaaaccatgtataagtgaataaataactgtgtcttgaatagctgcttgccccaacactttgtgtactttattggattctcatgattctaaggtaaatattgtctcatttcccaaatggagaatgttagaaagattaagtggcttagccaagccctgcagcctccaagtagcagggacaggatataaactcttattttctggctccagaccagatcttttggttattctgtcttatactttctagaaagaagcttgatgtttcctgtgcaggaggctaaaatgacatgatagggatagaaataaatgggaaattgctgactgtagtgaaggtcagtgcctgattctcaaaattgaacttaaataactctcttaaggacttattccaaaattttactagtcggactgccaagaactacagggtggagaagctggaaacattctatatcctaatcacttaatgtagccaaatattttggaccagattagagttgtcaaatattttatcatttttactgctgtggattggatttcattcaagttattcacattctttttaaaataagggtttcactgctaatgaaattttaggagaggcctcaactatgttcttattgaaagattaatgtctctcatgtaaagaaacattcagagtttaaaattttggtgattatcaatttcccctaaaatgaaactgttttttttttttttgctctcataatctgataacacttttgacatatgtgaagaggatatggggtaatggcccttgtgtgttggaaggcactttaaagaccacctaatcatacacccattgctcatagctaaaaatgaggtttcacttagcagaggttaagtagtttgttaaaggttatataatttgttgataacagaatggcagccagattgcattatttgtccagtgttttttcaatgcagagggacaattatgggttagattttcttatttgtcttccctcaagagtttatttataggtatctttgattgccctatgactgaagtattttgtgatgggagatgtctatgaatgagataatcaaaaaggggcaggcgctccatttctcaggcagtgcgtattatgagaattcagtagtgcagacaaaagaaatggttagcgccaagctgccttattgggtattcatttggtaacactatgtagaaaataatgatcatttttttcctaaagagattgtaccatctacatccccttggatccacagtggaacttcctacatattgtgaatacttgtcttggaagctgatgtatgtaagatgtgtgtttttctagttacttgcatcataaatactttatattctgtatttaatactgaattatagctgtctacattatttttaagtatatgaaaaggggaaagtcttaacaaggcaaaaatattcctatttatagtaatgggaggtaaattaccttctaacaatttcagttttttcaagataggaacgcatatcctcaaaagccaaacaatggcatcgttatctttgttagtattattatttatttattcaaaaagcatttgttgaacacctggtgtggctgctgctgaaaatgcaagactaacctggcattttccttgccctcatcagcctccctggactcacctcctgcttcagtcaccagggccttctttcagagcctccaaatgctgggcctcctgcatctgatggtatttgcacatctcttctgcctcttccactgtctcctcaccctggctaactcctgcttctttttgacttagcaggaagacgttcctgatcccctgatctcactgtgctgtgctatcatgatttaagcttagtctacaatgcaatgtttgtttgttcacttgtttaattctgagttacagaaagaatctgtctctgtattacttgccatcattttcccttgaccctggacctaacaggtactcaaacaatattcgttgaatgaatgaatgtcctcttgagacctatcaggatatttggggatacagttagcttacaaattaattatattatagtttgaaaaatatggggatatgaataagaaaaaaataacatttaggaggagtggggggtagttgaggaaagcttctcaacggagatgacacctaatgctgtgtcttgaaggatgcccaggaacctgccagatagggagtgggaatgagcagcacgcatttctattgagggaaaagcaaaagtaaaggcaggaaaattgaaagaatatagcatatttaactgaaaatactgcttttgtattagcattactaaagtcaatactgtactgtcatcttatatatagaactttaacaacacctcttcaatatgaaaggatttatgcacccatgatgctgggagaacagattaatatcttcctagcttgcaaagcaatttcctctctgtggggttgttctgaaaagttcaccttaaaaaaataccaagtagggagcaggtgagaaatttcacagcttaatgaaaaggtggcacataagaaaaatttctgtaatattattttaaaataagtttctcttcttctttctgtttaattaaagcagaaattttagtgttgtctcatcatatggaaggcattcatgttttggaaaaatatccattttagatgtgaggaataaacgaggcaaaaatcaaacttccatcagagatcttcccttgacaaagggagactcattggcctccctgcctgctcccaccaccctgcgctataagataatgattgccaagtcattgtgtaatgtaactcatcgtgcaaatggggtatctatggagatcagtttatgtttggctttgtggtatggctgctgctttcattataatcctaatagatgcacgtaatatttacaattttattatgatctctttggttacacagtttatttttattcaacatactacttcccttctgtgttcccccttggttggcttgggagattgagacatttttcatcatgttttctagttaacatttattgagcagctactataaatatgatgttggtgcttgtcataattacctcatttattttcacagtaactgatgtggtagtccctgttttacagttttcaccatagctctatacttccaagtggctattaaaaaacagtgctcatttcccacattgtattctgcattgttcctagattataatacaaatgatttacattattgagcactcattaatggcaggaactgttccaaatgttccacatatattatttatttaatcctccctataatggtatgatgtctagactataattagcaatttagatgaggaaactgggacacaaaggatttaaataactttctcaagatcacaaagctaataatagagctggatttaaatccagaatccattaaaccatactgccttttatgatattgtgttgtggtgggtatcaaatgtatggagtgtggataaaagaagagagatcagttgaaagaagggatgatttgtttacagtgggggtgaattaaatgtggttgggcagagagctctgtgaagcagactcattgtgcacagttaccagcttgtctgggtctggtgagacaaaacatgcttacatgcaacaagttgcatgaagcaggtttattacttacagatagatagtagggaaaacaggagcctaagacccattgtgggccagtcttccaaggtttaggagagttgcccaggcatggatggtatcactaatgggggcatcccactggcatcacagctgggggattcagggaagcagcctgccctggattttataccccagggtcataggacatattgggctaaagtgttgaaggaatctctgtttctaggggagactagagcagagcttgatctgttctaccttgtcccttcttagctcaagatgctgcatttacagcacatgctatagttgttcttgagacctacaagcaggaaagaggggagaaccgggttggtgcaaggccatccatagaattgtcctgcaacctctatgctactttcagtaggatagtaacaagtgctttcaattcctcacattctgtgtcttcttaaagccatgtgttacttggcctgtccacaagactctctctccctcttattcgtcccgaagaaacaaataaatacctcattcatttaatcaacaaatgaacattgaaccgtcattgtgtccttagcatgatgctaggctttgaagatagaggaatgaacaaatgaatgtacctctgaactagggttttaattgaagaaaaagataaacaccctgtatctcttatctttctattaccccacctgtacataatctgaggatgggcatttatttatctgactccaccactgtgaagattcttgagggctgaacctataacttattcatcctgctatctccagcacttagcaaaatctcagaaaatagttaagtgctctatagacatttgttgattgaaggaaagaagaaaacaaagaatgaaggaacaacgcaaataacatgttaagattccgcagaacacaaacacatttaagtactattaccttgactcaaatttttcattcagctttcttaaattaatggagcatgccacgtactgtgacagcattgtcagtgctcttatgcatttcattaggagcatagtggagggaattttccatttttacaaaactatatattatttgcccttagcttttttattttcctgtttttctagtttaaatcatattaagctgtagacagctaattttattgatgttatttaagatattatttctgaatattgtgtcctttagcttctaggctaattttctcaaaaaatcttctcttaatgaataggtcatcttcatattagttcactttctaagcagtgccattgcccgaaaacgtggtctaccttatgatatgaattaaactgagaagattaaacatttatattcttatctgtttttcacccatattcattaatttcctgaaatttccacatattctttatgtgcaacatcagcattgattcttaggcattaaatgcctaagaacaaaagtcatgtcttaagccatttcatacaaaagcttgcatgaggttatagtggtcccacacaatagttttaatggggacaattttgttctgagctacttttatgtcattttatataatattccagatactggatagggacataattagtttagagtcaaagttatataagttagatatgtatttttattttatccattatatatttttattgtatctattatgcctcatatttctgatagttataaatgttgtttctaattgcttttattttgtctagtatttctactggaaagattggtcttactgatttctataggtaatttacatacgagaaaatgctttgtaaataattacatgatctgcaagtattattgctgagttcctagtaaataaatgaggaatttttgtttgcttgtttctaaattcagtcatatataaaatatatagtaatgactatgttatgcttggttttaatgtgttatttcaggaaactttctcaagttctctgggattactggctatcattatgagaactattgcagaaatgaaatgatgatccccacaggctggtctgtagagcaagtcaaacctggataagagtcctgaatctgcctttcacaaactgtgagacaagccttgatgtcaccatactctgttctgaggaaatggcagagataaccagaattatagatttttaggagatctttattaacttcttgatgattatcaggatcatacaaataggcagtaacatatttcaaacctaaatcagaggagcaaattttgtgccttaatatctttttctttagaatgagaataacaacagtatctatctcattgggtttttataaacataggagttaatatttatatctacctcattgagtgattatgaaaattaaatgagttaacatttataaaacacacagaacagtgctagcatatagtaaccccttgcataaatacctactaaataaattaaatataatgtttaaattataaagatttgttatttacataaatttgaagaacatttattaaaaaataatttttaccaaacattaactgtacaaaaactggattattgccaaaattctggctttttcatctgaattcaaattaatctatttccaagtagactaacctcaaagacagaggaacccaaccattttctcactggaggaggaaatagaagatagactagaaaagtgaatcagctgttactgtccaatgtgataattgctttgataagggaacccacggggtgctattagagagatcagaatggctccaagcatgatagccagggggtttcacaggagacatctgagctgagttcggatgaagacttgaagtgtggctcttcaggaaagggaagagcatgtggaatgcacagtttgaaaatgacctacacatggaactatgagcagagttctagcatcaggcaggtgttgcagctgtagctgtggaaatgcaatagaagccgaggctcagagataatattgtaccaagattctccccttaaggagaatgtcgtgatcagacagggattttaaaaagatcaccaggattgcattaaaactttagaaaaaaattcgtgctgaataaattatcctttcacttggcgtaatcaacatagatttagctaagtaaaatgaatgaatatttaaatttaaattgaatttaaatttaatgtatgtgtgtatgtgtgtgtgtgtgtgtgtgtgtgtgtgtgtgtgaagtaggtttactttttatttttgtaaaagggagaatgacaccatttttatggaataaaactaccaaataaacttgtatggatgtcacacatgaaactcaacagttctaagaggaagacaattcatatatggacattgctttccaaatgtgctatttcatcctctataataatggcaatcactgttgcacttttaaagaaaaaaactacacacacaaaaaaatctttttttaggccaggcacagtggctcacagctgtaatcccagcactttgggaggctgaggtgggcggactgcctgaggtgaggagttcgacaccagcccggccaacgtggtgaaagtctctaataaaaatacaaaaattagctggatgtggtggcacaggcctgtgatctcagctactcgggaggctgaggcatgagaatcgcttgaatccaggaggcagaggtcacagtgagctgagatggcaccactgcactccagtcagggcgacagaaactccatctcaaaaaaaaaaaatcgtttttagagacagcgttctgtcactgaggctggaatgcagtggtatgatcatagctcactgcagccttgaccttctgggctcaagcaatcttcctacctcagcctacagctgtgactaaagtagagaccatcatacatggctaatttctttcatttttgttgttttttggtagagacaaggtctttctatgttgcccaggctgatatggaacccaggcctgaagtaattctcccaaagcattgaggttacaggcgtgagccactgtcccctgccatatatatatatatatatatatatatatatatatacacacacacacacacacacacacacacacacgtatacatatatatatacacgtatatatgtatatatacacacatatatgtatatatatgtgtgtgtttatatatatgtatatatgtatagatatatgtgtgtgtatatatgtatatatgtgtatatatatgtgtgtgtatatatatatattttgaaagccctctccatgaagtatgtgtccagtatattaagtcatcctcttctaagtaggttccagtaactcctcccttttgccagcacagaacttagaacacagaaccttttaataattttgagttgaattatttctgttgttcaattatacctacacagctaatatgtggagacatttatttacttcaagattctattattgatgaatactgtcttttaattttaaggccaaactttttttcactattgtttcagcttaatgaatgagtgcctccagcacttgcattgtcactcagtattcttttcatccacctcagcccttttttatggtagctttatgagccaccaaatactcagaaatatggtcatcctttggtatatgctagagagttgccaggacccttgcatataccaaaatttgcacatactcaagtccctcagttggccctccatatagacaaattttgtatcctacaaatactacactttcaatccttgtttggttgaaaacaaaagcccatgtatacttgagcccagcagttcaaacctgtgtaaattgaatatccattatggtcactctatgaaaactcttaagtgaattctttgtaaggctttggagggattttgagaaaggaatttcatatatgggagtatcattggtttgcttttgcctggtcaattcatatgaccagtgcaaaaagtaaaaattacttaggataatgtgattttagtcaacatctatgtcttgtttttaataacgtaagttatacttacttattgcaaaaaacgcaaacaatatagcattgtgaaaagtaaaatctatcccaaatcttagtccacatgccctaagatgggtttacatatttgtctacatactgtttttttcataacaaacatattccgtacatctaggaattgtataggaacaaataacctattttatttatggatttaacaatttgagttcctttttcacctcttttttaaaaatttttatttttatcttaagttctagggtacatgcactctaaatctatatgtcagattactattactaatatattatttctgaaattgcccacaaatatgtcataaaatatagagctttctctgttttgaagtttgctgagaggtttacttctagggcatctatgaaaaatatatattagttttttaaagttttctaaaggagcttcattgaaattaagataaacatacaacaggtgtttcaaaaattaagaagataatttgcatagcatgtgaatatgcaacacaaaataattcctttttttttctatgaagcctggaataattatttgatataaatcaaagagtttatgatgctagtggggaaatggtccaggtgaaataagattacagtgcaatagaaaagctataataaaaactgttagtactgtcatcaaggtctgtgaaggatcaaaagtgtattgagcatcatgtaacagctgtctagaatatgaaggaaaccatagttgtggtgagcagggaacaatatcttggtttgcaaaaaaaaattacatatggcttgttattgttaaattaaaaatggtaactataaaatgattggactgtaaaaaatactctgaaccttgggcttcagaatatggctacgtgttaactaaatgcataactattctctattatggatatatgtggttgcatttatgtaaacttatttaaattaatgtggtatataagatataggtatttctctgttaaagctgttaactgaactctttaaaattctctattaaaactcttaactgaattctttgtaaagctttggaaggattttgagaaaggaaattcatatatgggagtatcgttggtttgcttttgcctagtcaattcatatgaccagtgcaaaatgtaaaaatggttggactgaacacttaaagcatatgtatatgtttgtcagatatctactatccttattgtgcataaataattgtaaaacattactctttgactcttcactaattccttccacattaaagaagagaaagcaatgtataactttcagaacttacagaaagatagaccatatttgtacatggatagcctattttgtcacggaaatttgctgccttaccctggaacatgagaaatattttgttgccatctcattagataacaattgagaaagggaagggagataggctgtacagaatagctagagataatgtgtggagcaggaataaaggaaagcgtcttttgtcacatatattctcatacttaccagttgcatccttcagatacttttcaaacatatgcaaccataataaggatcaattacatttttagctagaatgtagccattttcaaaagtagaagcttcacagtacattgtgttgtccaacctgtcatttttaatttaattattttagaagaatattttttacatcataccattaccatggggaaacaaccaaaagcctcaagaagaaaggattccatatacagtacactgtaaataatattggaccactgatgagattgacatgtatttttgttgtttgatttcctgaagtacagtgactgagaaatgtttcttaaacgcgtatgagcacttatatatgtgcccgctaataggatacgcactgagaaccaaagatgaattatagtcttttgttttatttattaatttgagatggagtattgctctgtcgcccaggctggagtgcagtggcataatctcagctcattgcaacctccgcctcccaggttcaagtgattctcctgcctcagcctcccgagtagctgggattacaggtgcgtgccaccacgcctggctaatttttttgaatttttagtagagatggggtttcaccgtgttagccagggtggtctctatctcctgaccacgtgatccgcccgccgtggcctcccacagtgctaggattacaggtgtgagtcaccgtgcctggccaaattatactctttgtcctggatgaacccataatctatcttcattctatctatctattatactaatctctacatggtcaaaacctacctgttcctcaactttcagcataagtttctctatctaagaaggcgtctctggttctcctgagaggaaaataacttttccttcttctgaaatcccgtatggagaaaatgaacccttaaagcatatgtatatgtttgtcagatgtctactatgtttaatgtacataaataattataaaacattatacattgactcttcactaattccttccacattaaagaagagaaagcaatatataagtttcagaatatattgaagattgtagagaatacctgttaagttactaaagaaatgcatataagggtataatctttaaaaattatcgcaacaatttgatgtacaagttatccccatttgcaaatgagaaaagtcatgtcagagagtttaagtcctttgcctaatgtgttaaaaccagtaaagtgaagtcaaaaattaaatatgggcaatcaagcaccagcacttgtactcttaacctcaatgctacgctttctgagttaatacacttaaaggccttggatgagcaagcacatttgagcacttaatattagtatacacgaaagtctgggtccatgcatatatgctatgtacatacatagctacatacatatatgctatgtattatctgactgacttatgctaaatatagacattctataaagcatcctgtcctaggtacatggcttatcactattttcctcattactacaagacagaggaaactctgatcttcttgaatcttgccatcttcctcaatccctttaagtacatactctcaatccccaccatctttaaggtgaataaagaatggcttcctaggagagtgtcgccaacaagcccgtccctccaggacataaagcagagcttttatctatggtattctctggttttcttgattaaagtgtacctcacttgtagctgcaggtgacagggatcaaattatatcagctattttagtgccaacatatctactgggcaggaaaacatttaatgaatgcttttacgtatttttttctggtattcattgtctttactgttactgtttctgtattattgatatataaaaactggtgaatagctaatatttaattacttctaatagttgtaattaataacttattttttgttcagttttaagaattcagtttataaaccatgatcttatgctccataaataaatttctaacagagagtagtcagaattgggacacttttccttcatgctgcaacctacagtaatttcattcaatcccataattttcagcataattatcagtacattcgtttagcaacaaaaaaaaaacacacaccactaacaacaacaaaaaaaatccaaaaaacaaaaaacattttcttttggccttttggtcattgttgtttagtgttactatttaaatcttttcatttttatatcgtttatatttccaataagtgagagccccagtagattcagaaattattaagtactgacgctactttcttcatatgggctctgttctcttttcattcctggttataactgtctgtacctgtattcatgatgtgtgtattttcttccaatgactcctttgcagttattaatgtatacaatttccatcacgtctttcgtattccaccactgtataccaaaagcctattttttaatctttttcttctttatccagatatcttccagggtaagaaagcgaaacaaatacgtttaagagcaacagtctttaatagtcataagtatatttttcgtgtatagtaaaataggacaagctttgtttaaaattttataaaaggtgatatgtactaagtttttatgaagatattttatttgcttgtgagacagcacaaagtacttgattggggttgtggtttcttatgctattgaggattttgtagcatatttaatttttaataagaatatgctaataaaagtatgtttccagcacaaacagctaaatcacagttgcttaaaattgtaataaaactagcttcctaataatagcatatgaattagaagaaaataaatgttacagactagaataggcaatggattgagttagaaaagcttgccataaactctgaggaagatttaggacaagtcactttccttctctgagtcatagtgcctcaatgactactaaggttgggtaagccttcaaaactatgtgatactgtaaaactccaaccttttcatctggacttgagaagcctcttgaggagacagtcaagactacctttcactttttttttcctaaactaaaattggactccaggagagataatactgtagtctttttctagctgtgacttcttaactgcttttttctcagtcttcaaattactctggcaaggaggcactgatgtcatcaagagatggggtcactagaacaccaccttttaaaattctaacctgtttttgtacgtagatgggatagtcctgggtgtaagatactaaatgtgttttagttatttcctccactgccttggccactggtcttttatgcttacgggagatgactggagcctcatctatgaggtggagatagaggtagtcttataaatttttaggaatctgttatggatgaagataaataatgtgtatggaatttaatgtaagtcccttcatttaattcaaaatatgcaaaaagtataaactatacattttaaagctattatatggtaaaaccaataatcccctgacatagacgtcagaaaatacttacaggaaagttctcaactgtgttttattcccagcttcctggttattatcatccaacaaataattttgagcatcagttgtgtgaattgtgttctgttctaaatttgcttctcttgaattgttttgaagcacccatgtgcaaaaggaaatttctagtagataaatagctatttaaaattatgtttggcattaacttgtaaatacaaataaatatcaaaagcctcaaaacatgaacatcacaggtgtggttaaaaggcaaatggtgcacagcattaaaaattcagttattttcattgatgttatcatagctgccagctcagtataatagaggctgagccaagatgcatatttaagaatattcaaagttagttccagatagccctaagctattaagaacctgtggtgtaatcagaaaagcagagtcagaagtacataggaagggctgttaatggattattaagagaagcacagaggtataaataggcagataattattggaagctgaggatggcttttgactgttttgactgcttaatggatcagaacatggagttagtcctatcatgttttaaagataccagccatctttcttgtctcctttattatgatagggtctggaagcaaaggataaaagttgtggaactcatacatgtatgacacttccaactttgatttctttattcacatttcttttcaacctgatagttgattctgctcagttttcagtagacatgttgcaccactgaggaagatattaaattatgtattttcctacactggtgcttatagggtagggaaacaaggttttgaatccatctgatacatgtaaattaggtagactttccaaatgatgatgtagaacattaaatatctaaggaaatgcaatgttaatattaggaaaatattttaatttttaatgtgaatactttcttgcttaatgccattatatatagattaacgtatatttacatagcctgatgaaaccatgctgactcaattaaaccaaactctagcaaagctaagacaatgcaatgtgagttttaagggtttcagatagctttgtgtgtatgtgtttttttattattattttttatctgagaaagaaattaattcagccatttaaactcattgactagaaaattctttaacaagcataggttacaattccaaatgctgtggatggttaccaataaaagaagcaggcatctgttctcagatgtgtgaagaatgaaatgccgcttgtttcattactcactataatatttttggtgtcatactatggagtcaaactgtctagcctcacggatatttgggaagaggaatcatgtttctctttctctagagaaatatcatggataaatatatctttaatagtttttggcctttaagtaacagtacttaagttttcatacatttttatgttcatgtcaaattataaaaaattaacattgattaagtattctatattttgctcttcgacaaattcattgttatgctttgtattaaatatgaaaatttaaaaagtgtatgcctagtgaaaactctaagttgttttcttgtagtttaaaaaaatcaaatatacttctttatgtataacaactatttgggggaaaatgtatgacataattgtttctctgaattaatttttgctgcttatgcatttaaaaataaactgcactataacagagtaactttgaaaggtaaaaggggaattaaatgactaaagatgaaaacaagtgtaatttaaatgttacttttaaggagaaatttatgtggaactgtggtttacgataattgttgacatattcccctaagtactgtgtctgtgatttttcatggtatcaatcatttaaagcaatttaggtaataacattctgacatgcatttctgctattttatttacaccatttgcctatatcattgtaatgcagtacctttctgatttggtgcagtaaatgcactctgtaatatctattatggcatggtcaaaggataatttattgtcaaatagaaaaataggtcaacactaatgtcacttgatgatcaacccccaccgctcaaagtttaataaaacatctcaccagtatgcattccagtgcagtggttgatattttattaggactacctggctatagcagtagtgtaattactgagctgtcagagtgataagtgggattaatggcagcctgatgcactttagtctgcagagcgcttagagaattgcaagatggtattattatcagagtctgcccattctggcatattcatgacaccaaaggaaaaaggaatgctacaattcaggtttgcgtggccctgcctcattaacatctgacattttcaacagctgttatttgtgaactagctcaataataaaaggagaattatttggtaaagaggcttaataaccacaactaaaaatccttacattgtcaatactgttaagtgaatctgtttatgttgaatataagatttctctggaagaacagaaaaatacactgcacattaatttggttcccttatatctgctgacattataactttattttttaattgtgttattattcaagttgggtgttagaaaaaagaaaagcagaaaacttgtgacttcatagagataaccagaatccatatgatgtgccatatatgtgtgtgtgtgcgcttacttttgtgtgatggcagatatttttacaactgtttaaaagactttttttcaacaataaggtgacatttaagttggcatattatttactttttagctattttgtattgcgacataaaagaaaatcctttcaaaccactattaatgctcagtatatttatccacatgacagttacacatataaatatcacctcattttaacatcaaggaccaaataggccatacattatggagctttttgtattgtttgcaatgtatgctgcagattatacttcgaagaaattatttttgaactcaacaatagtgtttcggggaaaaaacgttaagtatgagcagacaggaattcaactaaatgatagatgtgaatctaacaatggcatttagagaaatgatagggaagaggtttaatgactacatttcagagaggacaattgattatgaaaagcctttggtactcattgtgtaaaatttaatttagagagaaggctaagggcacaaaccagagaaaagagatcagatttaaaaacaagatattaattaggcactgagaaattggttcagacaatgaagagggctctcttactcacaaaagaatgacaaggagactggtattgttttcatgaaggaaatgaaccaaggtctttacacatggaagtgtatagaaaatgaactagctagtcacctttgtcactgagcaatgtaggattcatgctcagtgaaattcttggagaatgctgtttttctgacacatgtggcagtagtatattttctttagttgtctgtctccacattcatttctttctactcccactctcactttatgctagaccaaattcattagttcacctaccttgtcacgttcttttctttccaggcactggtgcatactctttctattcttgggtaattatcctgagtgaccctgcactcagaatcccactgtcatttgctttcctaatgtccactcgttcttcaagcttctatttcaatattattcctcccaagaagcctgtcctgacaacctccctccaggactactgtctttcatctgtgctcccttagcatgctatatttcacccagattctcattgaccacattgaccagtgtgtggctttttctgtgtctgtacttcattcaaactgcatgttctatgatggcaggaccatggtgatctttttccaacacttttatattctcatatcccagggtctgctatgtaatggaggattattaaatatgtattaaataaatgaataaatgaagaaaaacacacataagttaatgtgcaaataaaggatgagtctggccattggttttagttgtcctgaatgaataattatagaatgttgttctaacaatgtgcttccaactatgaacactagaatcacttcagaggcccttttcaaaatgcggattcccaggtcagtaacttggactcagtaggggctcctctgtgaagtctgtgccatttatcaagcttcccaggtggttcttaggtgcaacaaagtttgaatacatctctggccagtcccccggagaggagagtcagatgagattaatatgcaggaagtttatatgcaggttaacatctgtagaagagtgaaggaagtgggactgagcaaatagtcacaataaatgcttcaatggctccttgcagactagttccccaaatatgggaatgggcagagagcctccaaccccgctcactgaccttgaattgtatgtgtgctgctactggaaaggaggctgaccttgttggagcccattctcttcagcagcagagggaaggcagctgtgggaataaagctttggtcctgaagggtatggatctgggctatgctttgaggcatctgttacagaactcaattgtcctgtgaatgggatggaggctgaaagacttcagacaattggaaagagagagagaggtagagagggaagctgggaggaaggaagagtggaagaaaggatatttcaagtggtaaaataagactttacctttaatctttgcatttgtttaataattttggtctaaaagaattacaaaccttatcataaaaaactgcatgcaagtattgtcagcatagtgaaggatgaaacaaaactgatagagtgagggaatggtatgtcctaaataagtatgattctcttaaaatcaagaaggaactctgagaggagggacagttactagccagcatgattctcatttatgcatcccaagaggagtgccaaagatgaaacacagaaactttgtatttattgcttaaaaatgttttgtacctaaaaatgatacgattttatttatacttactagacacggactctgaatgagtataaggtagaaaatagattatctcacttatcttgtagtttcttaacatagttattttatttcctagatgcctgaaatgtgcagatgccccgtgtcagaagagctgtccaactaatcttgatattaaatcattcatcacaagtattgcaaacaaggtaaattcagatttaactctgcaaatgaaaataacagtatttgatcttgttctctattatctgtgggtacagaatacagcttgtcttagcaaatccagttaaaccattaaatatgacttctataggcatttaaaaatgtggcacatttattaattaagcacttccaagttgtgatttatcatgaaaatccaggttcattgttttttgttttgaaaattagtttgtgttaaaatgaatgatttttaaaattcaagacactgaaaagattgattttagtttatgcttgctaaatactaatagacaagaactgtcattgatcatcaaaacacatttatgatttgtgaaatatctatgaaagtgtgctttgatagtaagtctagcacatagatatatcaaggtaatagacttttttaactaaaattcagttaatatgtttaagacttgaaataattcataatgactcatagagttgtagcaaaaaaaatacacaactaaaattagaagaaaaggcttatatgggcatgagtagaacaaaaggaattttgatctttatttttttttaaaaatcaatgtaagtctaagcccagttttcattcactaagtgaatggttgattgattgaataattgatagtacctattgtttttgtgaagagagcattgagagctcgcccaagtgtctaatcctttaaggatgagcaaaggctgaacaatgtctcccataaagatacagagaatcctttcacaaggtttaacactaattttctaaaatgctgtaaagataccttaactcctcgttcttcaacaaccaggtgcctttttacgtataaagtttatttcttaatatttcaagtacttagataatttaggagaaaaatgataaatacttttatataaatttagggtcttgaaagaatttaaaaattattcctgcatggtcagatttaaatctgcattgtcagatttattaggatttgaagtctggtttgaatttttagataaaccgcttattgtgaaactgggggtaattacctccttactttcacttatgaaggaaaggtagcatctatcttacagagttgtagtataaactgaataatatttttatgtgaaaatgtctaatatagtgattactcaacaattttttatgtggaattattagtttccctattcattcaatatggtaaatactatagaagtgattgctgtttttgaagtaaactgctatttataaaatcacattttttaataaagatctcatcagaaaaggagaatccaaagattgaagtctaaagtattttcgctaaaaatatatctaagttaacactcttcatatcaagcatgaggaaatatgagaattatgacggactatcttacaagatccatgctaccccaattttttcatagatatttcagaatcagtagttattttatgagtacacacttcatttattcaaggtctacacaaatgtatagaaaaaaagacaaaaaggattcttaggtttacaaaatgtctaagcaagatcacagtcatctctatttttggaaatccactttctgtttcattaatttgttcatattctttacctaatggaacgttgtgcttagatatctatttaaaagatttttatatgaatatgagagatttgaagatgattaattgagaagataatatgttgtcaaacctcaaaaaaaaaaaaaactctcctaattttttgttgaaggatcactgtagcaatcataaaaggtcaaagactgttgttctttaaagcctgcagctttttagatatttaccagctgtgtacaatgtaggctgtcccacattgctttgccagtggacctcaacgcaggaggggtgttctttccaggttgagagggtaattgaatcgccagactcaatgagccttgcgcctctttgagaaaaggatgtcacttgttttgtattgtgttaggcttctgtgattcagtggagtttaggccaatacttccattctttattttcttacaaactggattacagctctagttttgaaaggtacactcaattctattgtcccccctcagtcagtttttctctgtttggtttgtgcaggctgttgtttgcaattgtatctctcaattggaagtacacatttcagattcatcaaacagtgaatcctgggttatatttcttgataggttttcttttaaaaaacactactttatatgagaatgcatgagatcagtctataaatatagtgaaataaatggctgttttaaacagtgttccttgatttcgtgatcctgtatttaaaacaatagagatatattctccttaaaacttttaaagtgtaagccatcgatttttccatgattttgcatgtgtttataaaatctgtgtaatcagattagtgtggcttttgtgtatagataaataaatgtatactatgtgttacagaaaagctgactaaattacacgatgtaaaagaaaagtttttctttgtgatagatccttattaaaagtaactggaagttaaagaaacaacaaaatcgaagcagcagaaattattgataataatgtttgcatttataagaaagttacattgatacgtgtttgtgtgtatgcatgtatgtgtgtgtgtatatatatatggttgagagggatatatattgtacatatattgtacacacacacacaaacacacacacatattacagctgttacaaagcagaaaagcagaaatgtaaccaatagatttggtgctttctgctttccagtttgcctttcagtttcaatggctgaatggtttatactcttatcaaacaaaatattgatcatttccagaataactttctaaagctttgctcaaattctgacttccttgctcagtaactgtagttactccccagtgcctagaaactaatgtccaaatacataatctattatgtaagttgattggggtttctcccactattatattaaagaagtaagtggaagaaaaaatgttggaaagtccgtaatttataacccagtaattttttaaaatgtgaagatttagatatatgcaacaaaaagtagtgataagatttcaggtttcccttggtacaggaggtcatttccttcatctttattgttggataataagtatttacccctctatccatttaaagagtattgacttatctatctgccataagacagtgctcaagagaacaaagctttaaaacaaaacaaaacaaaacctctatctcctttgaccagcatgtctccaaagttatagaattacagttaggaggaatattttagaaaatgtccgtaatagacaactatatagaaacggaaagtagataagtgatttcctgggactcggtttggagagttgggcaaaaataggtgaggagtattttataaaagtgggtaatgactactagtggtgatggagtatcttttttgagtgattcaaaaatcagtgttctaaattaattggtgtacatatgctatgtagattatatcttaataaagccctacacacacacacacacacacacacacacacacacacaaatgcacacacacacacccccacctctatctctgttatattcctagagggtacacaagccataatcctgcagagttgctgagttgagtatgccatgtgatttaaataagtaattctgaactcgtgccagttttcattacagatgacctgccaattttggcctatgtattatgggttggtttgtgtcatttagaatatcaatgtgagtgggttttgtgtcatagaatgaggtttaattctaattacctctttccacgttacaagacgttctgtggatattaattctctcttttaaaatttgatgagagtattataattgctttatttagtcaatattggattagctttattcatatttttgtcaattttttcagtgttgcaatttccatgtggaagccgttctacttggaataaataaaattttattcagaaagggttttttttttgttgccagactatcttaatttttgtttctgaactatttttatttccattttttttacttttgaaaagttttttcactaattatagaattcagggttggcaatgattattattatttttccacttcatagaacttaccattttggggccttttatcatacaatgctactattgaaaaatgaatggaagtctaattattgttcatttgaggttaatatgcctttggggtgctgttttaaagatcttttagtttttgatgttaaacaattttaccatgatttatctaagtccatatttctttttatttgtcctacttatttttctttgcaattattgaaactggattgatttctttcatcatgttgggaaatatctcactgtctctctttctttatgaagctcttattagatacatgttaaatctttttactttgttctcaatgactcttaggtttcatacatttgtctttttatttacagtgtgggggttttattatagataatttccttcaattctgttttgaagtttactaataatttcttcaccagtttcaaatatgctgttaaaatggtccattgagttttgagctacaattatatctttcatttctaagagttttttgtgctttttttctaatctgccagctttttattaatcttttcaagacttttattgttttatttatttatttatttatttatttatttatttatttatttatgacagagtcttgctctgtcgcccaggctgaagtgcagtggcgcaatctctgcgcactgcaagctccgcctcccgggttcacgccattctcctgcctcagcctccagagtacctgggactacaggcacccgccaccacgcccggctaattttttttttttttttttgtatttttattagaggcagggtttcactgtgttagctaggatgctttccaactcctgacctcgtgatctgcctgctttggcctcccaaagtgctgggattacaggcgtgagccaccgcacctggccgccttttatttcttaaaacttaaaatattcgttttcatattctgtcaattttactattaaaagtctctgcgagtctgatgatactgtctgtgctatctgttgcctccactgagtgctttgtgttcccttgtatgttcattgaatttttattattatttttttactctgtcatttgtgttgatgccttattggaggaaattctctgagaactgtgaagcatgcatgtttctttacaagggatttatatttgcttccctcaggcagtggctttaccgccagtcctctgggaccaccttaaactaaattcctcacttaatgttttttttcgagtcaccaagattgtgtgaatcagaccaaaaatacaaatataaatttaatttgctaaggacattattttccctctttttcttgtgtacccaagtttaagactgaaaagtttctgtgcagttccaggtgggacctaggtggggttaattttaatttctctttctggtgatgtggacttacacaatcctagttttatgattgagtcttatgttagactcagactttaggtgggccttgagcttttttttctaaaacctatatgcttggagacccttaaaacagaagcctttgtttacatggtttggcaaatgcctttaagatgattcccactgatttctctggtctacttactgccttgttattttcagtccttggacatgcctattcatgacttaaaagctattttcctataattttaatttctaattagaagagtcatggcagataattagttttcaatatgccctggaaaagtgcggtagatatttaacaatgagtggatagtctaaactgataaaaaacccagagattttgtaggaaaatataggagtagtaattggggagatatatggaagaaagaaactttaaaaaatgaagacaaaaaagatttattatatcagatactgatactacaaagctactgtaatcaaaacaatgtagtattggtgctggaatatacatttctcaaacagatgagagtctataaatagaaccaagtaaatatgagtgtgtaatatataataaggaggacatttcaattcagtggaaaattaattacttcttcaataagtagatctggaataattttgactttacttttagaatctttcataggttatctcctagaattcttttcaggtggactaacctagatattaaaagtacatatttaaggataagtttaattacaagcagctataaaatatgggagaggacattttactacctgcattttaaaaatatattttaaaataaaaactaaccacacttgaaaccaagtgaaaaattatttgccatgcatgtttcagtccaagtgttaacatctttgttactcaaagagctcctgaaaatttatatgagaaggataactcagtgcaggcataggcaaaaattttactattatagaagtcatataagtgactattaatcatattaaaattagcctgcttgcatattagtcagtaagatgtaaatgaaaaaatgagataccagttttctctcatcaaattgttgaagttgaaaagtaaacccctgtgttactcagcaggaaggaaagaactttgatatgatggatatatatttgagaattaaaaatatatgtactgtttcaccagcatgctttattaatttgttctacctagagaaataaagtaattacaatgtaaagggacacatatacaaatatattatttaaagcaattatagcattgtttgaagtaataaaaacgggtgaatactttagtatcagctcaatctattaggctatatttatattatggaaggttaagaagcaattcttaaaattgcattttatatttattggtctaaaaggatatttgtagtaagtgaaagaggacaaattgcatagtaatgtgaatagtatgacactacttttagaaaaaaatttaatctgtatataaacaaaaaaggggaggatgtaatttagtttcttcatttgattgaggttagtgtagggtgaagttaggtttctaacattttccttataaatctctaaatgactttgcttcttataatgaacatacgttttataataaaaacaatatattaaaattcagtagtaaaattaaataaagtaaagctgagaggtttcacaatagcacatgacagaccctattctaagttttcattgtggtataaggagtgagaaaaataccaagattttcctcccagattgctaaaatagttccaaatatgttttttgaataattactctagtatactaatgccacctttattgcctatttgattccatatttatttagatctattttcaaatcttctttgtcctacctatctatatgtaacaggaccaagctgttttaatttctttgctgtgtagtatattttgttattaactaaaagcatctccttgacattacagttattttcaaagtatcctagcttttttctgcgtgtaaaactagctttgtaaactgaaagagttctacagaataaatattgagcaccatgttcagactataataaaatattaatttctaattattaatgtaaatgtatgcccaccttgactcattcatttattactaatgttactgtagttaatgtaactattaactaaattttccagaatccagactttaattttaataaatagcttcctagtcttgaatctggcaaattgtggaatactaaatttactagagttaaagacaaaggactggggtattattgttaaaatatcacatcttaattgaatgtatggtgtgaaaaggatagatggatataacattatctattgagtcattaatgcttatataagatgtatcttgcttctgttttgatatatatataacttcacaaggttacatttttacttttttttttttttttttgagatggagtcttgctctgttgccagactggagtgcagtggcacaatctcggctcactgaaacctcctcctcccgggttcaagccattctcctgcctcagcctcctgagtagctgagactacaggcgtgtgccaccatgcccggctaattttttgtattttagtaaagacgaggtttcaccgtgttagctaggatggtctccatctcctgacctcatgatccacctgcctcggcctcccaaagtgctgggattacagctcccggctcatttttacttttaatcacagctgatacaatgtgtaatagtcactgattttattcacttttgctttaatagaggaagttcagatttgaaaagcctgtaagctcaaagcaaatgttagtcaattataagttataaaatgtaaacaactataagtccaagagtcatgttagtataaatgagaaaggatttttattatacatcttaagccagttttatatgaaacgagtaacatcatattgtttgtggttgtgtatagtatagacaaatttaaacatatgcttttgtaaatatttgataaaatttaaattatttttaaaaaacactaatgatataaaaactaaatatatataaattaaattggaatcacaactattttcttttacaatattaagacaagaaaaatctgtataagaaacacataggatactattttgggtattttttaatattaataagtaaaagtcaatgtaacagaatatagaccaaaagaaaatgtaattgaactaggcatctcattgtatagaaaagaaatttgaaacccagcaaagctaatgacacagctgcttgatagtataattgaattttctagatttcttgttcagtgtgcctttgtattacactatactatcgatattaacaaagtatgcagattatgaaatattattaaaatataaaaggctggaacatttgctatcatgaccaaattttgtaagtgctattaacgtcttgaatgttgagtaaaaagtataatgtaatagacttcatgttaaagaaacttgagtttagtttttttgaaaactactttgaaaaattaaaatttttaaagtaaattattagaatcgatactaattatattttgaagctattaatgggtttaaattatgtacttagaatggaggcttttttgaaaaacccttttatttccactgtagaatataataacacactgtactatgcatcacaacagtctgtcaattaaggaattgctcatattctcgtcaataaagagcaaactcgcacaaaatagtctgacttttttgtatagaacaaatggtgtgatattacagtctagatttaatggcataaataatcatgtgtcttttggcatggcataaataatcattaaagaaaaagttttcagcattttatatgtaagttatatatgtttgaatatatatatatttcacattaatatgagattctttgattaataatcttcacctttcaataatttctcaaacttaaagattctcatttgcttgcaagctgtgtaatattcataaatgaaattgtagaattctttcaatacccaatgctttttttttcaactctaatgatgactagctttgacatctttgtttttgtatttgtattagtgtttcgatgtagaaaagtatcctctttgaagcaaattgtagaaactctactacacactaaataaaatagtatttcatctttttctttctctcttcaaatttaataacttactggaaatgaaaaacttaagcctctaaatttcttataaaatttattgcatttataattattttccctggataaagtggggcttttataattttaaaatatatattcatgttatttaattgataattcaaaaactataaagcactttcttatttttgccttttatagagattttcattttcaatattaaaggataagtaggccaggtgcagagactaacgtgtgtaatcccctcaatttgggaggccgaggcggctggattacttgtagtcaggagttcaagaccagcctggccaacatggaaaaatcctgtctctactaaaaaaatgcaaaaattagccgggcgtgatggtgcatgcctatagtcccagctacttgtgagactgaggcagcagaattgcttaaacctgggaggtggaggttgcagtgagccaagatatcgccactgcactccagcctgggtgacagagccagactctgtctaaaaagaagacgataagtagtaatcagtagttcagtttctagtattatatatgtagttgcctatatgcttacagccaaaaggggttgattagacatgatctctgacattaataaaagaaaaaataagacacgtcataaaaatataagactaccgcaaatatatattaacaaacacaatcatcaaaaggctgttgtacaaagtgctttctggcattatgcttccaattggaaaaaagctgaagtattgataaaggtctttaaaagaaatgttacctgaaaagaatgggttttgatacagatgaaagttttatttcatttagctagaacaatatagaggcaacaatattgattcttcattcatatctagtgcttaccaaaagcgctctcacatatttgatgaataatgaattgaatacatgtgcacacatagactaagttattttgactaactcatggggaagattgtaagttctcaagttcattaaatagagcagggaggataggatgcagaaaataggagtaatagaagtgacttaaaatttatataggttctatataaaaaatttaccaccattcatatgcccccatgtcattgatattttatggtttggtagattagtgattttctgtacatacattttgcttctttctttctgtatttcttattctacttcctaacatggaatatttatttaatatttatttagtaaatattaaaatcttaaactcacagtattaacatttaacaaaatctttttagtgacaaaaagcctaaaggggtagagtgggaacctaagttcactgaatctattgtatagtacataatggaataggcatcttatccatgcacagttaaaaaatgcataatataaatatgcctgacgaagaaggaattttgatcttcatgtctcaagtgatgaaaccgaggctgagagatatgacatttccccagtcatattgcttgtgcatagtataagcagaattcaaattcagttgatgacttcaaagctcgtgtacgtgtgtgtatgtgtgcacgtgcttgtatgtgcctgtgtttttgttccagttaaatatctcaggatcaataaaaacgttatcttctacaagaatgattattaatttccttacatgtataggcttaaacgaggctcactgaaccaaatgtgtagttctaaaaatgaatcatattgtataaagctgatctaaaatgtggtatatctaagatatgaaaagagaatttttcagaataaagctagtcaaacctattcttctatctccattttttttttctgagagtatgagtacgatgagggcaggaattttcatgtgttctgttcacaatatatctacattcttctttgccaaatatctgaggacccacaggttgttcattgagggatggtgacagcttgacaaaaagagtgttctgtgtgcatgtactttctgtgtgtggtgctagagacattttctattcaattaatgtacatcagtacattcaccattacagcttgagccagaaataaaagtaatgttaattcacccttctcacacatgcaaacttcttgaagtttagcccaagtgtttttttaaatgcagcagattggagtttatcttggaagggtgcttccatctgtgaaaactgtcattggaagaaggaagaacactttaaaataaatccaccagctgtattgataatcttgtagtgatatgaagacttgaatatgataggactatttgttaaattagttataccatatgacagggtagcggcttgtgagttttccatttcttgataatgactttggaaatcattaaattgtggaggaatgacactaatgcagtttcatgctgtaattttaaataaaaagcaaagtatagaaattaaattattttaaaattaactcacctaagtggcacatgtcgtgcctatagacatgctttaaataccccaaggactaatagaaaattcaacacctgcaaattgtgggtaaattagtgggccaaagaacattcaatgcctaatgtgttgatttgaaaacagcaaacatttcaaatattatttttgtctttagatttttgttaggagaaggattgaaagtcttaatgttttgtacataaaatatctctatgcacaaaaaaatcagatatgtattttgtatccctcctgacatagctctgtacattttttcctcacatgatggaacactgaaatgtttgtgactgattgaataacatgaaccagttgaagtagtgtgtattttctagaaggagactgctggggtgtctataaagtacccttctaaatttaaattttctagcctttacttttaaaaagaatgaagagctcacagaacagaaatcaaacctcttatgtagaaggaggactcaagaaatcttcccacttgctatgagagaataaattgatactgatcttgacattatctgtgggaagaattgaggaggtgttcccctcctaataggtttctgagtgtctttggctctgagtactaagatccctaaacaatggagttatctaccatttcttcaaagttatttgtaatagatagattgcaaaggtgacttgtgaatcattgcttaatattggttcaacccattttcaaaatcatgcttctttattctgtgaaacatgcctatgctttcctctttctaggcatcattgtgtaacctctcttgggctccctacctttccccttcctttctgagaatttccacatcatctattcaatatttttcttagttagtttcttaatactggaacccttctattaaaaagctttaattaaatagtaatccctcagcttgccagtcagaatcctccataatttggttcatgcatatttttcaaatatatcttctaataatctttcccaagtgaatgaattacctcagccaaattgccaagtcattacaccaaaccctattgtgaactttcttgaatatttactcatatcaatcaagaatgatgtggctatgattctctcttatcttagacaagtcacagccagaatcattttgactgttacccatttaatgctgtttctggacaccttaacctgaaatgacttcttactctgatgctaaagcatcttgatatcaggaagcatatacttgtttttttcaaaaaaataaacatacacataatgctttatatttagaagacattcaataaatccttactaacttaaaacaatttttaacctcctacaaattttattttagtgaaagggttttacttagagtcatgagagtgttaagaattattagacaatttcatggcagtagtagatcagacactcatagtttgacagctatagaaaaatcatgagccataagtataactttaaatattttatttgttgcaatttttcaaacgtgtctctttttcttcttgtgatatcattttatgtgcaatcttgaagctaatttggggcccatgaaacaatcaatattcttgtggaaagatacttaagtgtttaattggattatgttttttttttctgtgcttccttaccccaagtatccttaaaagtggtctaccaattgcagatcacatttttttgcatgatactgtttttatattacaaggacacttctaattatacaatgggaattttgagtcatggagtcagtcaaatatttgttaatgaatcacatcaagtgtttctgtgatgtcatataagaggaggaaagaatactgacagtgactttgagattatttctaacaatgatgacctgctcagttgcttttactaagtgaagagatcagtgggcttcagcaggaactaaatatgtttgcttaggaatagactgattaattctgagttagtaattgctcattttcattattattaagtaaaattatccaaaaccagaaagtcaggtcaaggagatgactgtgtctttttattatcatactaaggtattctttaaatacaagggaacaactaagtactatttagttttctaggagaaagaaccattggctcacttctgtatttattcttaaaaattcaacctatgaatgtacatgttaactagtagctttgtgtcaagtagagatgcaatttctattcagaagaaaaatgattccaaaagttatgttttattgccctacaggtcattgcctagttttgtatataatctagctattttatgcaattattcctttattaaattgagtatataattcccactcctttaaatgcatgctttaaaacataacagcttttatgagatgtattcacttcccatgtatttgttcatgtaagtgaagttgacaattcactgatgtctagtacatttgcagtttcaaccatcaccacagtcaatttgagaacaattttatcaccgctaaaaaaaacctccatacttattagcagttattgtccattccctctcagacccccagatctatgatttacttttagttcatttttttgtttggtgtgagatagggtcaaacttcattcttttgcatgtgaatattcagatattccagcatcattcattgaaatgaatattctttccaattgaattgccttagaaacctttttcaaaaattaattgaacataaatgtgaaggcttttatctggactcatatttatatcacattgatctacatgcttatcctcatgtcagtaccatactatcttgattatgttagctttgcagtaatttttgaaatcaggaagtgttagtcctctagcttcattcttatttttcattttagctattctggatcctctggattttcctatgaattttaggatcagcttgtcaatttttgcaaactcagctgggattttagtagagattgtattgaaattttagataaatttggatagtatcaccatcccaataattagtcttttggcccatgatcatgggatgtattttcatttatttaggtattatttagttcctttcaacagttttctatagttttcagagtataaatttgaactttttacagtttttaatacatatagttctgaataatttattttgtttgttgctgttgtaaatggaattactgtcttgattttatttttcgtttgttcattactaacatattgaaatacaattaatttgcattttaatcttgtatcctgtaagtttgctgtacttttattacttctcatagtattttagtggattagttagggtttgtatatacaagatcattttacatggaaatagaaataatttttccctttccaatctggataactttctctctctctctctctctctctctctctctctttccttccctccctccctctctccctctctctctcttcttctctatctctatccctccccactctgtcacttcctccttccttttatgcctaattatctagcaagaatttcaagtgctatggtgaatagaagttgtaaaagttagtgtgatggctgattttatgtgtccgattgattgaacctttgtgtgctcaagtatttggttaaattttatcttggatgtttctgtgagagtgtttttgaattagattggcatttaaatcagtaaggttagtaaagcagatagccctcccaagtgtaggtgagcctcatctaatcagttaaaggactgaataaaacaaaatgctagctctaccctgaaaaacacataattcttcctgtctgactacctttgaaatgaaacattggctttctcccctactcttggactagaactaaaactaaaacttaactggttctcaggccttccaactgagacttgaactaaaacattggctcttctgtgtctccagctggcagactcaaattgcagatcttggaaatttgcaggttcttaattgtgtaccagtttcctataataaatctcatacacacacacacacacacacacacacacacacacacacacacacacacacacacacacccccccccccccccacatacatcctattctttctgtgtctctggagaacttttgactccttgactaatgcagtgaacattcttttcttgatattggaggaaggcattcagttttcaccataaagtgagatgttaactgtgggtttttgtagaggccttttattaaggtgttgaagtttctttctatttgcagtttgttgatagcttttgtcatgagggatgttgaatttgtcaagtgccttttctgcatcttttaatatgattgtgtgattttttgtcttttattctactgatatggtatattttgatataaaccaaccttgcattcctgagataaatccttcttgtatgttctagaagtatttgtcagaaattagcataaattgttattatatgttttatacaattcaccgattaagccatggcagcctcaaatgcccttgactcagattttactatctttattctgtatttgttaatgaggtaaatataatctttcacacatttttcttctctgtgtgtaagatatttctgtgttgacttttggatattatactttgacagcttaatgatttattattaacctcttttagagacactaccgaagactctgacaaacacagtggtaaatctgatccaatttgggggaataaacagatcctaatctcttgattaaaagaaacagacttttaacttattaagcttttcattgaactgatggaaagaccacaactaaaagaactatgtaataaaaactacttaatataaagtgtaatgaatcgaatggactagctatatgtcctccagcttatattgaaaagaacttttgtgtgtgtgtgtatgcatgtgtgtgtgtgtgtttacatcaacatatggaccatagctgaataagatcactgtaactagattctgtaatctattgagccatgaacagtatgctttagtatgaatcctgtctctgccacttatctgctttatgatcctttgctaattatttaccctttatatttcagttttattgcttgtgagtttaatttcataccacattcttactgcatattcagaaaatatatgtagaagaaccattcttacatggcagacataactttcattgctgaagggacactgaacaagacaaatactgttaaaccaccacgaatgctgtgaaagccgtgcattagcttttattttaaaatgttcatttacttctaaaatatcagtttgattctttttaaacagattccagtattctggtgctattattaattgtttctttttttgtcttttcttttcctgaattttcgtcaaggttatttttaaaagtcttttattctgacttaaatttcttgattacctaggagtttgcttattttatttattgttttcttattattatcaggcgtttggtcctgtctcttcttgcatctaggaatttttgatcgagcaatggacatcctatatagtgagagatgataacagtaaataaaataattggtgctaagagtaaataaaagtcttttaaagtgctggggatatattaaagagtcaataaatagtaaatgtcattgttcctttttgttatcatcagtattctgtaatcactaggaatctgtacttatgtctgaggcttttcatggaagcaacgtctgtgctttcaaagaccttcaaaattattacaaataaaagccaaaggaaaaataaatgcaatatgtttatattgttaagtgcattctatcagctctattcttaaaatgtattttagagcagttttagatttatggaaaaattgtgacagtagtacagagagtttccatatgcactcataattacccctattattaacaccctacattagtatggtacatttgttgcagttaatgaaataatattgatatatgattattagctaaagtccctagtttattcagattttcttaatttttacttttttttctgttccagtatatcataaaaatcaccacaatacatttatttgtcatgtgtccttaggcttctcttgtctgttaaaatttgccagacttttcttgtttttgatgtacttgattgttttcaggagtactggtcagatgcaattcttccttttgattagaggaaaacattctcccaaatattcagcttattattcattcttttttcagaaaataatatgttccaaaaataatgaaagctctggctgcttttaatttagttaaatggaggataacctgagtataaccattttttgttgttttaaagtttaggttttgagtttgttcaaacaatgccatctaattttcatttgttaaaaagtgaaatgaataatttttgacaagatatagttagatgacttgtaaatgaaaaccatttacagaacatttattatattttaaacttcagttttccaaaattgattagttattcatttatcaacatactgtgcattgaatattcctatgtgtcaaatactctgctaagttttaattgatggttcctgatagtagtattgaaacctatgcatcttatacacatcattatcttcaatctgattacctagtagaagaaataatgtttgtcgtaatttggctgtttaaagtatatttttaagtagtaaaattttattttgtattaattttgcagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtatgtatgatatacacgtgacatccccccactaccatcaccatgcacaaatatcttaaaataactttaatccttggtgctctgttgatacccaacatttttagtgtgacacacagctcaagtatgttttgtacaacaaactttatttttattcagcagcttagctacaaaaaggaagtgtataaaaccatatgtcaaattagttgcaatcccagcaggttattaaaatactttgactgaaattatataaattagatgatccgaaaatagaacttattcattaactttatgtggaagtatggcaaggagaccctcttatgaaaagactatcttctgtaacagattattttccctgaagctctccttaatctttaaagcttgaaatacagcatatttcattgtattctttgagtaataatgttagagaattttcaaaaaccctgaaactaagtaatgttatttaaccacattaataatgtcattagattttgtgaacttatagattggaagcaggtcttttatttgggtaaaaaatgtataaggaaataaaatgagagcacttttttttctgtttatcccatagactttgatcctggctttctctttaatgaatcatttgtaaagactttgattcttcagacactcttgggctctctgacgtctcctatttggagtcaacaagcaggttaattcccatgtatcatttaaatgatcagcttatatgaagggtatagtaagattttataatctttggagactagttggctagaaggtcaaattaagtgcccgtcaacctagatttttagttaatgacttactgatctggttttgtcagcataaacacaatgtgttctttcattttgggacccttcccataatattcctcaagcttaagtctcactttgctcttagtaataaatcagggttattcccttcctgctttctgacaggttaattctaaagaagagctcctgggaataagaaaataaaaacaattcgaggttgtggattgttgcaataaattctgggatttaatttcttttcttaccaaattcaaaattgcattaggcttacctgaccactacgaagtatgatctttactacctgtgaaaatccttagttgatggagaagattcacttgaattcctcctcacttttctttggggacccattgcctcttcattaaaccagggcaagctttcacagatgcagtaagtgaaaggtcacatagtatgtatatcaactaacacagcattttaaaacaaaatgaattaaaatgatatcattagtaattgatctggtcatgagaggtgtgtgtgtttgtgtgtgtgtgtgtgtgtgtgtgagagagagagagagaaagagagagagagacagggaaatacattattcctctggaaactctcacatggttttaattcttttctctgggaacactgtccctctgggaactcttacttggttctaccactcattcccagagcagagtctatttaagacagagacatgtgccttcagaacagaatttattagaaacttactaaaatttgagagtggtcacacttaggtcttgccataagtatcacctaatgaagagttatgcatagattaggactgcagtagatgcattttaagtgaatcaaggaatttagaataggaatgtatctgcttatttcattccaattatagtttgtataattgtaatttcaatatcaaattataaattaaaaatgtcctcgtgggaactactgagaaaagctttttgtccttttttttgggttggccgattagggtgcctgattttagaaagtcctgtattccctaggtcagtgtgtggtttacttaaatttacccaactgtcaaagttattaggaagttaaaaaaacaacaaaacgagtaactccgttttcactgatattcacggaaaaaagtacaaaatgcgaaatgttattctttcaaactactattgacatgagtatttaagttgaagtgtaatatgatgcaaataattttatattttgattgtttgataaaacaatgattgttttttgacctttaaagaaatacaaatctattttttcaaccaaattaagcaaaggttaggaaagcagattacaatagtatggtatttttcaaaattgtttttcctgtgacttataagtgatttttaaaataccaactcagtagtctgccattattggttaggtacataccttattcttctccagtttaacatgagcatgtgatttggagggaccatagtggaaaaggaataaatcacatgatgcatagccttatgtagaatcaggaggccagctgcttttttttttttttttttttttttggcagggttgggggtggatcttgtgttgtcattcctattcagccttttgctgtttccacatttgcagtgtgaaaaagccaccttccttcacacactggtgtgttcatgtagtaaacaggctaccggggtgattgtgactcactctaggaggcactttttttccctagtaatattttaatcctatcatgacattgtttcaataaaataactgggaaataatagtttagtatagattttatcagtcacatgatggtttttgaatttctctgcacaaatataacccttgaaaattttattttgaaaatatttgtgtatttattggaattttgaaagaattatatattatttacatttaatagaccacctagactctcattgcctctgaaatttaattaatgaattgttggaaaagcagaaggaaatgagaatgcatctttctacccattgcctaaagtttgaaaaaaaacgattttacatagaaaattagctgcatgtcaaatcagttctcttctactgattaaaaaattatggaggcaatttagaaatattaaaattaaaaaatcccagtcttccaggatttgtgtgtcaaaatgaatgagagctggaaaatttatacttaaaattaccacctcaattctgaattttcaggaatatactggattatgatattgacatctaaatataaaatttatttcacaaaaacattttataagatttttctgatatctgtgaaatataccatcttatgatatatacctcttagcactttacttatatttagattttatacttttattgtactaatacccagaatctacaagaaactcaaacaaatcagcgagaaaaaaaaaatcccatcaaaaagtaggctaaggacacaaatagacaattctcaaaataagatatacaaatggccaccaaaaatgtgaaaaaatactcaacatcaccagtcatcagggaaatgcaaattaaaaccagaatgcactaccaccttactcctgcaagaacgatcataatttaaaaatcaaaaaataatagatgttggcatggatgtgttgaaaagggaatactttcacattgctggtgggaagtaaactagtacaaccactatggaaaacagtgtggaaatttcttaaagcactaaaagttgatctaacgttggatccagcaatcctactactgcgtatctacccagaggaaaagaagtcattatatgaaaaagatacttgatcacacatgtttatagcaacacaattcacaattgcaaaaatgtgaaaccagcccaaatacacatcagtcaatggttggataatgaaaatgtgatacaaacacacacacacacacatgcacacacacaccatggaatactactcagccataaaaaggagcaaaataatggcattcgctgcaatgtagatggagttggagaccatttttctaaatgaagtaactcaggaatggaagccaaacatcatatgttctcactcataagtgggagctgacttgtgaggacacaaaagcataagaatgatacaatagactttgtggacttagggggaagagaaatggtgggtgggaggatgagggatgagacaacccattgggtacagtgtacactacttgggtgatgggtgcaccaaagtctcagaaatcactactaaagaacttaccagtgtaacaaaaagtcacctgttccccaaaaactattgaaatatttaaaaatgtaagaaatttctgtggttttaagccaaaaaagagaatggaactgacaagcaattgtagatgaaatcaggtgactcattcagaaaagaggtatctgtagattttccttttttatgtttttaaacattttttttattttactttttgtctctcagcaggtttctaaactatcacctctcatttgactttactcaatccttgtcgtatcagcatatactatttgcagtaatgcaataaatactttgaaatatacaataaataattaactacagttacactattgtgctactgaacagtagatcttattccatgtaagtgtattttcatacccattaactatctggaattgaattggatttttcattaacacaaataaatgacaaatgcttgaagtgttggatatctcaagttaccctgacttgatcattacacattgtatgcatctatcaaaacatcacatgtacaccatacacatttgacactaatatgtattaataataattaaaaataaaaaataaaaaattgaattttttcatgtaattgataaaatgtattttgttttatttgctttagattgaacatatattatagataaaatgctaaaggccatgatattcccttcccaagtcaagcactctgattcattgatgaatatggtctatgttttatgtttcctaagaaataattgtacaaagaatgtggaattctcaaatgaatgttgaagtttagaaactttctcatctgtttattgaccattcatcttcctcatctttttttaaaaagtttattctttgtacattgtgtcatatgtgtggtgatggagggatctagggatataacacacccaccctggattctctacagaaagccagttaactcaattccatttattgtgtagtttgttgtttccacactgatttgtaataactctgattttatacagtaagatcatatgtatgaatttgtctgcttttgtttttttggcagggtttggagctctattttttttacattggtctatttatgcatccattcactgacacaaaatgtattaattgctacagttttatatttttatatatgatggggtgttttattcttgatttaccattttcagaattttgttaactattcttatgccttaataacatgatgatgggatatttcttaagggttaaagaaagaatatactatatattccaagggactgtaaacatttatttctatattttatcaagggtagacacagtttgagttaaattagtctggtaaatatacactaatacaattaaaaatgtcaagtgttatgagactacattagagaacatttaacaattatttaaattacatcaacatttatgttttgcttaaaaacgataataaacagttttgaagaattgggaatggagaaggaacttgttcactcaaattagtatatgattgttttaatagagcaaatattacttctaccatatcttcaccttggttatggcagtcactgaaattcttaaacttttgtattctacaactctattttaggagaacatagacatatgtattctaatgaacaatagagtattgcaggtgtgctctgaaataatgtatttctgtgataaatttcatctatcaaatagaagagtggagacagaaatattaagtgcaagccccgtattaaaaacagtcatcaaaaagatgagtatttgtgcataaactgaaaagtgaggttggaaatactctagctgtgtattatgttgattgctttataagtaagatgatcaaatgaccgagataggttagataatgatcaggacattattaataatcagtccagtacagcaggagtaaactaacaccaccccaggcaaactggcttatgtgaatacccagtgtagtaagagcccactaggtaaggattcagttaatcaaactaacattgattgggcattgatcagcactgtgtgttgttgtagactgcttctttactacaagtcctagggaacattgtagtttctcaggaaataaagccaacaattgaaataatgtagtaaatgtaatgagacatataggtttacattggcatccttggacttattgtccaatcttcattaatttttgtcacatggttttggaggtgattagaccttagtgcaaagaaaagtatcaggcaaggagaaaatgcagttatattgtactttgcatagtgcttcagtgcatttttgtaatatctcactcaaaaatgctgataaacaacgcttgagggcatgcaaaccaggtaatttttttcccattttggacataaggaaactaagaatcaaagtgattacaaaatcacagctaatgttaaataaactcccagtgtcctgcacaatgttgagtactttatttagagcttgattaatcctcagaataactctccaaataatgttattatttccattttacatatgagtaacaggaaactccaggaaattaattaacttccacaacctcacatgtagtgagaggcaaatctggaatacaaagctagtggtttaattttcattatttcacaaactcttacttgccccaggtaatgttactagtcaaagacagaggcgctcaatgtaaaccctggttttctggctgtaaggccacagcagtatctgttgcatcttctaggctagccaaatatacttggtcaccatacctcacaagtccttgtttttctgttagatatgaagctactacattgaaataggttgggtaagaccaacacatacggcttagttgtttttttttttttttttttgtcttttcttttttaacttctgtagccaggaatgaatcttaagttttatggggcttcagataacaaaatgttgggttccttctttagaaattacattacagcactactgaaaaatttaaatacaaggccttagaaggggtctatatgggccaggcgtggtgggtcatgcctttaatcctagcattttgggaggccgaggcaggcggatcacaaggtcaaatcaagaccatcttggccaacatggtaaaaccccatctctactaaaaataaaaaaaattagccagctgtggtggtgtgcacctttagtcccagctactcaagaggctgaggcaggagaatcacttgaacctggaggcagaggttgcaatgagccgagattgcgccactacacaccagcctggcgacagagcgagactccatctcaaaaaataaataaataaaaagggggggtctatgtgacgaggagccttgaagcgttaagtgtttatctgcagttttattttattttggaatgcctaagtatgattttgtgaaagctggtatacaaataaatttaggaataaacctagcacatttatgatacagtttgacaaactgatcaataaaatctatcagttcattttgtaatctataactaagataaattatcatgataatgaaaaattactaatatatatagctaataactttttgcaggtcatttataaataggatatagattaaactatatttgttagattaatgatatatcacacttgccctattatcccaaagttttatcactttaaatgggatttctctatactacttctatttaaaatagtactattcaattatttgtgaatgtctttaaccaatacccaaccctcaaacacaaaggtgaattatttctgagagaagtaagatatagatgaaaaatatgcattaagcactaataagataaatattttttaccctggtaaaatgtgtctgtctggaatgcaaatacaagtaacatctttgaagatttgatttgtgtctctccttttactcttaatgcagtgattaatagaaaagaataatgtcttgatagaattcactaaatatctgacattcttctccaaaaatctttagaaatctattaaaatattccttactggcacaatgatttataatagaactgtggggccagatgaattgctagatgatttttattacaatattttagtttgttttaaaactgtatcttaatatctaggacttaaaaataagctaccgtgatttgggggcaataactttgaaatttaacgaaatcgcatggttaaaattatttgcggttacttttttctacattagtttttaaaaataaatgtaaatttatactatttcgttgccaatttacagttttaaaggattcgttggtttaagcttcaacaacttaaaaatgtatatactttcataaaaatatttgatgactcataatatagggtagtataaagcaatattattgtatcaacatgaatcacttgtaaaaggcatgatgctgtaagttaacatttaagccacccatttatcttcaaataatgatgataagtaaaatttaatgaaagtagaaaaaaaattaagaggtgaactgaaaaagaaatataaataccttttgggccagaaatggtataaaaacatggggactaggttattctctgctaacttctgctggggagtggtctaagataaacttaagtgccaaaaacatcttgcatggtagaggactggactcagctccacctcatagaaagtttaataaaaaataggtgcaactgctgtacagagctgaggcttatagaaagctgcagaaaaaagtagagaaagctgtacagcaggtattgtgggcatgtgtctatggtacagtgatttggttctgtgatgcctctaatcaccttggactggagccctggactttaagaaacttggttctgcagtgggagagagggataggagtattgttgattgaaggccacacacacctgatacaaagccatagggggagtgccccgaaagagaataaaattcactcaacgtaaatgagaaacaaaaaggtagaaactatgttaggaaagataatctattagtgataatttaaagacttacctgatggtacctgactttatcctaatgaaacacaaataatattataatcaggcctttaaaattaatatgtataaaataatatcctaaaaggagataaaataaaaaaatcaacggtgagtttaatataaaaaatagttgactgtaaatttacactataatgacaatctcaatagaaaaggtcagttttgggctggatagaggcataaattgcagaactaaagaaataaaaagtaaaaatatgatctgagtattcaaccagagcacaataaagagatacgaataaatgaaaagtttaatagagaagttcagaagcttctaagactccaatacacatgtaaggggagctcctaaagtagagagacagagattggcacaggaggagccttaaagcagttatggtggaaaattttccagaagaaaggaaagatgaaaggtcttcacctagacacagggttgtggtaatattgtgcaatactaaggataatgagaatcagaacttcaagataaagggaaaacaaattactggaaaaccaaatgacaattactctgaccttagatttctcatctgcatctactaagagttattctttagaaggaaggaaacaaatgtggaaagaaagataaaagaaacaatgtgtaaaaatatggttgtgaatataattaaatattgatcccagagtaattataacttattttgagttttaaaaataaagatgtaaaaaaaagttttataatattgacaaggacgtgttttggaagataaaaataataataaaaaactcttaaaagatgtaatattcataaacatttatacacatgacaacataaatttactcaaaatttgtaaggtttatttgtataaagtttattggattgatttaagaaatctatacttttctgagcctaacatagaacgaatgcatcattttcatgcacttgcagaacatttatcaaaactgaccatgtactaaaaaacagtgacttatagtccctgacttacaatgattcaacttaggattttttgactttaaaatggtgtaaaagtgatgcacatttagtagaaaacttacttcaaatactcattcacctactttatttttaactttcagtactgtatgcgataaattacatgaaatattcagtactttatcttataacaggctttgtggtagattattttgcctatctgtgggctaatgtaagtgtcctgagcatatgattttggataagtttcttataactaaactataaacacttaacgttttcatctatatttggtcagttttaaccactctattcaattggtttatcaaatatccaatataacctttgtttagtcataataacacagactataatcttatgagtcagttcctttgtatagaaaatgaacaatcatacctaaagtcgaagatttttaggattggagatataaatattaagttccccagagagtgccttgtaaggaaaaggcattcatcacaagaagttatcaccattgactctaatcttcacaataaattgctgaagtaatcattactcttttaattttcagtgttggtatttaaaaaggtgaagtactgtctaatatatatatgttttttttattgttgtttttaaggtttggcttaggtgtcaatttctctttcaggtgggtttaccttctcaaatactctgagagcaacgtttgtgaaaattaaccctgttccagacaggctacatagtaatatagtttattaaaaatatttaggacatgtgagtgctctattatccagggagctagttactggagagtctatgttttttttcatactggtgtctaggacataggaggtacctaaacaatacctaccaaattgaaaaggaaattgaatgaaagaatattctgatttcagctaacacagtatttttaacctgccagttgtttctctcaatgtctattttaataatatgaaaattatggaaaaaaatctttgagaattactaatacagtaataattttgataaataaaaatttgacattacatgaagtttttatcatttttaatacatttgaaacacagtactcacttttggtgttcctggtctaattgttatgaagaaaactatttgtcaagaagcccaagtatatttcttttcaaagaatgaatgcagtgattagtatgtactcagtatttcctttgacttgtcttacaaaaggaaacaaacaacaaagaaaattacatagaagcatctcctagaaggtatgtaatttcaggaaacttacttttggatgcacaaatagcaatttcttcattcaggcattcaaaaggtaacgagacattcatcccactaattaagtaactcaagaaactgaaacgagcaaaagaaaaactgatgtattatttttattaagatttatcttagacctacactgatgaaataacattcctttagaaattaccagaaattatttttatttgataatgaaatcaaggtaaacacttgcaagagtataatcctcttgtgaggtatgtagaatacaatcatactgttacaattcatccttcaactagtagagatgttctaaaatttccaagagtattttacttctcatgacttccctatggtatatatttgctattgtttggttaattagaacaaacagagtaattgaggaataattacagctatcaaacatttatgtttattttcattatatactcttagcaagaagggttaaaacaagcaagagttaccctcaaatttgaattggtaaatatacttttatttacaatgctttgtcttttttcatttatagaacactatataatgattagaaaattatactatttctgtctccagaaggtgaggagacttgggggaaaatcctgtggctcctctctgcattgcaatctttccattttaaatatcaatataatctctccctttcttcaaagtaatgtgaaaattatggagaaaatgctggtaaagtcaatttggagtggtgaaatacatgcactttctagatgaatgaaagatgagaaatcacaggatgaatacacaagaaaattaatattaaaaatgttcctcaagaatgtactatgtacccacaatattaaaaaatttaaaaagtaaaattaaaaaaatatataccatgtacttacaaagtaaaaatattaaaaagtaaaatttaaaaaaggatattcacttgcagataattcttcattatcactaaggtagaactgttttccttggtgacttttactactttgtttaagcatatcactgaaggccaggaattttgaaattcatcaaaatcttgttgagtgcctattaaaataatcttaaaatagtccaagtgatacaatatttgtagggaagggaacaccttaaaaagaatacaaatgcaatttataagacaagaaaaggaaaggaaatgtatacagagaaggaagaaataaaactgtctttgttagcaggtggcagaattgtctatgtagaaaattccaaagaatcaacagaaaaactcctggaactaatacacaattttggcaaaaaaggatataagattaataaacaaaagtcagccactttcctttacaatagcaataaatgattagaatttgaaattaaaagtataccatttacatttgcatccttaaaaacgaaatacttagatataaatctaatgaaataggtataatatgtatatgagaaaaactatgaaactgtgatgaaataaataaaaaaagctaaataaatagagacatattccgggtttccaaatagaagacttagtattttcaagatgtcaggtcttcccaattagatctatagattcagtacaatcccaaatcaaaatctcaggaaactattttatagatattgacaaactgattctaaagtttatatagagaggcaaaagattaaccaacataatatagaacaacaaagttggaggactcggactacctgattttaagacttactgtaaagctgcagtaatcaagacagtgtgatattgttaaaataatagacaatagatcactggaacagaatagagagcccagaaatagacacacgtaaatatagccaacttatctttgacaaaagagcaaaggcaatataatggagaagggatagtcctttcaacgaatgatatttataccaccctacttccatatgtaaaaaagtgaatctagaaacaaaccttacacccattaaaaattaattaaagatggatcataaacctcaatgtaaaatacaaaactacagaactctttgaagataacatgggagaccatgtagatgaccttcggttagacaatgactttttaggtacaaaatcaaaggcaagatttataaaataaattattgataagatagacttcatcaaatataaaaaattctgagctgggtgtggtggcatgtacctgtagtcctggctactcagaaggctgagggaggtttgcttgaatgcaggagtttgagaccagcctggggagcatagtgagactctcatctcaaaacaaacacagaaacaaaattaaaacttctactctgcaggaaactgtcttgaaagaaaatgaaaagacaagccacaggctgggagaaaatatttgcaaaagacatacttcataaagaactgttatgcaaaatgtccaaaagtctcttacaacccaacaatatgaaaacaacccatttaaaaaatgatacaaagaccttagcagatatctcaccaagaaagatatacagatggaaaataagcatctgaatagatgcctcatatgtatcatcagggaaatgcaacatgaaacaacaacgggataccactatactattagaatgcttagtctgctcagtttgctacaacaaaataccataaactggatggcttataaacaacaaaaattatttctcttggttctggatgctgggaattcccatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagcgcaccagcacggcacatgtatacgtatgtaactgacctgcacaatgtgcacatgtaccctaaaacttaaagtataataaaaaaaatatatgctcataagctgctttctggtcataggtaaaggctttttactgtgcctgtcttacatgtgacaggggcaaggtatttctcctggggttgtttttaagggaactaatctaattgaggagggctcctcatgacctaatcacctcctaagtcatgacctaatgactttttaaaaaccccacctttctaacatttgtggttagttttcaacatacgaattgaatgaaatgggggcgtagacacaaacattcagaggagaccaaacagccaaaatgcagaacactgatatcaccaaatgctgacaggattaggagaaataggaactttattcttccctggtggaaatgcaaaatggtacagccaatttggaagacagtttgacagtatcttgcaaaattaaacatactcttatcatatgatctggcaatttaccccaaagagttgaaaacttacgttaacatgcaaacctgcacatggatatttatagcagctttattcataatcaccaaaatttttgagatatccttcagtaagtggatgcataaataaactatggtacatacagatattgcaatattattcaggattaaaaagagaggagctatcaagccatggagagacacagagaaaacttaaatatatgttactaaatgaaagaagccaatctgaaaaggctgtatattgtatgatttcaactgtatggcattctagaaaaggcaaaactatggaggcactaaaaagaccagtgattgctggggagaaggtgagagagggatgcatatggagattaagaagatttttaggacagtgaaagaaactattgtgtatgatgctgtagtcctatgatgctattttcataataaatttgtgcaaacccattgaaggtgcaccagttgtaataaatgtactcaaatgtaccactatggagaggatgttgataatagggaggcagttctcttaatgcaccaactaccttagttctcgggtggcaggatagcatggtgggaaaccagatgatgtagttcagtgttttttaaatgcttcatgaacaattcttggtttgtaaagttaatttattaattataataaccagctatttttgttagtagagtggctagaatatatcaaaatctattttatcagaatgtatgaatttaatatattaaaatataacatattctaagtgggttaggaatgacaaattcatataattttttcagttatacatttcttattgaaaaattagagaaatatagtgaattttttagcgattactgtgaaaatgtaatcgttaaaaaacaaatttacaagaaaaaaaacccatcaaaaagtgggcgaaggatatgaacagacacttctcaaaagaagacatttatgcggccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaagatgtggacaaataggaacacttttacactgttggtgggactgtaaactagttcaaccattgtggaagtcggtgtggcgattcctcagggatctagaactggaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctgaaaaccatcattttcagcaaactatcgcaaggacaaaaaaaccaaacactgcatgttctcactcataggtgggaattgaacaatgagaacacatggacacaggaaggggaacaccacacaccggggactgttgttggttggggggagcggggagggatagcattaggagatatacctaatgctagatgacgagttaatgggtgcagcacaccaacatggcacatgtatacatatgtaacaaacctgcacgttgtgcacatgtaccttaaaacttaaagtataatttaaaaaaaaaaagagttcaggctttggagtcaagtagccttaagataaaatcttttgtatgtgaacctgaccacaggtttcttacctaggaaatggatctgataattgtacctccataaaggagggttgaagactaaatgatagagatttaacataaagcctggcacataggatatatttcaataaatattggccaccttattattgtggggaaatacatattaagtatacttttcattcatctttaaatacttcagtcactctcttctgatattaacaagtttatttcatttattacattgtttcggcagttgacccttcaacttaaaaattaaatcatagaatattagtcagttgatggacaactgacatttgctttaacgaaaaaaagaggggtctttctcaccgaaagagccaaattattttataatatttttgttacattatgaaacaatagggaactatattctaagaaaaaatctcttaggaatttgatactgtaagtaactggacctaataatatcttttatgtataatttgtttgtaattttatgttgcacttctctgaagactgatgtagtttaataaaaggaatgaaaaatattatttttgaaaaatattcttcgtatttatggacattttaaattttgtaatttgttttaactaacttttgtaaacttttatttttaaatttaacaaaattaagttaaccctcttttttttaacttacacaatctattcattggcagtttaaagtgttacaatattagttattttaatttacatttttcatataatgccaactctagatttataattgatttcaattttcatagtttcataatatacttaaatacaaatcactaccccccattcacccacaaaatatttttggagctatttatttggctttttatccatttgccctcattttgtcataatcaggctacattcatggaagtatattgtgtatatatgaaataatccattacttgtatttcagttaaaaaagagttagttgctgatgttttaaagggatagagggccacttatgccttcagatctctattaagttggaaagtgtaacttatgtatttcagaatttagggttgatggtagaagaatattagtggctaaaaaaacattgaatgagccctcatgtattgccgaggtgcaatagtgtgctgaagccagccaggaccagctctagtgctgattaaatttttaggaattttgtaaacaggttgtgaaacacagtaattttgaaaaattaaagtatatgaacatgtagtcataaaaatcatattaaaaataactataacaaatactacaaactcactgcctctaaattatttatttcccattaactatgctcatgagattatttatatctattgcattatatgtttgaaattttaatttttgcagtgatggatgtgttcgatgtattatccactagccacatgtagttattgagcacttgaaatataattagtgctactgaggtctttgcatttttaattttatttaattttaattttaatttgaacttaatcaaatgtggctagtggattccgtcttggacactatgagtttagatacattctgtctcatggaatttgaacactaggtgaaatgagaagtagataacatttgctatatgggcaggcagtttcctaaagcactttccacatataattagctcattaaatcctcaaagcatctctatgaaatatattttattaatcccaccttattaaggagactgaggcatagaaatgttaaaggacttgttcaattctatacatcatgagaatgatggaagtcaagactcaaccccaagagtctcgtttcaatgccatacttctaaaaatataccatctgttgtgctgaaattcacaaaaatgtggttcaattatttacttccttaaaaattgcatcaaggttaatccaaactcctgttaaactcggggaaaacctagtgcaataaaaagttgtaaagaaaaaattccagaacagagcaggcaaagggataccaattgatagattagtgtattgagccaagcaatgtaatgagtatgtattgaacaactcttaagctgcagtgcacggggttgagcaaatcgggctaacaatttacattctagtatgtgcacatatgctatgtgtactgaggagtgtgcttgctttcatttcttcaaacactttttaagagtctttaactctgtgttgggtacttaatagggattctgtaaacattttttaaaataattcaatgtttgcatctcataatttttttaaaagaaggcttaaatttttattcaaaaatattaaaatattttaggtgaaaatacatacatattgtgtattatttggtaattgctactttattatttgcatgccattagctagaatttgttcagatatgctaggcgtttcagaactaacctatttcttgcttatgagtgaatgctgagcacaaattatattccatttggttatgacactgtaacttcatattataatgaatgctgtagccttagtacatttaaatctgcttccattgtaaaagatgtcagcaataaatgatacttttaaatacatcataaatgtcttcatttaagatttgttaaaacacaatgttatttgtaaatgttagcagattttaacatgggaaagttaaatatttaattattagttcacaaagctaaaattattcaactaaatatgaaagaaattagcatttatttaatccctaaataaaattagctatatctctgttccctgatcagagatccttgatcacgttaaacatatgttttaagtatctctttatgaaaagtatgtgaaatctttctttggggaaatataaaaaatatattttaactatattttaattaatgatctaataaaatatatatttatgaaaagtatgtgaaacctttctttggggaaatataaaatatattttaactacattttaattaatgatcatataaaactaccagaatttagttccttgttcacattgcttagaaaggaataaaagataacagtatatgttgattcaaaaacaatatttaagaaaatctgtactgtttggatagcacagggaagagcaggaacacatattaataatttgtaaattatacaaattgtagctgggaataagaaattattttattaccaatttaaactcattagttaacatatattcccccttatgtataaaaacactgaatattaaaaggtgaattcaaagatgttgtcttcccttaaatattttatggtctaagagaggaaacagataagtaaaccagtaaaagtgacaaagtattagaatgaaaatgacaaaatattatgagaccatttatgaggacctttcatctcatgcttagaaattgaccctataatacttgttgataataccctcttcaattttttaaaataagattgtttggatgttccttatgtgttttgactttatttacaatagtttgtggtatatgtgggatgaggttaagaaaatgtaaagtcctgtcacctttattcctcattcttaagaaaacttacatttatatctattgatctctgtctgggtttccaggagagaaagttactgctttgacctattaaatgcaagcaactgtgtgagccaatccattggatagcataaataacttacctataatatggatttattcattggccacttctattggtagtcaagttttcatgagagtagaataatgagattatagtgatttatttattttacttttagttctatcaattttgctttatatatttaaaattgtattttaaaatcttgttgaaagattgaccatttccttgctatgaaatgttctttaagtttagtaatgcatcttgccttaaagtgtaatatttctaatattggtatatatatatttcatatatatatataatatatatatgtaccagctttcttttggttagtgtttgctttgtataactttttctagtctttaactttacacttatctatctgtgctcttatatttaaggcatttatcttccataacttttgtcttttaattggaattttagtccatttacatttaatataatttctcatgttgacatttatatttaccatcttaccatttgtttctttgtttcctaccctctaccacctatttataataattttaattaatacattttaataatgtgtttttaaaatcccactccctccttccacattagctagttattttttttgctaaatatgttttactaaatgtacttagtaaatttaattttttatttttaacaaattccagcttttaatgaagtttacattcttcttacatatttttgaacatatcaatcatagttattctaaaatttatttttgataaccacacttacgagattatgtatgtatctctttcaatttttttaggtttatttttcttgcaggcttggacttttaaaaataaaaacccaggcattttataaaaaatttgtagaaactgtggttgacttattattcacagaaagtgcattctatcgtttggtacatagataacagtgaggactgatcactgtcatttaaatccagggctgagttgactcaaggctaggttggctatttacccctcatttgccctacttgtagagtgtagccctccagaagcttcagccgtacactgaggtgtgtactagggctctttcttatttagtcactccagtttttgtttttcctggaccatagggttttctgtttagatctttaggtttttgtcatatgcactttaagaattaatctcactcttctgtactttattttgctctaggttaatggcctcctacatttccaaaactctgtgtctctctggtttcaaaagactgccaacatctcttttctgagctgtggttctcttcaagatgcttagccttcctccctttggtaagaagtcgcaaatccctcaggggaaaagtgacttctggtcacttaactttgttcttactttcctctgagatgttagcccttccaagatgcctgcgtcagtagttcttgaatgtttcaactatttttttaaatcattattctcccaaagttaatctgtcataatcaaaagcagaattcaagaaattatttattaaatgtctaccgtgtgccatcgcaatgctaactcctataatgcaagggtaatgtgtttacatgtgacatgttttctgattcagggaactaacattcattctactgactgacatcataacacataccacagatggttatgttagagacatacagattatgctgtaggagcttagaggagaggcacttaatgtaccctctaggtgggagtagggaatgtgccccatgagtgtttcctagaggaggcatgactctagaaaggaaagactgaaagttagccataactcctcatctacttgacacaataaaagttgtaagtataccatattaatactgaaaatgtactgctcattgctatttaaaacaagaattcgtttgaaacattaaaaatatgtttgaggatgtaagctagtttcaaaattttaaccatgacaattgatttccccgtaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaaggtaatgcctacatttatttcatgtttatagtgtcagaaatgatggagcaaaacaattatgaatattgttggttcataatcatataggaacttcaggctcacagatggtattttaaatgttctttttccaaatgttcaagttttgattacattattcactttaaaatttgcagttggcttgaagcaatatttatttaaaaaattttctctctagttctgtgaatttaagagaaatctctgcaaattattttttgattataagaaccaatcatatgaaaaatgattttagccctgtgaatatttcttttaatggagatataactgaaaatcctggatattagtgatgtggaaaacctagatccatggaatattggactattcattgtgttgtctacatagatatgttgtcttacatattttcagtttaaaatttcttaagtcttacttttgattaaaattttgtcagcatgtactagaaatgtatttaaatatacatttttaaaatcacatgatcatattattcccatgaaaatttatacatggaaatgggaatatatattgaaaataaacagaactctatacgggacacatatttcattatcataaagaaataaaatttattacaattagggaatagatattgcttaaaacattttatacaaaataaagaatttggatggtaactgaataatattactcaattgatttttattttctctatgtatattatcaaaaaaatcatggattacaaaatgtatccatttggaatatctgtttctatgcttaacatttaaatttgttgtggctactgccctatgtgtaacaaataaattaatcatacccaataatcacagaggataaatttaatcaaatttgttactaaaatttgtgaagtttcttatgttttttggcaccagtgaatatatgttaataaatgtataaatttcaatattactcaaacaacaatatgctaagcccaagataatataaaattatcaattatcaattatttgtatcattgatataaatatgttgatatatttattaacataaatattgatgtataagctatcattaatataatcttatttgactgaatcatcaagcaaaaatatcacattttaggaagaccctttagtgtgggcatgaaacataaataacctgattgttaagaaataattattcttctgtactgatgttccactactatgaattccaagagattacatgtattttatgaatttatttttctggaaagtaaaatgtcctatatattatttctctggaaagatttagaatatcattttaatggtatttaccacagctttattaattagaaaaaacataatctattaacaatatatgtataagcattgtatgttgttttcagttatacacatcagtgaatatctgagtcaatttttaaaatatgaacttaattgtgtaccctggtaaactaggaaaaatctgtttgccacttgattgcattttcacaaaaggcctaaaatggaaccaaccctatttgtaacttactatgtattgccaattttggtagattactgttgttagcctatctcttttttaactcaaatgcaggataggcatttgtaattcatataaattagtactaaacttgttttttttaaatttatttgctgaacatttttttagtgagacagagttctctggatccagaccaaacatggtggtttttcttttaaagttgttaaattctttcttttgcctttgaatcttttcagtatgtagagacaatatgaaatatttaatcaatctcctttgtactgtcccatggtacaggcattctgtgtcactgttacaggattataaaaactgatgctggaatttagccggaattatagccacaaaactttcctgttactttattttctacttacggctgcctctcattctcttgtatcttgaaagtggctaaaaaagattaaattagctttgtatttgaaatcaattgcttaaagaggtaatgtcaagttttatctttccttctcctttgcatccaaacagattcttttatctctggtgaattagtatcacaaccactttttaagaaatcactggagtcagtgaaaaatatctaggatttaatctccattgcattgaacacatcaattatttttaatgttgcaacaaatttataaaataatcagtagttttgctttcctctaacagtggcttctgtttttaggacacgagtttaacagggttaaaagggcttgatattataacaaagataaacaaaatagtgctaatagattttcaagaatgtttgtacatatatacattctgatttttctcttataaattaatatataaggattatgatgttattgttaggatagtgaggccaatgctgccctttgctttacctctttcaaattttatattgttttcattaggcctattgtttttcttgttgattgacaataaagagaaatgaggtctaggtgaactagttatagcaataggaaatattttgagaatgtgtgatgtattacaaatttaagtctattatctctatagtaataaactgaagcatacctctgtcagagtatgagaattgtgctttaaaaagaacggaaagttgttatagatatatttcatcacatgaaagaaacatgaaaatagaagaaagatttttttcatgttgtctgactttccactgactatactaaaggacttacgattacaagaaatttttttttttcaaagccttagattgttacaggagcacagatagaagaaaagtttgttttcctaagcacaacaaacttggaaaataatcattcctattaaattctgtcttctgtccttttatctcctttctcaccatgcagtcttcagaataatctcatttactctcatggtttcaattatcacctacatgcaaatttcttaaaaatccatatctgccctgacctctttctctattctaagcaacagatttatacattcaaatcctagacatctccgtataaacttcatatcaatgatcaatgttgcttctcttcctgagtttaccatctcagaggatggcatcaccaaaatggggattatctgggctactctttaatatcctggcaattccactttatgaacactctaaaaaaatgtcctctgatatcctttacctctcagtttccttttttttttctttttttcttttcttttttctttcttttttttttgaaagagtctggctctgtcaccaagtctggagtgcagtggcgagatcttggctcactgcaacctccacctccgggattcaagtgattcttctgcctccgcctcccaagtagctgggactacaggcatgcaccaccatgcctggctaatttttgtatttttaataaagatgggatttcatcatgttggccaggctggttttgaactcctgacctcaagcgatctacccaccttggcctcccaaagggctgggattacaggcgtgagccactgcgcccggccacctctcactttctttaccactgcagtagcttccaagcagttatcttggcttcctgatttgttttttcaaattcattcttcctttagtttcaaatctgattctatcactcttccacttgaaatctttcaacaactcctcctaacctcagagataaaggatctgtcctggcataaaaacccttccacgacctgatacctacctgtattttcccctttctccttccctcccttccttccttcagtatatatatatatcgatcacttaactatgtgctggtcattatttctggctctatttagagcataaaagtaaacaaggcaaagtgccttctcatgggccctatattttagtcgtggggagacagacaataaacgaacaataaaccaaatatagaatatgttaagtgaggataaatgcaaggaggaagtttttaaaaaatgatggattagtggtatacctagcatactagatactcagaatagatttttttaacatgctatcctctggtctatacaataagattgaataagaatcacacaataaccagtaataattattttttaatttattcctgtaaaacaaaaaatgattaaaacattattttaatgtgaaggatatagctattttcaattttaaacacaaaaattccatgtgatcatacaaaatgacagaattgaagtaattaatattgcttcatgtgctatcattttatctattccaaatcaacttttcacatattggaatctgtagtatcacaagagtggaggcatatgtcgcctatggggaattggaatgaggaatgcctgtagctgaatcagcagttgctgatggcctctatttaactgtagttctgcaagttaactttcctgtagaacacaatgtttattaaagagttggtaataaaaatgggatcattgaaagcttacatatatattactaaaactcaatagcaactatggctattgtttagaatttagactcaccagagaattttttttattttggcagaggacattgtttaggatattagtgatattatttagaattgctagctcatgaaaataagacaaaacagactcactttagtaagttttataatggtttttaaattgtctaaaaagaacacacctttttactttactgcctgcatctgggcttggtgtggggctggaaagggaatagtgtgtgatgatggagtttaggtcctgagcaactcataaaatggggttgtctgaggaccagtgttgggatgcaagaaccaaagcttactgttaggcatgataaatatgagttacccattagacacccaagtgaacataaaagtctggaatttaagaagaaaaatgtggaagccatcatacactgatgatattttaaagtcctaagacatttcccctacccacttatctcatcccacaataagccttccctcctttgaaacacttgttcacatttagtattttacatttgtcatgttgttctgctgatgtatgtgtgtatgtgtttcgtctatttgctgacttcatccattagtgaatataaaaacgtcacatttttcacaatcagtaatttccacctaccccctacctacttgactgtaaccaaatctaacatttctcagtatttcatatttctctgatttgcttcaggagatgctgggaaatggattctctcacacttattcgtttaacactgtgctaagtgttggtgacaatggttccagagcagcatggggttttaagcagagttgctgaactccagcagcctggcttccattttctctggtgcctgcatctgcattcaaagttatactgccaagggtggtggctgccccttcctcctttctcaggtgtcttcctgctaggttaggtgttccttcctttatttttttctgaccaacagaaaagttgtccctgctttttataacatgcctttcagagtttttttcttaagtcagaaccattgacttgcactcacaccattttttttccttttattccatgtgcttctacttaacatcccataaaaatccaagagtaggcctgactcattggaaggttctcggcttcacaatgtgtctggatgtatttaagattctcatcttgttgtagttggtttatttggctggaattctttgttcatagtccattgcttttgctttcctgttcaaccttttgaggatctgcatcagtgcccagttttagtccatatttaatctccctctcatgcagccccatgtctatcaagtctgtgtgtctgtttgtgtccacatacagtccatagttgttaagaatctttctacttagactttgaagggaaaaccttcttggtgcccagagcattctggcacattcttgttaccttgaggtaatgtggctggagttcacaagttggcttaagagatttttatccctgccctatgcctgaattcattcttaaacatcatcttgtattcctaactagagggaagctcctttagtgtacagctttgattttatggtgtttgataccttgcattttcttttttggtttttttttttttttttttttttttttgagacggagtctggctctgtcgcccaggctggagtgcagtggcatgatcttggctcactgcaagctccacctcccgggttcacactattctcctgcctcagccttccaagtagctgggactacaggtgcccgccactatgcctggctaatttttttgtatttttagtagagacggggtttcaccgtgttagccaggatggtcttgatctcctgacctcgtgatccgctggcctcggcctcccaaagtgctggaattacaggcgtgagccaccgcggataccttgcattttctatagcattgagcatgatgtcttgctgattgatatataaaaattaattgcataatcaagttcttaagtcatcaaacaatgaaaaggctgtactttgggagatttttcaattgatgatccagaagattcatcttcaacaattatttattttccaaattaatctctataatatataaaatatgattgctattttatgtatatatacacattaaagatataatggatatacttctctcattgtgcgtaccacattctaaatgtaattatcttttgtgtatccttccctgatcagaaaaagaacttattaacagtgagaatttggtgaaattcaccatcaaatcattgcagcttacacttagctggcacttcgtaaacactgtgcctggcactattcacttttaatgagtaggtgaatgaatgattcagcaaatgaatgaatgaatggattgctgtgtattcatggacatacatagcttttttaattgttaacaaaacactggaaagtgtttttagcttacttttaatactctattatactactcaaataatagtgccataggcctcattttttttttaaatgcaggcaataggcattaatatacaatagaattgttttttaatgactgaacttttggaatactcattgctttcacagaagactaaaatgttctatagatcacatggaactgattttgtaatattctaaacagtatggtaatacagttacacatttgcatatcaacaagctagaagtacatttatagactatgtatatgaatgttagtgtatatatatatgtgtatacatatattaaaatctatatctccatctagctttattaatagattttaagattttttatcttaggaatttatagaattattattaaataaatcaaccaaatactttattgaacttaaaagtattgaaattgcttttggccagttttatatttatcattttctgttgctgtaatttagttatttttatatcagtttctactgtatcttcactccacgtaacatgtttatatcaataagaatgtagatgtcctcatgcatatcttgtgtgatatataaatatccttggaagagatatttattttctactaatccataaagacatgttacctttttttaagattggtcaaagattggtcatttttctactgatgcctgtttttctttctcctttcttttcagtacttctgaaattcctcagttccggctgccgtatgatgtagtgaattttgagattgagctaatgaaggaccttggtgtaaaggtaaatgaaaaaaacacctatctgtgtactgctcaaaaagaaaggagtaagctctacactaaagattaacagcaaatgtcatgcattttaggaaagaacaattaaaagctacatcaggcagaagcagaaagatgcttccccttgcttagggcatttgtctgtctactgtctgaatgccactagcctggaaaagggcaatcaatagttctcatctggcatgcctgcatgtgattaattgtctgtaagaaacaaattcctaaattgctttaggggttcagtgcagctaatagaaggatttggtttctttaatcatgttttttcatgcaagttgtgtgcactctgaaacattagtatttcacaatttggaacataatttcttatggagatttattttatttgttatattcatcatgtcagtagtgtgaatgtgataatcctttctcaacacaagcagtaaatcagtgggatagaaagcaacagcttcgtattttttattattttgttaaataaatattgtgttattcttttcgagatggttgaaaatttgacacatcgttattttcagcatatagctttaaatattcctcttcttttctgttaagagcattatattctagctcttcacttgaacatattgctatttttgtttcaaaaatgttaatttttcataatagatataacacaatagattaataatgtactgtgatttacataatacatgctgtaagtatatgcagaagatactttgaaaagtgattaacaaactactcataccttttgcatttaccagtaaaacttaaaatgaatcaataaaagagaaaacactcaaaaaaatattttgtggtttatatttataattacgttttaattgacagtggccgggtgatgaaacattcacacataatgactaaacaagatgtctgggaataaaaacacatagtatagatttgggcaactttataaaacttaatgttcaaaattacagtgttcaaaatagataatttagaggtgattattttacagaagtacattctgaaaagtttttaaatgtctttcattttgaatacaagttcttctctaaatctcatcaaatatggaaatgattattgaaatttccaactattagattcggtattctgaattgaagatgaatgttcccaacacaaagacatgggaaatgtttgaggtgatgaatatcctaattatcctgatttgatcattacactttctatgcatgtatcaccccataaatatgtaaaattattatatattaataaaaaatgaaaaaagaaattaggctttatttctccatttatcttatataaaattgcaaaattgcattcagttttcacaggaccagatatattgcataaattagagcatacccattactcttatttgaaaactcatcaaggtgcagtagtaggcaatatactgagtgccaagaaatatatcttagctatagtcatgccactttttaattttgtcagatatctttggcaaagtctattaatatctagaacgttgttcaaaatctgctcaaataaaaagtatgctactaatatttgaacaaaatataaaaatatttgtttacatatgcaaagaatatctcagaaagatataagaatctgatagaacagattgcctttgagaaggtgtgggacaattttttcaacattttgtacatttgaattttaaactgtgaatctgttacattattgaggaaaaaaaatggaacctaaattaaagagaaagctaacagtactgtcttgtccatctctcaagctgttttaagatgtgaaggaaatgatgttttcaaatttgctttgtaaacaataaactgtatatacaattctgaggaaagatagcagtgagattccttttcactttgaggatttgtatcctttgatgagatactcttgcagcttttatgatttacgaactttagccataagtgggtacattttgacaaagtggtctgtgctcattacctccttttgaaaagtcatcacggaggttctttttataatttgccttctgtttgtctctctcaactaatatatattttaaagtcaaaaataatttcctggcaatgaaatgaactatttttgtgggttcatactgtttgactcccgtgtagcatatgatgtaagagttctcttatatatgtatgtatgtattttgactttcatgacctagcattatcttgtttattcttctactttctcttttacttcccaaagaggtttatttcatttactcaacaaataattgttcagaacttatttttgccaagtagtatgccaggactagaaccatgtagagccatccttcttttgaactccagtcctgtatacttagtagtttaataagcgtattatcatccaaataacataacctgattatatccagaacccagttcagtttctttatcttcactcccaactatctttttttagctgcatttcctattgaatattttaatttcaatttatcttattagccaatcagtccttgttagttctaagattaattttttaaagtcaaatatcatgttacaagagaataaagataattttgtttgttatttgtacattattcatatttttcttccacaatttcaatatctagtatgttaaaaaaaaaaagaggtataatacatggaattctttttcttgtctctgaaatgggatttttaatcatattgaataaatatttttctagtcttacattaatacattttattaatttaaaaagttaatcaaaagtgtgttaaatttttcaattcccctttgtaaatacttacgttgagtttatatgttgaattatactaatcattgaatttctaaaatttatcaattttggcatcatgtttatttctgtacatgtaattcagattcaattggttagtatttttaaaatttttcttgtgcattcatttatttatgtaatggatattaaaaccagaaatatcgcagggaacagtcaaataatgttgttaccattacaagttttaaatgtgcaaagactttttgttttgttttgctttatttttatttgttgttttgtgaatttttgataatagagttatattagccttataaaattaaacttctaagcattttattattttctcattggtaagaatattatcttgagacatcttttttactaaatttggaagttgtcatcttctccaaaccctcttatgaaatagaactatgaccatttttcttcatatcgtctataagttttttccactgattttattctcgtatcaattttgccaatatatttctagaaaaatttctgcttcattgaggtttttgaatttattagcaaaaatttaagtctactatttcagtatacaataaaaatatgtcatctgtgcctgtgattatatttgctcttgcatctctaaatttcctttgtgttttcctatccagttaatattttctttaaaataaacagttatcaaagttttgttttcttattcattaattgctgactatatatttattaatgctttcccctgctattcttatttgttagtctcttttttaaatttagttttattttattttattttacgttccaggatgcacgtgcaggatgcgtagatttgttacataggtaaacgtgtgacatggtggtttgctgcacctatcaacacatcacctaggtattaagcctcacatgcattagctaattatcctgattctctccctgtccctgccccactcaactggccccagtgtgtgttgttcccctccctgtgtccatgtattctcattgttcagcttccacttgtaagtgagatcatgcagtgtttggttttccatttctgtgttagttttctgaggataatggcttccagctctgtccatgtccctgcaaaggacatgatctaatttttttaatggctgcatagtagtccatggtgtatatgtaccacattttctttatccactatattattgatgggcattttggttgattccatgtctttgctattgtgaataatgctgcagtgaacatacacctgcatgtatctttataacagaatgatctatattcctttgggcatatacccaaaaatgggattgttgggtcaaatagtatttctggttctatgtctttgaggaattgccacactgttttccacatggttgaactaatttatattccactaacagtgtaaaagcatttatatttctccacagcctcgccagcatctgttgtttcttgactttttaataatcaccattctgactggtgtgaaatggtatctcattgtgggtttgatttgcatttctccaatgattgaatgattttgagctttttttcatgtttgtttgttggccacataaatgtctcattttgagaaatgtctgttcatgtcctttacgtaagttttttgtttgtttgtttgtttgtttgagatggaggatggagtctagctctgttacccaggctggagtgcagtggcactatcttggctcacttcaacctctacctcctgggttcaagctgttttcctgcccgagtgtcccaagtagctgggattataggtggctgccaccacacgtggctaatttttttatttgtgttacagatgggattttaccatgttggccaggctggttttgaactcctgatctcaagtgacccgcttgccttagcctcccaaattgctgggattacagacatgagccaccgtgcctggcctcctttgtccactttttaatggggttggtttttttcttgtaaatttgtttaagttccttgtagattctggacattagacctttgtcagatggatagattccaaaaattttctcccattctgtaggttgcctcttcactctgatgatagtttcttttgctgtgcagaagctcttttgtttaattaaatctcatctgtcaatttttgcttttgtgcaggtgcttttgatgttttcatgatgaaatctttgcccgtgcctatgtcctgaatggtatttcctagattttcttctagagttttatagttttgggttttatatgtaagtcttttttttttttttttttttttttttttgagacagagtctcgctctgtcgcccaggctggagtgcagtggcgcgatctcggctcactgcaagctccgcctcccaggttcacgccattctcctgcctcagcctcccgagtagctgggactacaggctcccgctaccacgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggcctatatgtaagtctttaatccatcttgagttaatttttgtataaggtgtaaggaaggggtctagtttcaattttctgcatatggctagccagctttcccagcaccatttattaaatagggaatcctttccccattgcttgtttttgtcaggtttgtcaaagaccagatggttgtattgtgtggtcttatttctgagatctctgttctgttccattggtctatgtgtttatttttttccagtaccatgctgttttggttactgcagccttatagtatagtttgaagtcgggtagcatgatgcctccagttttgttcttttggcttaggattgtcttggctatatgggctcttttttggttccatatgaattttaaagtagttttttctaactctgtgaggaatgtcaatggtagtttaatgggaatagcattgaatgtataaattgcttcgggcaggatgcctattgtcatattaattattcttattcatgagcatggagtatttttccttttgtttgtgccctctctgatttctttgagcagtgatttgtagttcttcttgaagaggtttttcactttccttgttagttgtatttctaggtattttattctctttgtagcagttgtgaatgggagttcattcatgatttggttctctgcttattgttggtgtataggaatgctagtggtttttgcacgctgactttgtatcctgagactttgcagaagttgcttatcaacttaacctattgggctgatcaatggggctttctagatatgggatcatgtcatctgcaaacaggcagttcgacttcctcttttcctatttgaatactctttatttctgtcttttgcctgattgccctggccagagcttccaatactgtgttgaaatggagtggtgagagaggatatccttgtcttatgccagttttcaaggggaatgcttccagcttttgcccatttggtatgatattggctgtgggtttattgtaaatggcttttattattttgaggtatgttcatcaatacctagtttattgagaattttttaacaggaaaggatattgaattttatcaaaggacttttctgcatctattgagataatcatgtgtttttttctttatttctctttatgtgatgagttacatttattaatttgcatatgttgaaccagccttgcacctagggatgaagccaacttgattgtgatggataagctttttatatgctgctgaatttcatttgccagcattttattgaggatttttgcatcaatgttcatcagggatattggcctgaagttttctctttttgttgtatctctgccaggttttggtatcaggatgatgctggcctgataaaatgagttagggagaagtcccttgttttcaattgtttgaaatagtttcagaagaaatggtaccagcttctatttgtaattctggtagaattcagctgtaaatccatctggccctgagctttttttggttggtaggctatttattactgcttcaatttcagaacttgttattggtctattcagggattcaacttcttccttgttcagccttgggagggtgtatgtgtccaggaatttatccatttcttctagactttctagtttatttgcatagaaatgtttataatattcttcgatgcttgtttgtatttctgtgggttcagtggtgatatcccctttatcattttttattgtttctatttgattcttctcttttttcttcattagtctacctattggtgtgtgtgtatatatatatatatttttttttcaaaaaaccagctcccggattcattcatttttttgaaggatttttcgtgtctctatctccttcagttccgctcttggagttatatggcacttactctcaaatcgatcacataattggaagtaaaacactcctcagcaaatgcaaaacaactgaaataataactaacagtctcttaggccacagcacaatcaaattagaactcaagattaagaaactcactcagaaccacgcaattggaaattgaacaacttgctcctgtatgactcctgggtaaacaatgaaattaaggcagaactcaggaagttctttgaaaccagtgagaacaaagagacaatgtaccagaatctctgggatgctgctaaagcagtgttaagagggaaatttacagcgctaaatgccacttcagaaagctagaaaggtctcacattgacaccctaccataacaactaaaagaactagacaagcaagagaaaaatatccacaaagctagcagaagacaagaaataagcaagatcagagtggaacttatttgttatttgctgtaaaatcttgagttgtaaacttacttcattttcattttatagattgaataatgaaaacatttaaagttattagtttcagaaaaatctttgtcagcatccatgtgttttcattattttattatttttatttttcttcagaaagtaggtttttttcccccgtgtagacaacagttatgtaggatagtattttcatttgcttctgtattcttgtgatataattcattattttttcactttattagccatatttgcattttttaaatttatcaagcatactctcaattgattttacaccaaaggatcatttatagtgtaataaaattgggtattccctttaggagaaatggcttcttagctgatgtttatttatacctttttttgtaatgcaactcagaatttaaatagaaatacatatttttgtttcatggtctttatatcctaatttttcaaagttaaaagtataaaatatgaatgaagatattgcatttttgcatatttaaaatatgtatatttgtcatttcccaaagtattctgatagaattctaattgattaccttaatttgtaatttctatacatttcttctgcttcgtagttttagatgaaatatctaatagaggtattacctttttcttaataacctcttataacatcttgttttcactatggttatttgaaccaataatatctgtgattatgagatagtattagaaaataaatataaaatcatattatttctctcccacaaggaaacatgtacactaatagctaataaataattttcatttctaaagatagctaaatactttcaaaatttcttcattttattttctatcttagagcatctggaaatatttggtctatttaaccaaattttctattagacaactgtgaagagtatgtatgtttttatttgatttttaaaaataatgggcatcacctattttatttgaagatttatactccacaaaaaagttgtcagcctttatcctgcataataaatgttactatgtatatgaatacatattatagtatataaagaaagttttcatcaaatccctaagagactattagatggaactttggctcagggtatatgacattcagaactgctggaataaagtagtgactattacactgaacttgaaatagattgaatttgtattccgaatttaggtaggaaatatctaataatatgttactaaagtcattagaggaaggtagaatgtatatctaagaaaatcaagatggaaatattacatatgtaaaagtacaaggaataaagaaacaaaaacaccaaacaaaatgcccgtaatatgatttttctagcatcatatatatttaacaaataacattgagatttcatagcttatcagccaacatgatgttcctgatagctgtagttgtcttgcaattccagttttagttaacacacatttcatttcaatttcccaaagcataatgtaagcaaagctttacttttgttgtcaaggaatctttcttctaattctttctaagaatagattatttcttgcatggcaaatatttggggcctcaggcttttaggaaagggaaatttgaataggttcccattcacaaaaaggaaggaagccttgtgcctgtcactgcttggaatgttcttgttatggctttgtcctcatttctaccagggatctgctgcccagtgatgaccatcctccatctttcccacaatgtctgttcatggtaaagtcaagtcttgctggtctccatcccagtagattcacaccaagatcaagatactcatctttgcagctttccatacatgaaaggaaaactcaactgttttctatccccatttgcacactattgtgtattagagtagaatcagactgtataaatacagaatgagcatctttcttatatattacaaaatcaaagacattttcactctgctgtggtggaagaattgggatgtctttattcctctttgataaatcacaaaaagctactattaaactaaactattgtgccttctcccacaaatacccacctcaaaaaggatgggaggtcttcttgaatcttcctgcagaggcactgaataaagtaaacctaagattaagtattttgagaatcacctccaccaattaattcattggcatggcattccagtgctcaactttgaaaatggcatacttactcagtttgctaatattctattagaatgtttggacctggtgttttcttttatgtctaacctttattatatattggtatgaagggtatttgattcataaaacaaacagcgaaattatttttctttttcaataaaatatgtattatttaaaagttagaataaattaaagttctaaagcctcactattagatgattttaatagcatcgaattctactaattctaatagtaatactattacttactataaaatgctttgaataatacatatttaattaatgttccagtttaatgttttttgatacattccagagttctgaatattcgttattaatctcaccttggttgtccccttattataaactttctgacagttaccatatctgccaatataaaaacagaattactattttaggaagacaaaacattgccctctatgatccagttccagtcatattctcctctccaacttcttgctccattgcttgctttgcactttatattcttgaaacacaacctttttagtaggtcttcacgtataatatgctgttctttgtccttgaggatggtgccagctctgccctctaacctcaagaggcacaagagcacagcaattatgcatgttggctctgaaattagactatgtatttgactgcaataaaggttatgtaagctctcttgtcctttagtatcattatctgtaaaatgaaaatactgataacacttcatggggctgctgtggggattaaatgagtcagtatatgcagtacttagaagagagctttacacttaggtgcactattcagtgtagctgtaattaccagttcatgggtatacattgctcttcttctatgactcagcttaagggctttgtttttaggaacattttgccttcagaacacaaagaaacctaccaggcattgtgcttccttctatatggcaggaaatgtgagatgcagctctatttgtcttttactttcaaggggacttactggcacatacttgataactggatctctaaacttcactcaagaggccagtccctgattatagagttcatcttccacccactggagtgcagatatcttaacagtttccagcatattcaccacctctttttcatgctgtctgatctgcctgatgtcgtcaaggtaatgaatcactgtgacgttctgtgggatgtccagatcgcttcagattacatatattattactgaaaagagttgacatatccctaaggcaaaactgtaaatgaatattcttatctatactctgtgactctgaactatttctgatctccttctgtaattggagtggaaggagtatgcatttgccaaatcaatggccacatgcagtctatgtgtggccttataaaacttctctagcaataataccacatctgtaacagaaactgcaatcaggactactctttagttaagcctgcagacatttatagtcatcctccagaaattctctggtgttggcaggggacaggctggtggattaaatggggatatgacagggaccactaacatctctccccatcccattgcacccaggataggatattatctttgatttagtctcttggctggattttcagatattttcatgtggccttcccaactatgatagcttttatagctcttacttcacagaccagagacccaatgtagggattacttcaattgacaaatgtaacaatttcaattatgctcttagagactaggagaacgatcactaactgagttgtggtttcagtgggcccactgtgaactagacttcagtcaggctccattttttacctcaccctgtaagtacccactcttatgtttccaagtatcagtattactgaagaaccagtgcttaatagtccttgaaatgtctgatcattcccctttttccagggcttagttgcttggataaatgaccatagtttcctttgggaaaggactaggggaatcacagtacttacttgtagggatgtttcagggtctttcttcctagggaccctgacacctccctggtcagcaggttccagaagtgaaaattatctcatgtctgggaactgaccaagcattgtgacttttactaggggtgactaccctctgcttcctgactttattcattttcccttgacactgtccgttatcaaaatcctgtcttttccttttaaaggccctattgaaatcccacttctctgtattctcaaccttctaagcttagctaaaatgaatctccccagcctctgaactctcatacacatgtggtgatcatagcttgttttatgttacatttatttgtgtatatcttttgcccctacttgactgtacattgatgctggaaatgtgtcttatttatcgtcttattatttaaatgccccacatcgtgctttgaacatattatgcaagctatggaagtttactgatggttttaatgacactggcttttcttctgcatttagcccttaatagaacatgttcctgttctatttatatactattttgtgtatgtaaacctatatactaaaagacaaaaatgttgtcacattttatatggaatctcatagaatttttggctgacttttcattctttttgatgttaaatattaagattttaattaatcatatgccaaattttcttatgcaaaatattgtttcttatagataatttgcggtaaaagcctttcagtgaatgaaatgactcttagcactttgaaagaaaaaggctacaaagctgctttcattggaataggtgagtagtttactcttaaatatatttatttataatgtatttttttatttcctagcaatatccagaagaatgactgccttcagacattttcgtgatgaaagttatatttgttcagggaataacagatagaaatgattggccaagtaactaaatttctattttataagtaggagtgctgtttcaccttaattatggagagatttcggcaagatgtttatcttcccattctttcaccacaccatcatcaccagtgagaatctctaggaagaaaatattttcaagtcataccaccagaaactcagaatctgtctagaggctgtagctttctttttatgataaaaacaattgattaaagtgatcataaaggatggagttggctcgttccctttgctattcattttccaaaattttctaaagacttttcttatttggttgaattttttaaatgtttcatcagtgttctgaaagtcccatagacagtgtattactcctgaggcactcactgtatactgttttctcatattttgcctaaatatgttatggagaatgagttttctaacatttttcttccacttagtgtttactgagagaccagagagaacaagtaagttggcttgacttagtctttgcctcatgaatgtcatattcattctctgatatgatttgtactatgggcaattacggcatataaatggagtatgttaaatcggggtccccaaactcggggccacgaactagtactatactgttaggaacctggtcacacagcaggaggtgaatagtgggcaagcgagcattactgcctgagctctgcatcctgtcagatcagcattagattagattagaatctaatggcattaaattatcataggagtgcaaactctattgtgaactgggcatgcgaaggatctaagttgcatgctccttatgagaatctgtaactaatgcctgattatctgaggtggaacagtttcatcctgataccatcctctttctccaacccggtccatggaaaaattttcttccatgaaactggtccttggtgccaaaaaggttggggaccactgtgttaaattgttactcatttttaatataaactcatcgtcctgtattttactttgtctgtctcttcggcagttcacactcagaatatgaagttcgaaataatatctctttaagtgatcacacactgagtaatgtttgttttgcagctgtcctttttcattgcctttctgaagtgcagtcatcattaatgcttctttgtctactaaacttttcttatcaaaatgccatttctaagaccatgcctgtcagcccctttatttaggcaaaaaattatggaaagcaatataaatttacactgtcttctagctcctaaatgtctcaactgaacctccttcctttcagaaaattttgggtgccattgtcattagtatctgtctgtatgatcttaattacaatattatatttattgtgtatatcaaaagtaggaaggaggcaagatctgatattttccctgggttctatttttaggcatactatatttgactttagctttacttttcaacattacatttgtattgataatttaatgtaaagaaattgggcaggtgtctgtaagttccaattactctcaataaacacatgatcaaaaatgcttggtcagtaataagtgaaaaatttcatcaggctttaggtctgcaatactaataatgttatcaaataactatttgaaattcaccaatgtactaaaagatatgttttccattatttgagtatatactaatacaattattaatacatgtatctgtaagaacttcatctacaaagaatctttgtactgaaggaatatggaccaataaaataaccaatacattgaaatatccaaattaattacataagcaaattattccaaaaatgtggaataattaaattgtttatcactctgagtagttataaccacgaaacaccttctaactgaaataatcaatagtgtttcagctttttaatttaattttatactattaagtccccttaagtatattatttgataatgctatactggttcacaatacagttgtctccatttgactctgcactgaggtgtgaatacagcatttagaatgtagagtcctttcatatttatgtgctgtgcattttcatgctgagaagtgaatctttgacattttggtgtagtgatgtgaggaatgcagttatgctctatttcagtattttgtatgaaacatatacgagaaaaatttcatcatgtcaaaaagaaaagcttcagtctgtggaagacaagtagccgtattctctaggaaatgtttatttgacactcatgagtgtcgatttgggaatttatgacctttgtattaccatataactggcggttacttggacagccacacaaccttacatgtttttgttcattaaccttgcttccatattgtaattaaacattactcacttattttatctaccctttctcactgattttgtaggaggaaatgtagaataggaattccatattatttaggatatacatttgggcagtttcagaaaacaatagagggtaaaacaatataaacgtttagttctttctcatgtaacaatgtaagccattttcaaacctgaattccgtctttggtctgtgggtagttaccatgttcacattcatgctaatagaagtgggaaagagggaagcagctccttcagtcttatatttatgagccggaagttacacaaatcaattcttctttcatctcattgtctgttacctgatcatataagcatggcaacagcagagggtgctgggaagtattgccttttgctgggtggacataatccccatcaaacgtctagaatcatagggaaaggggatgacagatattgagagaggatagaaatgaaagtctctgttacaggtgtgcatcatcattagtatttgacacaggagatcagtaaagtacttagtagcaaagaaaacactcttagtacctggtgcatacatgttggttacataggtagtttttaaaaatggagatggtaggccaggcgtggtggctcacacctgtaatcccagcactttgggaggccgaggcgggtggatcatgaggtcaagagatcgagaccatcctggccaacatggtgaaaccccgtctctactaaaaatacaaaaattagctgggtgtggtggtgtgcacctgtaatcccagctacttgggaggctgaagcaggagaatcgcttcaaccggggaggtggaggttgcagtgagccgagatctcaccactgcactccagcctcctgacagagcaagactccgtctacaaaaaaaaaaaaaaagagatactttctctttctgtagttggaaatgccatagttattaatcttatgtgtttataactactatcttattctacgttagattgtgtaaaataaaaaatatttttaattaactatgacataatgaagatagctcattaagcccattgtattaagtcaagtctgttcacatgtttcctgattttaactatagtgcatgatattgctcatgaaaagtctctcatttttagagttttctctaatactaccacagtccaaggaaattatctcattgaatgtacatcattgttacttctaaagacttatgtctcttgaaccatgagaagtttagcttcttctaagtactgagataaagccctatgtcttattcaaaattagtctgttatcttcacagtaattgagtcattgttaaagactctaaagttttggtggttttactgaaatcagagcacctggacagcatgttactgaaaatattgagacgtagaattggaacatctactatacaaggcttttaaaaaatattggatggctctctttgtttggtattgaaattgacataataggttacaaccattgtttcttcctttttattttataaaaataaccagaaaataatagaatagaacatatcaaagtgtgttggctatggttagggcaagtgttattttgtgaaaaatgtttttcacctgtgtgtatgtgtgtttgatgtgtgtgcttgcacgttcacactgcattaaaataaaatgtattttttaaatatggctctagttaaagtttgatagccaatgctatacaatgtaagggctctgatggactaaacacctttttcccatagtatactcaacacctatcaataagtagctattagtgagttaaataagtattgaattactacaatcaatgtcccaaacactgtgctaagaatttaaaaaacaataaagaaatctgaattcgttgtttaggttggtattaaattgagtcagaaatatcataagacattcaaaaagaacaaccatattgcacaatttcaggagtgggacgtagtgtggtagacgggctggacatgggtatagttcctttttttttttttaaagttctgtgggtaattttattctagagccaggtttaagagtcactgttatagataactgaagagatggacccttcgtctttgttttaaagaagcccatttatttttctctttctgattgttcatcttctgatagttttcatctcatagcctcataaaacatgatagtgccaaaaaggttaaacaagcatgcaagggaaagaacatccagtaagacacatttaggtaactgatcaaactttatatgttcttctgccaagtttttctttctttgaatttttgtttttagaatgcatgagaaagaaggggctaaggggaaaatgcagtgaaatcaattataatagtcacagtagacactacgaaacaggaactacaggaaggtgttgtagagatgaatagtctttttcaacaccaagtgctttacttgtgtccacccaaaagattttccttgaacttacttcttgctaccaccactcccctcacttaatgccactgggatactgctatggcctcaaccagtctctttggccaccactgttcacacaacaaaagtagtaatcatgctgaaatcagatctgatcattattcctcactaaaactcttccatagctccatatttccttccagataaagaaaagtccccacgaaggttttcaaggctcttcttgatttggtcacagctatgtctctagtcacttctcctattaaattatgtgattcagccattctgaactgtttttagttttaccttatctgaagttttttaacctcaagttttggacatggacctagagctatctttgttttcatatttgtgttcttgacttcgatgctttttttctatttgatacaattattttacttgtgatgatctactccctaccttcatactttagcctggattaatgaatcatcttcctcaccccccaccccacacaaactctgtgttcctgctctctatgttcagactggactttttactgtagtatagcacttcttcaccttctttattataattcactagttacatgtttgtttccaccactagaagttaagcttcttaaagactgtagattctgtctgctttcttcattgacagatgtttggtgcctagcaaagtggcgggtacatagtaggaactttatacgtatttttagttattgattttaaaatgcaactcttttgactgttttccaaaataaagtaaatttataggttgcttaacaaagttggcaattttggagtattataacattgcccaaacccagggggaatacattttacattattataattttggtattacactattccaagtaggaatagtgatattagcagtggtgatattggtaataatagcagtaacagtgaataatattccaggctcaattcttaacatgatctatccttttaactcttaaaatggtccttgatgtcgatattcttaacactctttgatgggtaagaaaattaagactatcaaaggtaacagaaaagaagtaaatggcaactaaagcatggaaagtgagttttataaagaaagtaaaaaaaaaaataacaagtgcaaatatccatacttcaattgtgactcaaagccaacatgactctgtctacatttcagcatctcacttaagattcttgaagagggtaagctgatactcaagaagaattagtctttatatttagcctcatttttctcattgttatcacaaattggttttcttttagttaccatcagaaaataatatttttttaaatgtgaagattcccaaatattataacagacaaataacagataattataatttaaaaaatccatcgagagattgtggtattaaatttgctacagagtggcctttagttaaatctctcatgccttcacaaagccagaattattctctataaaagttattcttaattggcttcttaatcaggaatttttaaattgtacatagttgtgtatactttctatttattcagaggaaaatgcaattaagtttttagaccatttgctttacttctgtccccagataaaaatgtaaattgtttagtcactatccacaactatgaatagattattttaaaaaataaacctgacttaattttaagcaaaaagcaagtcttgagtattttgccaatctactttttttaatttgtaatattgtttaatctactgtcacttgtaagtacttcggtgtaattgtaaaatggctcccaagattttggaaatgagggaaatagaattccagctgagagttcattaaatcattacttaatgagttcatgcaaagccccagaaggagataaaatagatgtagggcaattattctttgatcatattaacatatctatagaaagcacatattaatctgcagaagcaggcaatgggggctggtcatctttagaagtattgaggaagaaaaggaacctgcagaaatatcagcaatattgacagtggctcttttaaggcacctgaatcaatggaccgggagttctttgagcccaggtcgtaagatagacagagaagtctattttagagacctctgaatcttcttgttctgattccaagctcaccaaactgccactgattcctaaatagtttgattatgggagatgagcgtgggaaggggaggttgccgtgaggtgagatggttccactgcactccagcctggatgacagagtgaggcaccatctcaaaaaaaaaaaaaaaataatagataaatacgtaaataaataaataaaaagaaaagacaaaaaaagaagacaaaagaaaagaaaagaaaagtttattctgtgttcatatataatgaaatatatgtcatttatagtatatagttttccttttgtcatttttggttgtgtgcatatatccctcccctgtcacccacacaaacacagtatattaaacatttatgagagttggtgttggtttttatccttgaattgcataatttcagcacatttcttaacacataatacaacatcaataaagttttttgaagttaagtaattggaaaaagaaaaaaaagaaacaatggaagaaatgaaaagcaatgtaataacttgttgagaaattttgagattatacttgattacttcactgcttaaaattcatgcatctttccaagcatcctcttttatctttttttgtttttgacaaaatgcaaagacatattcattagttctgattaatgactcaaagccactcttaagtcattcctactttgatgccttataattatgtcaagtattacattactgtgctgaatatcagatattttctttaagtatttttggttaatttttaatggtagtactcgctagggtatttaatgagcgttttgtgatgaagatgatgatataaggaaatgttttttaaaatcatggctttttctactcgtagaagtctttacatgttgtagatgatcaataaatatctgttgaagtattgattaattattaactctaattaaccctattaactcatgatgtcttccgtattattgtaaaaaaggagataatttattaatcactaaggttattttaacattatacagcttatattctttttattttaaaaaaccttttataaaacacaaattatattttaaaatattttatcttctttgcatttaccttctttgtgtttatcttctttgtatttctttggatggagacatggaggaatttttattatatttttctatatatgtttcatggaataaagacatattttacttatggtagttacctaaattagagaagtaaaacagttctttttggtattttcattgtttaagcattaattttcttttagtagtttccaatggtttaattaactcttaaagtgaagttgataagagaattggaaaattactgaactaagaaaaatgttgtctttcaactgctatttatggctgccagttacattttttgtgggagataattatcatttgaacctggaaggggttattagtgaacatatactatgggtattatcttagtcttgctgggctgctatgccaaaatagcatagactgggtggcttcaataacaaacatttattttctcacaattctggaggctagaagtctgagatcagaatgccagcatggctgggttctggtgaaggccctcttcctggcttgaagatgtctgccttctccctgtgtgttcctatggcctttccttggtttatccgcatggaaagagaaagacctctgacgtttcttctttctataagggcactaatcccatgatgggggccccaccttcatgagtttaactaaaactaattacatcccaaaggccccatctccaagtaccatcatgtttgagattagggcttcagcatatgacatttgtccttaggatcatcatgatgttttgttttgttttacgtttggtaatcatactataggtctgcattgtcctctaaaggtagaatattgatgttgaaggataaattttaggatacttaacaaaattagaagttactgagatagtggatattgtcaagaagacttttggaacatcacagtacacaacccttcccctccgcccactgtaattcaatgaagctaaatgtggagaattcaagactacattgtattcatgtgcacagtacacagtggttttcaaatagagctaggagatgtactgttggatagctattttcacactacaaaccacacagctcttatcttacgaatcgctgctatgtaaagtttggtgaactgaagaagacatacacagaagaaaagaggggttagtaagagaaaaggaaaatggcatggaaatggcagggattgatgcaagttggaggaaactaggcatatttccatatatgatatatatttctttctagaacaatcttaccaaagtacagaaatgtgaaattttgggggataatttatgttttatccgttccttatttcctgtttattccagttaagctatgccatctttcgttagcaggattaaagtgatctaataatctctttctctgtcatttaaacagcttttttgactttaagtgcttaacacctgtatactctaaagcaagaccaaagcttttaagggactgcattaaatattttaagtaaatctattttagaagcaatgcaattgaaatttatatcaaatcagtttttcttcagatcttgcctttgaatggcttaagaggtgtccaaaacagtcatattgttcccaccttcccaaatacaatctagtttggttatattacttttctatttcttaaactcatattacttagtactgttataagttatgtcaggaatttatgggaaaaacaatactgcaagaatgattacaatatgaagtcagaaacataaactcttaaaatgcattattaagcattaatactgtggacatctaagaaagttttatttttaaaacaacgttttgacttatttactttcctatctcaaaatatgtaaggaatcttgatgtgtgttgtcatcttctgattaaccatgcagtgccacctggtgtgcagatggaaagaacattacacatcagaggctctgttcacacccacccccaccatacacaaacttacatggcagaaagttaacagatgttcattttgcttttgttactgagatacgttgtgcatccaactcttaattcataagttaaatttggagattaagatattggtatttgggttaatcagtcaaagattatattaatacatccattatgagaataaagtaatatttaattggaaaattgctgctttggatctttaaagtcttattttgtgtttctattctttcctttttttaaaaaaaatacttggtagttttgtctattgagccttatcatttatattttactaataaatttatcattcctagaatactgtagtttaaaactgattgctatttaatttctccctggttaagtttccattttacaggaaaaaatagcccttcttttgtctttggagattgtatcacagtcaggtatttttccacttctcttactcttttaatgccactgttggttgatcacattttaaagttggttgatcatatttttaagcttctgcaatatacctagcagtgtgctagcaattatatgttacagaaaaattaaagaggttattatatatttagaaaagtaattaatgcattttaaaaataagaactttgtgcatataaatataataaatagaatagctacatttattgagttctgtgcaaagtcatgtttaattctcacaaagtaattttggattggtattattcatatctctattttacatttatgtaaatggtgtctaacagatattaagtaaccttctcaagtactagaacctggatttaactgaggtccctctgaaaccaaagccctactcttggctaatacattaagttggcagaatttaatcattttttaaaatttatttatgctttcttaaaaaatattttaaattaattcttttttaaaaattgtggtaagtacacatagcataaaatataccaccttcatcatctttaagtgaatagtgggattaagtacattcacatcgttgtgcaaccatcagcactattcatccacagaactcttttcatcttgcaaaactgaaactatacctattaagcaacaaatctatgaatttgactattctatgtacctagtatgggtggaatcatacattatatattttgtgtgtgaatggcttatttcacttagcataatgtctcaaccttcattcatgttgtagcatgtgtcacaattttattcttttttaagactgaataattttttatgtatatatcacattttgtttaacattaatcaatcaatggacattggatggtttctgacttttggatattgggaataatgctcccacaaacataggttatacagatatttctttgagtccttgatttcatctcttttggccacacatccatatgtggaattgctagataatttggcaactctgtttaactttttgaggagccaacatactgtttccaaagtagctacaccattttatatttcatcaacagtgaaaaaaagttccagtttcttcacatcatcgccaacatttgctagtttgtttttgtgtgttttttgatagtagctatcctaatggatgtaagtagtatataatgatttttcatttgcttttcatttgcagcctgcttgttaccaacagaaacttgcagtgataatatatagataaaaaaaatttttaagtatataaacatatgattaatcaacaagatgaattagaaaataagaacctctcctataaaaattaaatggcattcacattttttgatattttgagggcctcaattagattatatgccaaagggatgaagatagagggccaaattcagcatgaagaccagttttgaattggcaaattatagagaggactattaagagatagcaaaatatcttatatttaaatttctaactaataaagtgagttgtctacaaaatttgtctataaatgaacagatatcaaatattttgtatgttgtgggctgtatggtctcttttgtagatattcagctctttacatttgtagtatgaaagcagtcttagagtatatgtaaacaaatgaatatggctatgtgccaataaaactttatttaaaaaaatgagtagcagggcggatttgctcagcagatgatgcaccaaaaaattacttaagaacattagttgcttatattttcttcttgttttaagaaaaaacattttaagtggaaatctagttgaaatataaatcaagtgaacttttgtctaatagaacctgacttgttttgcatgcatgcatctgtttgtggaatttaagaacaacaacataggtagcagaagagatagctatccctgattattttgtactagaactttaaaatagctgaatttttgtgaaaccccccatggtgagaaaccaaccttgcttctcactccttaattactgttttagcaaatagcttatttgaaaggtgtatccaaaaatatgttttcctgataccatgcttgtgttattttttttaaatattactaacacaagctgctgtttttatttctaaagtgtagtgttttgtccttttaaagtacatcttcaataaataactttatacttgattttgtaatcaaagaaaaaaaacacacacacacaaccaagaattaaaacacagaaggggccaggtagggtagttcatgcctgtaatcccagcattttgggagggtgaggcaggaggatcgcctgaggccaagagttccagaccagcctgggcaacatagcaagaccttatctctacaaaaagaaaaaattcgccatgcagagtgggatgtacctattcaataggctgaagtgggagaatcacttgagcccaggaggtcaaggctgcaatgagccgtgattgtgccactgaactccagcctaggtgacagagtgagattctggttctgaaaataaaataaaataaaataaatcacagaaggaataaatgagaactgaaattagtttctgtgaagtgactgatggttctgaaagtatatcttaaacactattaatgaatggttttatttttcacatcaatttttgataacttaagaaaaaagaaaatatacatatacaaaaaaatttatcttagcctctaggctaggacttctataaaacctctttaacttttccttttcactttattgttctgcctctggattcttcatgatgaattctaacaattagcacctattgacttcagccaggaaataacaaaaagccatccagagcatagttccttttattcaaggtgctcagggcagtacagtggaattattttagaagatgtccttaactttttatgcaagcatattcatcatcttgctatgaataacaaataagtacacatttgttatgtagcaaaatttgttaaaaaccataggaaaagtattactgataaattaattaaagatagactcatctgaatactgaataagaaaaatacctggatattgaatagaatttgtgatttttcttcatttagaagataatgtgattaggtagaaatgcattcttttgtggtggatcaaaacatgttagttcaaaatctgtttgatctattgtaaaaatttattaaattcaagactgactaattcaattttttattccttttgccttaaactggattcagattggcctttgtgatacttagaaaaacacaaaaagaaaaagcaaaaataaaaacaacaatgtgaaaaaagattgataatgaaaaatactattgttattttatgggaggcatgatcacttattatattaatgtctatttgtaattactaaaatataaacattttaagtatatggactcaaattattttctaaagcaaaccactctggcacagtcaagtaaatacattattgggattttgtgtgcatgtttgttttcctctcctgttgactgtagaaatatttggttaatggagtactctagggcaagttgaatcaatgttatgtttgtgccttttttcccattctaatgtggttttggtagctatattactagaatttctgacagaaacattctgggtgataatacgagatcatatggggcttagaaaagacagagtattaatctctagtgattgatccatctgtgaggttttctgttacagtggtagagaccgaaatgtgttagacttttagtggtaaagcaatcttatgtttttctgcaactgctttccactatatttaagtatgctctcttttcccctgtgtatgtgtgtgtgcgtgcatgtgttctagcttccagccttttacaacttatagtcattttttctgaaaactggaagcttgaggtggcagagtaaggaaaaactaaaattcataaaggcagcattatcttaaagttattttcactcgaagacccttgtttctgtaggatcagaaagcagcctaaaatcaacgagttatatgagaagcaaaattccctaaagaggttaaaggttttggactactaagacctctaataagaggaagcaaaataaggcagtgactaagaaaacttttgacttatagtttttatacccaaggtataaaactaatgtatagttatatatatattatgtagatatacaatatatgcatgtatatttgtgtgtgttttacttaattatgccctcacaaccttaaaatactatttgaaatagtactttaagctatagtttaaagtactaaactcatagctatacatatatatgtacacacacacatatatatgttttgaatagttttatacctatagctatatatatatacacacacatacacacatatatatgcacatacacacacatatatatgccctcatgaccttaaaatcctatttgaaaaatctaatatttataagtttccttagaatccaactttatcattgataaaatatcaacagtcatgtgcttaaagtagtaataaaataaattatcttcattctcataattttaataatgctaaggatttcacccacattaatgcttatataacttcatttactcattcagtaaataccaagttcctgatctgtgattaatgtgaccttgttatcaagaggcttacagttttgggggagacagacatgtaaatattttctaatctgtgactttgactattccttttttcccacaatatataacacaatataagagcatccaaaaaattttgctcacttacatgtatatatttctattcattcatcctagactataagcctctgtaggaaaaggataattcaggagacatgctggggcagggattaggagtgcacccagatacagggaatgtcatatgtaacagctctatattcttgctagagttttcacttccagagacgtgtgctgacaaatagggacaaacacaaaccaggaccagattcaggagacttcacatggcaatgcaaatgtgtttagttatctgtagttattgagtgtttactttgtgctgtggaaaatgaaggattttgatgtgagaggtaagagattagtgagataggtttggtcgcactgtgaaaatggtttggagaagagcaagaccagcactgggtgatttttacattgtggctattggaataattcaagcaagagaaaattgaggaccaaaggtagggctgcaagagctgagagcaggaaacaaacataaggaaatacaatgaatgagtcttggttactgattagatactgttagtgaaggacaggagtcagaaggagaaggcagggtaaagatctaagaaataggtacaagtcgggatgttttcaacacttcttttgaccaaataaatggatggtggtgacaattacccaataaaataaaataaggggagattatgagatctttcctgacttcttacgtttgagattccttgtgacaacctggtggaaatatccaggaagctcttaggtgtacctgattagttctggggaaataatatgagaagtgtgggcaggagaggtagatttggtatccttggctgtggcaaatgatgctagtggcagtatctcctcgctatttgctagtatgaatcttgaagctagttaaatgcaatcagtatgttatagttcatgattgttgggagtaatagaaataatataaactaccttttcactgaaattggcacacagtaagatgccatggcattgacgagattacatatttagttttcataaccaccctatgcagaacgagaaaaaattatagcccagtgaaactgtgtgactaccaattccacagagtgtgatattcacacacactgaaatgaataggctctaattccgtatctaagaatattatttcaacatgatttattcatagtgtgttttggtgttgccattgccccatccttattttcaccagatcatatattagatgaatctgtgtggctagagggattttcatgataatagggcaaaaaaaggttagtccacatgatgactaacttttgttagcactcttttttgtttttgtttttgttttgagacagagtctcgatctgtcgcccaggctggagtgcagtggtgcgatctcagctcactgcaaactctgcctcctggattccagccattctcctgcctcagcttcccgaatagctgggattacaggcacgtgccaccacgcctggctaatttttttgtatttttagtagagatggagtttctccatgttggccaggatggtctcgatctctggacctcgtcatttgcccgcctcagcctcccaaagtgagcactgtgttttaatatcagctgtttgatgtacacagctggtattcatgaatactattgagcctgctaaagagttgacttggggccaggtgcggtggctgacacctgtaatcccagcattttgggaggccgaggcgggtggatcatgaggtcaggagatcgagagaccatcctggctaacatggtgaaaccccatctctactaaaaatacaaaaaattagccggatgtggtggctggtgcctgtagtcccagctactagggagattgagacaggagaatggcgtgaacctgggaggcggaggttgcagtgagctggagccgggatcatgccactgcactccagcctgggcgacggagcgagactccgtaaaaaaaaaaaaaaaaaaaaaaaaagttgacttggaaatactaaatatttcctatgtgtgaaaatatatactttttaaaataaaacttgatattatgtgtgtatatgtgtatatacacgtgtgtatgtatgtatatacatatttaaaaagagatgaatgggagaagaaaatcttttacttaaaaatattagattggggagttttaaaaagcaaatttccttaacattaattaacatatagcttgttttacaaaagctgatgaagatttatttcatagatgcatgttcatcataaaagtgatatgtaaattcattccctttttcttactaaccaataaagttattctgcaagagaaatttcaatatttattgtaatttgattgactttaagtttgcttcttccatagagctttgttcctggatttctatatattttttttattttatcaaagcgtagtatatgtcttaacacatttaaaaattatcttattttggcaagtatcaactagatgggtctctaaaattaactttttcccatagtcacagttaaatattgtattctcctaaagtaggggaggaaaatatgcattatgcattatggaaacataacatcagtcctcctcgattctatatgtttccataatgccgaataattgaacatatggtctctaccattgtaggctaattggtatacacacaagaaaatgagggggaaggaggtggagagaacactgtaggcaagtctttgatcttgggatttatgtttaccctcttcaaatgaatttgtaataatgagttcattacaactctaatatgtatacctacatatatgctatatgttaaatcaaatgagcatatatttttaaacataactggcattatgctaaattatttctcctctaatatgtaataggacagaaccagaaacccaaacctgtggttttctcaaacttccatggtacctcatacaataattatggagaggtaaatcatgatacagtggcttaagggagaagaagaggtgagagtttgtcagttgggttttgttttcctaatatagaaatataaacacattttatggcaagataaagaagtgagtagaaaacagatgtttgagatgataattaaatttaagcggggagtgagcaaaacaggaagagaccagaaaagaagaacataggcagaaatgttcgcttttgaaagttgaaaggatattttttttcccattgacacaaaaatagtgaagacagaaaaagttctaaggtggaacatgtcagccaagtgagttcactttgctttagcctcttcttagtgaagtagtaaggttttatttactcctttgagtaggaaggctttactagaatctaaaggttggtggggaggggtgaagagagagagagaaagaaccttgagtcctctccaggaacacacagaacagaaagtgataagtagtgtgaagaaactgtatgacatagtagagaagtatatacaagggacattacattgttaattaattttacatttatgatgggtcttaatactagtttacatttatggggtggaaggaagcaaagaataaataaagcattttattttaacagagggaacaactagggatgatacctttattgaacattagttttattgtttataattaagataaaagtaatatattttgtactttttacaatgaaattagtgattatttatcaaatggatattctaggaaacctacaaaattatcaccccttcaagcatatataaataaaatcaacaaacacacaaagctggtttgagccagttttatccagctataaataatactcaggttgtaattaattgctttgaaaagaagttaatcctatcaggtcattaaataaccccattagtaaattattgtgacaagcatattagttgttaaatacaagaacagtagcattttagcaaattgttagtccttagcagctacttttattttgcttaaatatagtgatagaaccaaccaccatgccattacagagtattactattggaaagaatatagggcattttctgagttgaaagttgaagatgaattcacctgtaagcatattatgctatgtgcactgggtttatttcaaaatcagatgaccatatgaatatacaatactcatatacagtaaggtggaaattgaagaaatgaaggtgaatgtgaagaaacaaaagaaagcaagaaaatgtatgtatgactcgatgaagggcaatgtaatttagcattcattcaaaaacttttgagttcttatactatgtgcacttttaaaaatttcaggtaaacttcacagcattacatgaataaaatagcaagttgaaaaatttaacttgctgttttgaggaatgaagtaattcattttaagctaagctttcaactttagttgaaggaagaagtgagtactgatttctgttaaagacttaattagccatgtattaaagaacaatagttcaatatacatggcatggaaaatactccccattatggattgatatttttaaactgtaactgttcagagcaatacagataatcaaataatatccatcactgaatatgttgagctgataccactcttatacaaatgtacagactgtatttataatctaaaaattatcattgaaagctttcccttgaatttccagactgccaatttataagcagcctggttggacatatgtaattatatcaaatttatatattcattctaccagcatttactatggtctgtctaggtacctgttattacgcattcaatgaaggggaaaacatttttcttgacttcacaaagatcagagattcattgggtgtaaagtaacataattacaacaaaatatggtaataacataagtagtgatagagagattcccagagagttgtgggcgcacaatgggtaggtccaacattcctgggatgacttttaagtgtgaggatgtgtattgggtcagggagggagccatagaaaacttcctagaagaagtggtgtctttactgagttgcaaagatgattaggagttaacaggaaaagagaagttagagggagaaggtttttttctgaaagatggttccagagagccaggtgttcagtgaactagcattataaacctctagtgtttctggatctgtgacagtccaattttttagtctttaggctgaagtgtaaggcaagaagcaagtcatacagtcatagagggcttgttagtaggttagaaaagttgggcatttattctactgaatacgaaaagtgatgaaaaggttttatgcagtgtaggctttctgggtagatgatgaatttaaaagtgatgagactggacatgtggagatgggctggacagaggttatacagtgcaggagagtgatgattagagattgaacttgggcaaatgctgaagtaattaattattatttaagtctaaattcttaggtcttttttccttataatttaatatcaggaactttaatgagaacattaaaaaataaaccactagtaagaagctgttcgaattacacgatgttttaaatttatgtggcttagtgttttcaatgttgtatttatccctatgtacatataatcaaatctaaccattatcataaaagtcaaaataattattttcaacctaataaagctatattttcccagtattgacattgtagaaatgatgtattttgatcagcatttgcagattatgtaagattattcctataattggtttcaaagcattttctcatatttatctccttgaatattaaacctcattaggaaatatatatttagatatgcagagaagactaatttataaaactaaaacataaaactaatttaagtgtgtaatagagcattaacagccattgaattctagtataaccaaacaagatattttcttgttgttttggcttatttgctgcaaactgtaggtactatctgtagaataaaactagtactcatgaacagaaacaagcaactgaataccttttaatttcagtagttgtgttcctataggtctatttcaactatctattggtctcaaaagtgtttgaattttcatgtgaaattcaaacgcaaaagctgctgtttgctttaatgattattcaggaataattctaattagcaaatctgtggttccattgtttctagtgcatggtctctgagaagaatttcagaaactaccagtcttcaacattttctgctagttatataataaatatatttctaattggaacacgttattgatgttgaattatcagttttctgataccgttattaagataaaaattgcagcataaactgttatttctagacgcccgtggttcctttgttagggaatcatcttttatcagatatatttatgactacaagaagatggatggttgttcatttacacacaatgtattaaaaataaaaccagttgcttagtcagtaatggcaagagaatgtgttttcactgattgagaggagatcattcaacaatgtcaaaaaataatttgctttatattacatttgcccataaaaaatattgacaactttataagtcataagagtgaggcagctgatgggcaagactgcatgttttagaatttggaaatttaatttaaaaatacaaattttaatattctttataatttttagtgaataaatatctacagaaagtcataactcattttgttttccctaatccttgcttactggcaggctaattgaacagtgaaggtcctaaagaatacaggctgggcacagtggctcatgcctgtaatcctagcactttaggaggccgaggtgggtggattacctgaggttgagagttcaaggcgagcctggccaacgtggtgaaaccccatctctactaaaaatacaaaatattagctgggtgcagtggcttgcacctgtaatcccagctactgtggaggctaaggcaggagaatcgcttgaacctggtagatagaggttgtggtgagctgagatcatgctgctgcactccagcctgggctacaaagtgaaactgcatccaaaaaaaaaaaaaaaaaaaatacaatcatgcagcagagttaagaaattgcagttgagttttgaatcaagcccaagttcattcttggaatattgaccatttatagtaagcaaagtcacacctggaaatagatctcatagatccagtcagtcttttgaaaaaaaaaaaaataaaaaattcctaagcattgagacaaagtatgatacaatttatcgatggaaattcttctttataaaattagtttaatgaggatttcatttaaaaatggcagaccaaatgcaagtgtatctctatatcctgtcctggattgtcacaaaaatgaaagcaacaggatttgtcaaaaatcataagcccagaaggaaaaaaagaatagaaaggagcagaaatgacaacattttggaagttgaaaagcagatggctacatgaggttggacttagcagacccaagaaagctaaatccttaaccagactggagaagtatcataatgtgtactactgaacctacttaaggtttcaagattggtagtaccaggtagctgtggaaataagagtgaagacaaggccaaaaaatagggaatttatgaagagtgtattaaaaaaagtagctagaccccttgattccctcattcatcttgagtagcttgagaattctgttgttcagtaaagaggataaacccaatgtctagaccagaggacacaagacagaaagatcttccgtgaaaagaaggggattagtgaatttctgcatgctacaagtggagaacattattctccttcttcttgctgggctgccagaacaactgctccgtaggtagaatatgacagtttggcttggttatttgttgcataagatgtgttgttgtgaattataagattgctagttactggaaaatggtacatttagatttacaaataaaaatggaaatatgacaaaattagagctcaggaaatgtaggtattttgaaaagtcactcttgtcttctaagcctttatttctacgtaataaataatgatgttctttagcagttatattattaaaaagtaaaaagtaaagtgtgtccttctttttagtttcctaggcatgctaacccttttcatcctgatttctcccaaaacagtgaaagctaaatgactcaaaaagaacctttaacgtcaatatttctgttaactggctcacaacacaagctaacatgagttcattcaaatttatatcaaatgtgtacagtttttaaagtttttgtttcccttggttggggcggggtggaggcagagtcttctgcagcagtgctttgtgtattcctatgcttgttattctaatttgattgcttctgctataaaaagactgtttttaagtattttaacttttattgttgtcaccaaaattttaatttccttgtccaagctgaattttagaaatcaacttgtttaagcaaaagcaaagcaaaacaaaacaaatttaactccataggaaattacttctattactttggatctgggaagctggatgtatttcagcaggcagcagtggaaggaacttgcaaaaagcatcttctgagagctgaaacagcagtcacaaatgtgtctcgctctatttgaggcttaacagagtaggagagctaagcttcaagagaccatgtcttagcctctaaggaaaaagatgtacatacttttgtgtgagctgtgcagtaattttaaaaatcagatccatgacacttcattgtgggatcccagaggattttgttcattttcagaattcctcttcactaaattaattgccaaagtttttttcttaggaaatgcaagggtcaagtatgcttgtgtatattcaagtaggtcacaacagttagaaaactatttctgttgtggtagctgatatggtttggctgtgtcctcacccaaacctcatcttgaattgtagttcccataattcctacatgttgtgagagggacggggtgggagataattgaatcatggaggcggtttccccatactgttcttgtggttatgaataagtctcacaagatctgatggttttataagggaaacccttttctctttgttctcattctctcttgccaccaccatgtaagacatacttttcatctgctgctgattgtgaggcctccccagccacatggaactgcgagctcagtccacatggaactgcgattccatttttctttataaattacccagtctcaggtatatgtttatcggcagcatgaaagcagactaataccatagtcatttttattgactattttcacgttatttttaattattatttaccatttaatagtatgtctttatttttataaaggacatttctgacaaatagaacaatgtagtgatcaaattattctttctattggtatgcttttgctgcttatgtcaaataatatgtattggagattctatacagaaagattatatacaatagaatacctcacataatcgtgaaaatatatggaaatatatattactttattataactccctgaacttttatgaatattaaagggtcccataatgaaatcttgtatcttttgtgaaatcactataaaaattatattatattggtcagtaaatctttatatattggctgatgtcatagaattccttaaagaatttagtgataggaaaatagtttggctcctaatgagtcagtaagctttctttcatcagatattgatttctaataatttcattttacttcaatgcaaaaaatctcagggttaatttcagtgctcaatcattgtaattatctatccatcatattagattatttcaaatgcgttatggaagcaggacagtgtatatttatagctacatattctgtaatctatttggccctgtgcaattctgtgaatggcatctttacttaactcgttaatttttgagattgttgggttggctaagataaggtgggggttataaactgtagagacaccttgataagttattgtgcacatgtatggagagcacacgcacaatattgatcactgctagatacaaagttcagacttcaacagagatctgattctgatttttctccatcactcttcagtctatactcacagtttcataattaaagccttattatttcgtataaggaccataccttatgtttatcctttgttaaatgtgtgtgtgtgtttatgtatgtgtgtctggaaggatagaattttatcgttattactcatttaacacttagtacaaaaatattgcagacccttccctataaaaaggtgagaggagaaggtagggagaatagaagagaaggaaaagggggacactggtctcatgaaaatataaaaagacaagaaaaattatcatgagaatacaaagacaacagaatataagacaactaagaaattgacattttggctgggcgtggtgtctcacacctgtaatcccagcactttgggaggccgaggcgggcagatcacgaggtcaggagacagagaccatcctggccaacatggtgaaaccctgtctctactaaaaatacaaaaatgagctggacgtgttggcacgtgcctgtaatcccagctactcgggaggctgaggcaggagaatcgcttgaacccgggagtcggaggttgcagtgagctgagatggcaccactgcactccagcctggcaacagagaaagactgtctcaaaataaaaaaaaaaaaaaaaaggagaaagaaacaaactgaaattctgactatgaaaggccacttttacctgattccattctttcatttaatgatttgtcagatttttgaaaggtattatttgtccatgcactatacttgtccttcggtaaagaatttaggcatactctcttcccagagatgctcataggtgtttaaggggaaaaatattattgtagtgacgtacaaagggaggacagagaagatagataaatgaccatctagggggttgagtctttaatctggaggggtgggagtatgttagatagaaaaattgaagcaggatcatcactggcagataaagtggtgtccaccataacacggagacttgaaagaagagggcgatttggaaaactgtgatacttatgggatggcatatgcctaggaagcatgctgagggaggcagagagtaaataacagtagataggacatgagggtaggagacaaataaacaattatgggtcatatacccgaggttaagaagtttacagagtttagatttatcctagagacagtgaaaaagcatctgagtttcttgattgatatcataggaaactgccttaggcctaccatgctcaggatcttcaccatataaaatactgcaatagaaatgtccctcacccttccgccctcaaattaaaattatgtgggttttgttgagacctgaatgaaatcttgataatatgctttgcttttagcttttcttatttactctgaattcttcagatctttttctggaaaattctcctgcacaaattcacataatgtttattataaatttactgggaagggggccatatccatgtgtaaagttattagcactataccttaatgggagacagattgtgaataatcagtaatgataccaattcataatgatgaaacagaatatttataaactatttcctttttattcaattgcgtggccatttctagtttatgaattcattatcaggtcagattttaagtgaatgttagctttatgttcttataggttaggagatgttagtcaaagaggatgaataacatgagaattttttaagagaaaatgaaagtgatttctaaaattctcttttgcagcatctgtactcttgagctgtttttaaggcagtaaagcaatctagattaaatcagttgtcctttttttaggttatatgactatttatagaatgaatatagtgactcatgatccgtaagatcatcttgatttcttgtattataaattgatcattctctattatttatttacttagagaataaaaaaaaatgagaaagattttacagttgtctctcactttgttccattttctttttgtgggcttaaaaattatagtaggtagataaattgcctttctttggcttctgaaatgattttaatagcttaagctaaattaaaaaatatatctctgaatctttgttctagcaatttgatgtgttagatattaaatatattcatagaaaaagagcttatgttataaatttattattattgtgtacctaattttaaatgcctattatgactgcatttatttggcatttttaaaatctggtttgatttagctcctgataaagcatattgaattcagaaaatataataccatttaggattttttgctgcaaaatctattacgctgtaggaggtttcacatttccagaatggaagcagtaagttttgtggggtcagggtgtaaccagtgaatgaaagatgaaagtcagaactcaaaatgaagtgccttttctgtttaacactgggcactgatagaaaatgataatgtttgattaatgaacggcagccttgcagcgggtgaaaacatctgcaagaagtgatttattatttcaaaggtattggaagcttgcagtatcttgccgatttaggtatgtgtgcctgaataaaataaatgagatgcaacatgtgaaaaatgaaaacacattacttgtaaaggatgtgtcacaagcagggtatttttgttcaagtacactttgtcatggggatttttaatgctgttctgaatacaaatcatttagctggttcataaaatcgcctcagttggaattcttgcatctatcatccaagacataaatgtgggttaaacttaatgtggtgtaacatatccttaaatgttcaaattttgtatcatatacaactattaaaattgtacatgttttatgtataaagatgaataaattatagctacttaaaataacggtgcccaaagagaaacaaggtttgaggtcttaattgaacactcatcaaatactcagagctaaggcttttcactgcagctattgtggctagacatttgaataatctatcattttatgattgaacaatttttagttaggtgacatgttatatgacaaataatagaatataatgaagggaatggtactatcttaagtactaatatttaagctctcctgtgtgtgtgtgtgtgtgtgtatacacaccttgaattattcactgtggaaacagataagatttaaatttttttcaaggaacaagtaaactgataatattcataataggaatgataaagaatgtgaaaataaacttggaataatctatattagagttatgccctagggactactaattccttcttttgtggtttatgagatgtttctatctgtttgtttaacttgcctctaaaatgcccttttgtgaagttgggtgttgtaattatgagcaagctcctctccagatcaacagaatttaggaaaatataatcaccatcataaactaaaatctatgggaaaaacatgtcttttttaaaatttgaaaatttcaaattgtgtgcgtaattgttaataacttagaaactgaattggagcaaggtttaggtatctcttttgaccattgttgccttaggtcttagcataaaactaaatcttcactaaatgttttgttgaatgattgaatacattacaagattagaagaggaaacattgttcttagcagttttgctcctttttctactggagtaatggagaacctgttctatgccagggaaagagctgcacttgaaatatgacagtaaagaggatagagtccttgttctagaggagctcctagcctttgggagacagacattcagtacaacacatcacataatgaaacactttgaaaagcagaaatgtaaggggctatgagggtgcattctaagggaacatcccctaagtggagggaggagggatcctgcaagctgagttttgagagaacaaagaaaagaagcagtggcaggagatggtagatagctaggttgggaagtgaaatgatcagatttgcatttggaaaaagaattactctgtcggcctcggtggatggcagagtagagttgggaaaccttttaagaggctatagcaaggggggctgttaataagaacaggaggtaatacattgaattctaatctatccaggcatacaaatctttgccaactatggaacctcagtgtttcgcctgtgtcccagtttctgttttcttccaggaatggtcatggcttaaaaataagagtgtctttcatcattactttttggaacttcctacttccctttcttatattaaactttcaaatatgcgagtcttaattatcatttaagttaaacacagtggtattcttctgacaataacacagttccagtaagattttatgttttccaagttttgacttcactaaaatgtgaagaaaaaatattattttattatcaaagagaaatacatgattaattgtagtatgagcagatttaagcaaactaattgttatttccaaccacaaaatcattcaagatagaaaaagaaacatattttaagtaacttattcatgtacagatagtatcataagtaggatgataaatatgaacaagatttaaaaacgcatttataaaaagaatttctacaacctttttattttctaaaatttgctaaccctcactgtcaggaatatttcactcatcttttgtgctatcagataaatccagtttttaaatggaaatagtcatgatcaccttgagagctccttatgtagctgaaaatctttattaaattgatttttagtatttacttctctaggctgaataattacagttccaattaattaaagactaaaaattgcttcctcaattacactgcaatatgtaggcaaacataggaaaatataaaccttcttgatttaggagttttttagagctccttgcttagatgttaaatattaatgtagcctaacatgcttaacatcaaaggacatatagagatttgttcttcttactaattatgtagatataacatatgtaaaacaaaattaagatctgggtgtacttactacaaatataatacgaatttagattcaatataggacactgagggtctatagaggatcttctaaggggaatcttctctgactgaaatgaggtaacagtagccgtatgcttatacatagtttctaagagtcttccattccaagtgattatgattaaaaagttacttaacaattctttgttctatttttttaaagttaattatgaataatcatataatttgcctcacaggactgagaggattaaatgatttcacacagcgaaaatgcttagaataatgcctggcataaaacaaatgcttaacatgtgttagctattattataatgtattcttacctttcaatagtgaataaaactgcgtgtctttataggagaaatcagtgtctttcctagttctgattccacttttacttgatttctctttttttttaataaagtgttttcttttagtaactatttctaaacctcattgtcaaaatactaattttaaccataatcatataacaggaaatccaggtttattccccaagtatttagcttcctatcaaacacatgacatagtatctattgagatgatccacaaacaccaaattgcctgtaagtaacacggtctacctgactgggtccacttttaccttagttttaagtcagtttgcttataatgtcttagacatttactctaagccccagagtgatttccatagtcatactttctaaggttagatgttctagatgatgactgcttgattgaatccatatttagtctcactatctagattccttaccatgattatagtgaggctatcagtatggttttctgattgccagaccaaaactatgacaattgactcaaactatcacctaataatgcttgcacttaaatccagacttgacattcagtaggcttattatgactacaaggttcctttcaataataactttctgtgtttctgtaaggctgtagccaaggtgaaagttaatgaaaatctgatttggtagtagcagcaggaatgaatttaagaagatggatgagagagaaagggcagagttgagtcatcagtaattggcaaaatatcagatgtatgagttgggaaaaactagaagagactctgcagttagtaactttttattttagtagctcctttttggacataattttggttatcatacagccttgacagtttagtgatcttaatattttattaggaaaaacttcaaatatgaagtaattttatatatctgttttctcagaagttatacaattatacaaagatactatgcagatataatatggtttgataacaagtcagtaattagagataatctttttagctcattcagagaaattataaagataaaatatttttgaatgaaattatgctcaatattattttattatacattgtatatatatttcccttcaaaaacatatgtgattttggatttaaagttgtctgcttttagtaaaacactcacgctggataaatatttattacattagaataaaaactgtatattatactggttctgttattgttcttattattgttttcttcatgatctcctacatgttatttcaacccaagagaatttatctttcatttctaatcagatagacatttggctctgtactcatctccccatcactttgggccaccaaatataagattacttataagaaaatgtataaatgttaaaatttaagaatatatgtgtatttaaatttttattggtggaaaggacaccaaaatatttaaacttatattttctagtaagctagttcccatttctccttaaagtcaacagccatatcaaaaaatgcatttttttaggaaatcagaaaacaaatacaagtggtatattctgatgtaatttaggagcttccagagctgatgaaatcaggcaataactacaggtgagaaagtgcaaataagtattttagagtcttgggaaacccaggaatggtatcagatacaagggcactttgttcttctttaaatggatgggtatgggaactgagatgagcaatgctggtgaggggaagaaacaacagcaaccaagagctttctgaacttgattttgttcagaaaaacagagtaggtgaaactactcaagtaatccagtacaaataagccatatttgcaagtagtgtcctatccctgtggcagcaagaaaggagagaactctgtccctcaccataaccacctctgcaggaacatcctgcaaataaccaattaagcaaagttagctcattacatgatgagtaataagatattctcatggcattaaaagaaaaatactacagaaaatttatggaaaagaggcaattaatttaccaagagataagcatactttccaaaaaaaattgcaatggaacataaagaaaataacaaaacattttgaattttatttaaaagaagaaaacttaatcttgtattaccatgagtgttttgaaaaccataaagcataagcctcagaacaaaataagaaaaaataggaaatagaaagtgagttgacaaaatataaaagaagatgtgcgttcaaacaacataatcactaaaataaagacacaatgggaggagcataagaatgaataaagatagcaaagccctgtagaggacatctgatatggaaaggaggaaaatgaaaaaaaaaataaaaagaagatacagataaaagtaaagaatagggagagaaaataataaccaaaggaaacaatcaaagcagattcaacatatgcataattggagtacttcaggaggattctgcactgcactggaacagaatatgtatttgaaactataatacaaaaaatatttttgtgtgaaatgaaatgtttgaaattgtactttgaaaagacttgccctgggatgctttagacagaaatatcctaggaaaacttttgtattttacaaaataaaacttccttggacatatagggaaaatgatcaagtcatactgaagagaaaatattagactggctttacactcctcacagcatcattctgtaacagaaaacactgaaaccaaacttacaagatatttagagaaataaagtgtgagccaagtatttgatattcagctaagattttcttcaaatatagaatctacaagtaatttctcagaactcaggaaagattgttttttggagactgttcttggtgaaactgttagagaaaaactttagtaagattggggctcaaaattattgtacacagatcaacagcttttatatatgcaaacagtaacccatcagaagatgtagtaaggaaagaccatatttataagaacaacaaaagttaaattattttgttataaacctaacatatcattaagcctcatgaattaaaataatatagcattagatcatgaaaacatatattaacagaacagattaaaaaaacagaaacagacacaaatgcatacagagatttagaatatttaaaaagtagcatttgaaatcagtgtagaaaagacaagttatttcttacatggcattgatataactgggatatcctctgtaatggagttggatccattcactaagataaaataatatatttcacaaaaaaggaaattaaaatgacttctaaacttttgaagagatgctcaacttcacacataataaaagaagtgtaactcaacactccctgacctaccattttatctatcacactgacaaattgttgacgagggtacaaggaaatagacactcctatacaattattatataaaaccatcaattccacctcttggaaattacatacatgaaacaatgtgtctaaaagcttattaactgcactactgtttataatagcaaagtaatggaaacaacctaaatgtccatcaagaaaaactaggtagtaactgataaataagttacagcgtattcatgcaatagaatactgtaagttttaaaaatattaaagatctttaaatactgatggggaaatatctctaagatggaacagtactgggaagaaagttgatgtaaaaccatatatattataatttgcataaaaaagtaaaatttttcttgtgtatgcattaaaaaattatagacacaaggctacccaagaaaacttaagatagaggagacaacagtgaagggtcacttttcatggtgtatatttttatatcttatctttgcatatgtgaatatattaattattccagaatgtatgtgtgaaatatttgacattaaaaacatgtaaaattggccaggtgcggtggctcatgcctgtaatcccagcactttgggaggctgaggtgggcagatcatgaggtcaggagtttgagaccagcctggccaatgtggtgataccctgtttctactaaaaatacaaaaaaaaaaaacaaaaacaaaaaacaaaaaacaagctagctgtgtgtggtggtgctcgcctggagtcccagctacttgggaggctgaggcaggagaatctctggaatccaagaggcggaggttgcagtgagccaagattgtgacactgcacttcagacagggcaatagatggagactctgtctcaaaacaaacaaacaaacaaaaatggaaaattcactttataatgtattaccatctgatgtatatactcaaattatttgcaacatatagttacctgaaaccaagggtcagaaagcgatggcaagaatttttaacatgatcttttggtagatatataaaattacagttttatttttattaatcattggagattgaaaagcttgaaattttcttttccaagttcccccatatacagacatagcattcaatacagatgttttctgtggttctcagtagaagacttctgtgtagaaaaccattgcagtgagctcaaataaaggatgattctttttttttcagattttaaaaatacaattttcttttttttattatactttaagttctaggttgcatgtgcagaacgtgcaggtttgttacataggtacacacgtgccatggtggtttgctgaacccatcaatccctcatctacattaggtatttctcctaatgctatccctcccctagccccccaacccctgacaggccctggtgtgtgatgttcccctccctgcgtccatgtgttctcattgttcaactcccacttatgagtgagaacatgcagtgttcggttttctgttactgtgttagtttgctgagaatgatggtttccagcttcatccatgtccctgcaaaggacatgaactcatccttttttatggctgcatagtattccatggtgtatatgtgccacattttctttatccagtctatcattgatggccatttgggttggtttcaagtctttgctattgtaaacagtgccacaataaatatacatgtgcatgtgtctatagtagaatgatttatcatcctttgggtatatacccagtaatgggattgctgggtcaaatggtatttccagttcttgatacttgaggaattgtcacactgtcatccacaatggttgaactaatttacattcccaccaacagtgtaaaagtgttcctatttctccacatcctctccagaatctgttgtttcctgactttttaatgattgccattctaactggcatgagatagtatctcattgtgattttgatttatattactgtaatgaccagggatgatgagctttttttcatatgcttgttagccacataaatgtcttcttttgagaagtgtctgttcttatcctttgcccactttttgatggggttgtttgcttatttcttataaatttgtttaagttccttgtagtttctggatattagccctttgtcagatggatagattacaaaaaaattctcctattctgtaggtcacctgttcattggtgatagtttcttttgctgtgcagaagttctttagtttaattagatcccatttgtcaattttgggttttgttgccattgcttttggtgttttagtcatgaagtctttgtccatgcctatgtcctgaatggtattgcctaggttttcttctagggtttttatggttttagattttatatttcggtctttaatccatcttttaaatttaatgtaacttaatttaatttaatttaatttaatttaattttattattattatacttcaagttttagggtacatgtgcacaatgtgcaggttagttacatatgtatacatgtgccatgctggtgtgctgcagccattaactcgtcatttagcattaggtatatctcctaaagctatccctcccccctccccccaccccacaacagtccccagagtgtgatgttccccttcctgtgtccatgtgttctcattgttcaattcccacctatgagtgagaacatgcggtgtttggttttttgttcttgcgatagtttactgagaatgatgatttccatcttgagctaatttttgtaaaaggtgtaaggaaggaatccagtttcagttttctgcatatggctagccagttttcccaacaacatttattaaataaggaatcctttccccatttcttgtttttgtcaggtttgtcaaagatcagatggttgtagatgtgtggcattatttctgaggcctctgttctgttccattggtctatatatctgtgttggtaccagtaccatgctgttttggttactgtagccctgtagtatagtttgaagtcaggtagcatgatgcctccagctttgttcttcatgcttaatgttttcttggctatacttactcttttttagttccatatgaaatttaacaatttttttttctatgaagaaagtcaatggtagcttgatgaggatcgcactgaatctgtaaactttgggctctatggccattttcaccatattgattcttcctctccatgagcatggaatgtttttccatttgattgtgtcctctcatttccttgagcagtggtttatagttctccttgaggaggtccttcacaccccttgtaatttgtattcctaggtattttattctctttgtagcagttgtgaatgagagttcactcatgatttgtctcttggtttgtctgttattggtgtataagaatgcttgtgatttttgcacattgatttttgtatcctgagactttgctgaatttgcttatcagcttaaggagattttgggctgagacgatggggttttctaaatatacaatcatgtcatctgcaaacagggacaatttgacttcctcttttcctaattgaataccctttatttctttctcttgcctgattgccctggccagaacttccaatactgtgttgaataggagtggtgagagagggcatccttgtcttctactggttttcaaagggaatggttccagcttttgcccattcagtgtgatattgactgtaggtttatcataaactgctcttattattttgagatacgttccatcaatacctaggttattgagagtttttagcatgaagtggtgttgaattttatcgaaagccctttctgcatctattgagataatcatgtggctttttgtcattggttctgtttatgtgatggattatgtaggaaatgaaagcggaactggaaaatatcaggagtagaagtaaaatctttctttatttggtggttagaaagtcttttatatctgatctgtcactttttgtttcttctatctccatccccttcctttcctctgcacctttatatgtgctcattatatatgtctccaaaagaagttctcagtcctgtactttgcaccagatttcagccaaattgcccactacgcactgtgtacaatatctgggtggatttgtcagaaatcaggaactagattaggcgttcatcccccatctaatcaactgtgtataaagaaatgatcatttggtatgttcccccatgcaagcctgaggacagtctcagcagtgccatatagcttttacactccatccatgtgccagacaggtagtcatatccttcatctaagaaaaactgggagcctatggctcccttttcaaattgaagaggaaaagtttatgctagaagaattttatgctagaaggcccacccattaaaatcatagcaggcaagaataaacaaattacttatactaaatgtcatatcttggtgcctcaagcaacagggccaagtatgagtcatgcttttcttctatcactgttttggcctctgtgacttttctattgaagtgaccattttttttcacccaggggaaatttttatgagggaccacttgtgtaaaggggcaggaacttcatggcagtagcagttgtggaaaactcaggctctgtcccaccttttgcccatctttcagggaaagccctcaagcctgttaattcatggtgtggttacataacttacaattacagactctaataatctaacagaaagtaaataaattgccgggcacagtggctcacacctataatcccagcactgtgggaggcttcagtgggaggatcacctcaagtcaggagtttgagaccagcctgaccaacatggtgaaaccccacctctactaaaaatacaaaaattagctggtcatggtagcaagtgcctctaatcccagttacgcaggaggctgaggcaggagaactgcttgaacctgggaggcggagtttgcagtgagctgagatggtgccattgcactccagcctgagagagagactccgtcaaaaataaaaaataaataaaaataaaagaaaataaaagaaatttgtaagtaaaaatgcttctacaagaagctggaagcaataataaaaaaaaatcttaaatgcaacaattggatttggaaaatgccattttcttagaagttttttcttaaaaacaaatcgaagaatttgtaccctttaaatctgtaagtcactacgtaacttgacttcattagtatgtatttaaacattttaatgagttgtcagttatatatgaagactagacagatagattttctgatgtctgattaactttgggttgcttttgttttgaaaattaacttcatatttgtgatatggcaaaaacaccatttctgccccattgtttcagttaagttgagtagaataaaggccagctttcacaagattgttaatcagtgtcactcagaaaccatgttgtcttgaataggcatgttctgcgtcatctgttcatacacatgcgtttgaggatctaatttgaccatgtattttaaaaaaattggtattaaagcctccatagtagtttcttgaattaacaatgagataattggaatcaatgttttatctgaaaatcttatttctttgtttacctaccaattatatgaaattaagttcacatacacacacccttataacgctgaaggacccagcttcatagactatttataagattggggtcttgtttttaatgagaccattgattatttgatatagcacatcaccttaattatcactaggaaggagatttttaaaaacctctagtaaattaaactcttatttatacttttaaaaatgcatagtgcttacattttttttccaaaatttatataagtaagaaaaatataagatgaaggaaagcaactgaaaatacacacacaaaataacagttaatagtgaatagagtacaataatttttttcagtgtctgagccatggagcggtagaaaacaaaaggtaatagaatattatttttaatttagtacacacacatattttgtaataatggcattatcaataacagtaagcaatagaatttattaactgtttacatatatataccaatcatctataatgtatttttaagtcattattgcaatcctgagaatagtcttatttctgttttgtatatagagacaccaagattatttaaaactgtgtgccttacagttagcaaatgggtagtgctggttgaatgcaacccagtgtctgtatatcttctgcctcatcaactgcctacaaagaagatttgccttactacactgctgatgggtaacaatgcaggactgttctgtggctaaaaatatgtttttaaagcttcaaaaatatatattgaaaccgttatgataccatctccaaatgatatggtttggatgtttatcccatccaaatcttatgttgaaatgtggtcctcattgttagagttggggcttagtgggaggtgtttgaatcatgggactagatccctcatgaatagcttggcattgtccttgcattgagtgagttctcaccctgtaagttcacatgagacctggtttttaagaagagcccgacacttcctcctttctctcttgctctctctctcaccgtgtgacataccagctccccctcccttctgccacgattgtaagtctactgaggcctcactagaagccaaacagatatgagtgccatgttagtacagcctgcattggcaaataaacttcttttctttataaattacacagtctcaggtactcctttatagcaatgcaaaatggactaagtcatccaatatgaagattttctctcactcaataccaggagctttcaacttaattcttgaattttcataatggcttagtctatatgatcaataataaagagttggtaagcttgttgatggccattaatttagaaagtagcttctcctaggtgacataatgatttgccacaagtacccacatgtgcaaaaacatctgtgtcttattctgtcaggcatggcttcccagggcatagttctctgtggaaataaatgagagcataacttcaggggatgtgccaatgtacatatgtctgtgtgcctctcttgaccaaatcctggtatgctgagctgacagtgagggtttttaccctcactgtatgtacattttgaaaatgttatgcatgtgattctcatctgtaaaaccttctgccttccagatgaaaacttgttctcttccttggtctcaacaaattggaaacacaagttctagacttgtcaaggccaaggaagagagcaagttttatgagaacaccattaatatttaatgttacatgagatacagtacatgtgcttagagtgaacaccaagggctcatcaggcaaattcagagaaatgatgctgggcacaacgtattgcatttagcgcacccttcaagcaaaagagaccttgtcaacaaaaggtcttggtttatctgttctctattccatcctttcagaatgatccttagtatagatttgcacaaaatccatcagtaaggttagtattttcctgaaatattttaaaggaattggaaaagagatgtatagtaaagtaataaaaatattaattagaaagcagagtaggcatcactgttcttaaaatattcgttggctatcacacttgttcccttcgtgaaattacatctcacctatttcctttgttgtcttctttctgccctttctcttttctcacttctttcttgtttgtcttggagcaaaataatatatatgtctcctggtctaaggcaaagctctttagtcctttgcctggttttctgggtgcttgccaaccttagggtattttgtgttgttgagggggggaaaacttttcctgtactctcttatgttcagtgtctggggggtctataaaataaactgccaaaagatattatcagaaggaaaaaaggtttattcatatgcataaaggagctaacaaaagaagtaggtagctggataaatggttaaagttaaagcctaatatacccaacttagtaggggagtgggggaaggcttctatgggaataacaagtaggtttctttaggaaagacaaattggttttgaggagaacaaatgggagataaagtttgtgataatgttcatttatgaggtgtgtgtggtttttccttcttcttcatgccatgaaactctcctgaagagaggatttatggtagctgtactcttagtcttcttcctgggagtagaagccacccagaagatggaatttatggcagcctcatttcccagaagtttctgcttttagtcaaattgggaaagctccaacaatgtttttttctgcattggttgaatctcaaataccttcaatttaatttcttataccaactctggggacctgagtgggttcccacacagtgaatcaaggtccctggcattttgcaacattgtatgcctgccatccatgctcacaggatttcttactgaccctgggtaggtttgtcaaggcatttcatgggagagacaatgccctcattcactgagtgaacttctcatttctagtgttaagataatatgaataagaacttttcacttgttacagagattaaagaattcagacattactggggaagcattcaagactcttcggtagaaaataacattgtaaagctgtgttgatctcagagaagtggggaagcaaaagtttgttattaatgatgattttaaataataattataaaaatgataattcacatattatatgtcttcatttgcccatgtcctctttcatataaaaatggcaaatgcaagtaatcctaaaagtgttcttgtcaggcactaagaaacataaataaatcatacttaattttgcacaattctatttggtggatttttatctatattttatttataaagatcatgaaattggaaaggtcgggtgacttgcccagggtaacacagctgtaagcggtaggactcagatgtgatgattgtaatctaggagtaagaaatagagacctagagaaaggtggggccagttgaaatggaaatgaaagtgggaaaaagggatgaaataggatcaacagtatgacttcattaattggtattattactttgatattattacttggatgattgacttagtaactactatatgcttggagtgagagatgggaatgaagccaaaaatgatgctaagtgagcctggcttagtgatttttttttaatagaaattatgagggactatggctgggtgcagtggctcatgcctgtaatcccagcactttgggaggccaaggtgggtggatagcttgagtccaggagttcgagaccagcctgagcaatatggcgaaaccccatctctacaataaaatacaaaacttagctgggcatggtgatgcatgcctatagtcccaggtactggggaggctgaggtgggaagattgcttgggcctaggaactcaaggctgcagtgagccgtgatcacaccactgcattccagccagggcaacagagtaagatcctgtctcaaaaacaaagaagcaaacaaataaaaacaattatgaggaacagaaaaatatctagtttttgggacgggacaatttcttcaactttagacataatgagttgagttaatgagaatgtcagtatctttccttttaaattgtttgacattaatttttgaatacactctacatgtacaatatagacactgaggatagttgaataattttagcagacgtattccctgcccttgaagaattccatgctagttgattaagaaatgcatccatgtatttaatagctagagaataatttcagtgcaatttgtaagtaaattcattatttaggcaagaaccacactggtggtcttaaactgtgggtgccaattacatcgttaacacataatcccatggcggagccactgagggagaagtaggcagtacattcctctcccatcccaagaactgcaccctggccacccctagctcttggtatgtagacacgtcactctagggatggaacactaaggaatagactgtgcctcacaaaggccctggaaacaggttcagccttttgggaatggaattcccacaattaaatgggaggaaggaaggtgcgggcttgaggtgggcatatatatcggtccctacataattccttatcctaaggtacagccaaagaagagcagtgtcctctatggtcagtgccttttaaactctggagccaaggatcaagctagcctgggcctgaggcagtgccactccagcgtttctcttcagaggcatcactctcaatggcacctctgtgtctcctcactgttttcaacactccatttaagtaaacagaacatggactgaacacattttttttctccctggttatttgcattttaagccctttatctctagctatagattgaaaggctttgtctctagttaaaggaatttcaagcaattgcaactagatggataagattagatttggtcctgaggggcttctctttgtccctaaaactcctgatattgtcagttttactatatccagacagtgaataggctttgttctgatgctattctatatgccttgcagaaacgtgtatgcctactgtggccaccagtgtcaaatactgcacaatgctcacctacaattttttcaaatagtgtttctctttctattttattctttggtgcttataagacatctgttgttatattttgtatcttccacctacttattcatggctttttcctctaccttgtggatgaatttcttggtatcatcactaattactgctttgacatcttcagagtaagaattatctttttagttatttttattttgatgattatatatgttttctattgttatgtattagttattttcttcaaatctgttgttttatatttaattatttttctttttgtgtcataaattgatgcttcattttgataaaagccagtgtgtcagtttccattttaagcattgacatacttatttcaaagtttttgttggtgttccttaaaattaatttaaattctgtgaattcatgattcacttattgacttacttggtttttgttcttagcattagaatcttttacaggatttgagtttgggttttcaggcttatttttaataggaatttgtaaattcatgttggctttactttcttctctctcctcatctataaactgtccttcctatttagtggtttagcagtttcttcacctgttccttcaggactctagttcttatcaggtcttcaatgagaatctactgcaaaatattctactttggcataaggatgattttcgagctgaagcccagttgagaagcagaagatgcaggaagagttatcttctttccccttatctgtctaaaagcagggcataaattttcctttgtgaaggctctccctccctagcctggcaccaagaaaggaagaacaactcttatcactgcaaatggggagtcaacgctgaaacgagtttgcacgaataaaccttactaatataacccgactattccattaattcccccatatattgtctagccacttccccatgagttaatcatcccttgaagcctaatgcccccttttaaaaggcatataagcccctgaatctaaccacttgaatttcacttgttttctgtgaattcctatccatgtaaatattaataaaaattttagaccttttctcttacctagcttttgttagtttaatttgcaggcccccttgacagaacctatgaggatacaagaaaagttttttggttttttttcccaacatcttaataatgtgttgtggggcttcttcccacagtgatgtctaaaatcgttgatgatttggtttgattaatagtgaagaggctgtgtctatgccctcccactctctctaggttcccattttaaaataaagtcaaaattgcagtcagtgtgttggcaacagttttggccacttatctttggcagcttaatactaccctaggcccaggctttcagggaaaacctggttctagatccccatgacgcttttagttccctttacattataggggccttaagattgcttgctactttatatttctgtctcatttcgtggtccaaaataatctttatctcatatttgaccctaagtctttttctttcttattgaatataacttattgttgtcatatcctatcttgacccaaaattcttataaacatggtttacttcacattttaggttcacctttcaggtctctcaaatattatttttttggcttttaatcaatagcatgtgattagcaggaaaactaaagaaagccatgtggcctgggcaaatttgatacagtttgaaaagtatgccccattttttttgtgctaagattacgtgtgtttctgaaacttggagagaagccagggacattttatttagtaatgtgaatgttggctctatctttaggctctaaagaccaatctaagattgaccagcaattgtaaaaatgttgagtgatctaaaacaattttgtctaattttcgtcttttaaaaaacccatcttttagtctttttatctgaggatagtttatacaaatgaaggtagtgacacctgtaaatatattaaaaatcctgagaccattgttttaactgaggtccttgttgaccatttcaataaggaaatggttgcttatttgcacaacatttcaatcagttgaacttggggaagtcagaagtaagattggggtcattatttggcttaaaacttttccaatgagagtcaaaatatcattgatgaatagcaatgtacatgtatgattaatattccaagacagattttgtaaatgtattgtgtgtcttaaaatatttgttactctcattcatgtccaggtttcagcaagtttagaagtacatttgtatatcagtagtagtatgactaattatctctacatgtatttatcattaaataaacctcacaggagacagaaagattgtttacttaagcagtagaatactggggatggtagatagctctagaacacaggattacatcgctggaatggcactatttattaagctatgataacgctaatgttcctctttgatgtatagcatgtgcgacttcagctgaacttgtagagagccttaaggatgtttcattgaacatttagtatggcagccagccagaatacatttagcctaagcccagatgacgggctggtaatgaggtagtgattgatgaccacagcttccttatgaaaacctgcttgatatgctggggggaaaatgcattgccagctcttttcatttcagtccctgttatattagtaatttttactgtgaagaagttacatgggcttctgcttatgcacttttggcatcccttttagattacaatcgaacggtggtatagaattttagaagtcctgtggctatatttatgtataattcaaatctcaatttcaaaggggtctttaaaaatcatttttaaaaactataactgtgtcatccataaaatactctaatattatttttatgcatctgtttaatgttatggtttctctgactcctctatcccccatatccccacacagtgtcataaagctctacccactcccgtaactttaaagaacagacatttgttcaaattcctaaatatgtttcaagaagactctattttcaattattcttacatttttgtggtatgtatgtgtgtcttttcctgagtaaagcatataaaattaattcatatatatttttatatatgaaattcctctggcttagttcctttgaagcactttttctcttttgtccatctcttttttgctttatacatttgctctcttactcttttgtcaacataaatcatttctcagattgggttcacataagcacttatgattgcaaaatgctacttgctagaatgaccactttggttgcctactgacctgggacaaggtagagcaaggcccaagattgacatttcacccttaataagtcttgctcgttgaaacgccaacaacaaatagggtttgctgagattgacaagagaaaataaactatgctttaagccagcctgattgtggctggctgggctttcaattttgctagtcagagagagtctgtacccttttatgccttgcagccatcactccttttggcttgcagtggccaaacagaatgcttgaaactcctgatctcaatccagtcactggggcagctcagacaatgacagtttgaagtgactggaaatcctgttgagacgccatagcccacatttggcgtggttccagcaaatgaaaatcagtaagcttgctctcagaagcctgttacgtgcttatgtttttgttgtttcaactacctccatttcttcaattatttaagttattagaggacctggaatgaaacaaatcaagacaaaggagtattagtatccttttgaggtttggcttatctctcaaagcttttgataatacttcctattgatgggctttgtaaagggcaggaagttgtgttaccactataattctttactttgctccctatcaaaaaatagtagcaaaataagagttgtaccaaagtggaaggcttatcccttcctattatagaacttatcttttattaataagttgctcaccactattaccacaaaaccatactttcttactggagataaagaaacttgttatttactgggaaaagtttctggtagcaaaacttgacctgaaatgaattatttacaagtttagaagaaagacttgctaagtcaatgctacagctgagaaataagccaacactttctccaaaacagcttgaagctgacaaaacactaagctctgaggtcctagagaagcagcagttcagggtcttgttagcttcgagctgcaggaaagacaacactggcagagtgctcagaggaaggagcaggcaccccaagagggggatgtggagggagctagaaacagcattagagagaaggcatggagaaatagagcaacaccaaattaaacactgagagatgatgaggcacataaagtacttaaaggagttttggaggtaaaaacaaaacaaaagtaactggttaggaaaatgggaaatgaaataaaacaaattgcacagaaaactttagggcaaaatataaaaaatgtccaatgtaagaataatacatttgtattatatttatatagtgctttatatttcttttttttttgactgtatatagtggctttatccgtaatagccaaaaactataaacagcatagacgttcttcactgactaatggttaaacaaactgtcataatatatatcatattagtactagttagcattaaaaaggaacaaattattgatatacgtgacaacttagatgattatccagacaataagactgagtggaaaaatctgattctaaaaggttacatactttatgattctatttatacaatgttttgaaattatgatattttagaaatgggtaataggttagtggttatttgtattattttattcaattctcacagcccccagtataaatttcattacccccattacataggtgaataaaattaaaatgattgcatagatcatagcattgtctaaatcctaatttctaaaatccactcgtagaatttgctgaatatattgatatatggcaaagatttctagcattttatgcatttttgtttttgtttgtttttttttgtttttggagagacactattttaaataggattatcagaaatggcctgtctgtggagggacctttgagttaactgcaagaagtgagagtgtcagttatgttggctgtattctgataaaatatggctatatctaactaagtaagggggcaaaagagatgacaacattggaggaggatgtgttaaaagaactagtgcctctgtgagcagccttcaaacgatgaatgatgcccccttcatgcaccaactgcctgaccactggggtaggatagctttgaggtgtgtgtcctacattggctcctagaatttttagcatgactttttaacacatgctttattttgtttcctgtttcacttgcccaccctcctattggtgtttcctgggattatctcccaaataaatacttccacttgatttcttgactcaggctctgcttctggaagaacccaagctaagagagtggtaacaatgtaagtggtaagaattcatcagaatccgcatgccatttagaagtgagaccgataggatttactgatagattagatatggggtaggaggaaaacagaaaatcaaataaatgacttatttttaatgttaatcattaaaaggagccataaaaacatccaacttgtgtgattgtttactaattgccagggactcacctagtcctgctgcacatgttaaatcatatgagttatccctaaagccccatcattatgagtctgggttcttttatttagcatgtagaggctgggatttgaactcaaggtatctagttctaaagtctgagcaaataaccactgtcctcttttgcacagatagtacataggctataaaacagcatggtcatacattcatatttacatacatatatacatgcatattactagtacgtagtacattcgtatttactaattctatttgcatataatgaagaggtggtgctgaatttttcttctagccactttttttttgcatgtatgcatatataaagtattttgtaagtctaagttggacttggctatcatttcaaaaatcatgacccttctcataaaaattaagaggtaatattactatcattattattattggcaagatttctaagttgtactgaattttctataatcaactgttatttgatagaattgtttgaaaatattactacatgcttgatggcaggacctaaaacagcaggcaaaatatatatgatgccaaaggcatcttctcttatcactagctgatttacaaatgataatttaactgttaatgtctgagaatattttctctttcccatacacaataagaaaaatcactgtgtatactgagtggtgtctaggaatgtgatacgtattattcaaagtttgagttgccttgaaatcaaggtatagggaggaatgatgaggacacatgggaagaatttagaaataggtccttacagcaaaaagtccatctggtccctagaatatagatggagggtattggagagcctgggcaatagaattaatagagctaggaaacaagtacttatcagaggaggatttggtccatgaaagtggtcaagatttggaagaccctttccctttcccccaacatccaggcagttttcatatcatgaagagtctgtgcctcaatgtctctgaaataggaacctgccctttcattcctactatcattatctttgtccatgcaattgtctttttgctagcagatagttacaactcactttcaaactggtctttttaaggatagcatctaaagtctttagcatggctcaaaaggccctttataattttgccttcctgaacctaatagtattataatgttattttttgtatatgtatatgtgttttatataatattaatatataatactattagtaatgttatatcagatgataatctgctaatgatgttcaactcctctaggtcatctaggctggataaatgtttcaagatagaatacttggagagaagagagttggtgttatttagagcagtattttctattaaaagcaaggtggaaattgaggaattttacaagttgctagccctatggcagatgatagcataagtgggtaagataaaggcatcctaatacagtgtcttgttctttgttaacaagaaatgaaaaagaagcatacattttttggttcttagaaaacctggggaattgcagagcaggagggtgatatagggaaaatacctgaaacagagtgagttgccacaggctggcttcctcgtgctctcagtgcacaatggaacactggggattaggcggtagcatcagttcttacttggaagagataattgaaaacttttctgtttctagaaataatgtttcttaaattattgttggtaatatttacatataaaatgacattaatcctggaggcaatatgttgtaagttaaattatgtaggatttgaatccaaatcctggatctgcatctcagcagatgttttaccttgtgttatggactgtttatgtctccctaaatgtgtatgttgaaatcccaacccttgttgtaatggtattaggaggtggggtctttgggaagtgatgaggacctgagagtggagccctcatgaactggattagtgccctcataaaaggagcctcaaggagctgggcctgaagaggccctgcaccagatccagacatgctgacacactgatctgagatttccagctcctagaactatgagacatgagtttctgctgtttataagtcacgcagtctatggcactttgacatagaagccggaactaagacaccatggaaaggtatttcagtctatttaagctctagttagttcccttgtggaaaaaaaagaaagaaagactactaatatattttactgagatgctttgggaatttaagtcactgagaaaatacttagcatgtaatatgtatttcagaaattaaagttcccctccattctctttccttactatgtcgtttatttttataatggtcaggctaatgcggaaggaagacatactaagactttatctttcccacctatgataatcaggcaaataataactgatattgatttaacattgttttagaagaccaatgtttgtgaaatgtatatatcacattcagaaactatagatgggagtagaaacttgaggcaaaatgtgaaccaattttcagttaggcagaggagcttgcctccttttggaggaaatgggaagtcattgtatgtttttttatgttgttgtttgtttgtttttttcttgtctttgtagtaaacagtcgtagtcattggaaatatttacttccaatttaaattgagaataaaatcttctaaaaaagaaatagttgaagtaactgaatatttatatgaattttctgtttatattaatgattttctcatttatgttaatatcattgacatttcagaatagttgcaacttagattagagcttaagacatttttttcccattgatttagcaaacattaatgaaacgctgacaaaatgcaagagactctggacttggcaccgtgggaaatacgagtttattcatttaacaaatagttaagtatttaatgctgtatttcaggcatcacggatagagtgaacaattaagaaagaagtggtctctgacctcactttgcccatagtctagtaggtccaagaggacaagctttcctacccttgatatttgaaatgacccgaaaagaacaattatttatttgtattgacagattcatcatctgccaaagcccacgtgaccttttctttcatttgtccagtctatgtcagtgatgtcacaattattgtataaggttgcaaagcttcaaaaaataaaactgagtgttttatcatcgtattagattgccagggctgccataacaaagtatcacagacagggtggcttaaaacagaaatttattttctcacagttctggaggcaggaagtctgagttcacggtggcagcagagttggtttttcctctgaggtgtctctccttggcattgtagatgaccatctcctccctgtgtgtttacatgctgtcacctctgtatatgcctatgtcctaatttcctcctgtttttagggcaccagtcatgttgaattagggcccactctaactaatgaccataattttaattctttctttgaagatcttatctccaaatacagatgcattgtcaggtatttggagttaggacttcagcatatcaatttgaggggatactactcagttcacaacagttacccattgatatatcatctatagtcattctgtcatcattttacatccagttattctattgcctctgatactactctaatccagatgcttataaacaacagtgttttcttttaaaggcagactcttgttcagaaattcttcttacatgtaatccttccaattagaattatttctcaatagttcttttcttgatttataaaagtttattataaattgacagttataattgtatacatttatgaggcataagatgatgttataatattgcaaatagtatgtggtacaattaaatcaagctagttaacatccccatcacctcaaatcttaacttttttgtggtaagaacatatgaacttaatatcttaggaattttgaaatgtacagtattctgttattaactatattcactgtgctgtgcagtataactcaaaaaaaagaaaaaagcacacacttatggtctgagattttaccctttgaccatcatcaccccattccccaacacacaagctctgtaaccaccattctcctctttgcatctatgagtttaattgtttcagattcgacatccaagtgagaacatgcagtacttgtatttctatgcttgacttgtttcacttagtgtaatgttctccaattccacccatgttgttacaaataataaaatttcccttttttaagtccgaatagtatttcatactgtatatatacattttctttatccatttatctgttgatagatacttagtttgattctaaagtttagctattgtgaatagtgctgtaataaacatgggggtgcagacatgtcttcaacaaactgatttcaaatcttttgggtaaatacccagaagtgggatttctggatcacatggtaattgtatttccagtttttcgaggaactgcctttctgctttctatagtggctctactaatttacattctcactaacaagagtgttttcttttctccacatccttgctaacacttgttatctttcatctttttaataaaagttattctgacaggtttgagatgatatttcattgttttaatttgtatttccctagtgattagtgatattgaggataattttcatatattctaggccatttgtatgtcatcttttgagaaatgtctatttagatcccttgcccatttttaattgggatttttgttttactgctgttgagtttagtttcttaagtattttggatattaactccttatctgaggtacagctttcaaatattttctcttgatctgtaagttgtctctacacactgttaattgcttccttggtaatgcagaagtcttttagtttgatcaaatcccatttctctatttttgcttttgttgcctgtgcttttgggatcaaatccaaaacatcatttcccagaccaatgtcatgtagcttttctcctatcctttcttctggcaattttagagtttctggttttatgtttcagtatttagtacattttgagttggttttttatatggtgcaaggtcaaattttgttcttctacatgtggaaatccagttttcccaatagtacttttcaatgagactatcctttacccattgcttattcttggcacctttgtcaaaaatcagttgatcatatatgcatgggtttatttctggatgctctactctgttcccttggttgatgtgtctatttttttttggcgaatacctttctgttttaattactctagctttgttgtatagtttgaaatcaggtaatgtgatacctccagttttgttctttttgctcatgattgcattggctattcagggtttttcaatggttccatatgtgttttggtaatgttttctctatttctatgaaaattaaagttggaattttcatggggattgcactgaacctgtagattccttttgtcagtagttattttcattatattatgactttgatccaaaccccctcattaaaatgtttctatcactatgcctgactccctgaggccttggtaacaattgaacactgtgttcccaaatttatttcctgttattctgcagtgaattatgtttgctgaagactgaacatcctttttactttccataagagaacatttaacagcctgctctagctttatgagtaagattatgtgttttctcctttgtggggaaattcatgaggaatctttactggcttgcctttgttattcagactgctttcttcatcttgcttttttgtgggggacacccctcagtttgcacctaattcttacctctctgcttcacagtctttggtcatgattcttgagagcattcctttgcttcttgagtcactggtcattgccaatatccttggactaactccattcactttcaacattgcccagcttgatggaaactagaatgaccagagtcctatctcatacccactttcttgagaagtggttttaaataatttttgcctgaagtctttgcatctgttttgcccttcagtatcatgatactcccttctcaacttcacatatgcaaatcttagctctcctgattctgtgtaaacgccattcttttcatgaaactatttcctgattccttcagatcttgtttgcctgcctttcttcttcactttcaccacactggaaactgcataaaataacatctaattatatacagtcttgtatagaaactcatacttcatgcaacttagtcttttattcctcggtatctttttaaataaacttttttattttagaacagttttagatttacagagttactttagagacaatacagaatcgctggagtccacattcagtttcctctcttgttagcaccttacattagtatagtatgtttttgttacaattaatgaaccagaattaatacgttattattaactaaggtccacacatttgctagatttccttagtttttacccagggtcggttttacctagagtctatccaagatcccaagttatatttagtggccatgtcttcttatgcttttttttggttgcaatggttttttcagactttccttatttttgatgaccttgacagctgtgaggattactagtcaagtatttttttagaatgttcctcaaatgacatttatatgtgttttttctcatgattaaactggggttatgggtttttgggcagaagaccacagaggtaaagggttatttaaatcaccttattttatatactatcaataagctttgtcatgattaatgttaaccttgatttcatgactaacatagtgtatgtcaggtttctccactaaaaaattactcttttatgactctttgcatatcatgttctttggaagaaagccactatgagcaggccacacctaatgagtggggaattatgctccacttccttgagaatagagtatctacataaatcatttgggattcatctgcatgggaatttgtctattctgcccatttatttattcagtcatttatttatataagtatgatggactcgtggatatttattttttactttttgctgtaaactaatatcactttgttttgttgctcaaattgttctggctgtgtccattgggagttcttttagtttactcctgtgtccctttaatatatctacatctgtgcgtgtgtatgtgtgtatgtgcatgcattagtgtgtgtttgtgttttagcacttaatttctggccctacaagatgatctaggcttatcttgtatatttccttcctaagtcctagaatcaggtgtttctccaagggggccctgatttcttttattggataatggtattagaaatcaagatctgggagctaagtgtgctcattgctactgtgatgttattgcttgttaggccctcccagctgatgggtaagggaatatatatgtgtatactaacctatgcatatacatgtatgtggacatcagtacaaaattagacttatattatttatgtacaaatatgttaattattagatagctgatttttgaataaaatgctaatacatacatatttctttaaccatatgtatctgtattaaatgaaacatgtgtatatactgatgtcttccactctaattcatcaccacgtagaccattgtagcctctctctatccttttcttcttatttacatttaacctcccaatacaacagtgaaaacacctgactcccataatctactatcagtttacttaattattcaattcttatttacattcattaaaattattaattcataccaccattccaattcattatgtttaaaatgatacaaaagtgccagatacttagcatgtttctgtactactgaaaggacctagaataaagatgaatttatagtaggtcctatatgctattgatgagtctccaaaatagttaatatactcaatcaaatctaaatttcttttgatattcaaaaggcattacagcctcttgcagtgctgacatggccatcattataaaattagacaggcttgtacagtatatgtacaaatatgctgattgttagatagctgagtttgaatgaaatgctaaacttttttatttcatgataaatctcttaagaggatgaaagcattatctaattatcgaattgttaaataaagctgtaatccatgtacaagtaggaagctgattttttaaattaaaaaatgattatcaaaatggaaccagaagttgctaaaagaatgattagataggggcagaagtatgaaggaaggctaagaagattggacttttacattttgggacagtgaagaatgaaagagcatatacgaatagaatttataaaattatgaacaatataaaaggtaaatgtggattcctgtccagatatccagaaattgtaatttatctgaaacttcactgaaataaattttggccaactatgtttaaaaagttaattttaagagggcagatggttaataacctatgagatgttgccagtaagaaatctaaatgtgagagtgggtgccttggctcacacttgtaatcctaacactttgggaagccaagcggggaggatcaattgaggccaggagtttgagaccagcctgagaaacatagggagacctttatctctacaaataaataaatatatagtggagtgtggtggcatgtgccgatagtcccacttaggagggaggctgaggctggaggattgcttaagctcaggaatttgaggttatagtgtgtgctacgatcatgccactgcactctaacctggtcaacaaagtgacactgtctcaaaaaaattttttttaaaaggacaaaaagaaaatgtaaatgccttcaaaatgggtatgggaacaccagtaaatggcagaacattaagatgaatgccctgtgtatcaattggaatagtgattgcagccaaatctcactggaatctgagtgtaacccaggctaataattccaaagtgcctatgttttttttttttttcacttatactgggagattttgccgaactttaaaattaaatgaaaaagaatggctaaaaacggttcttacagctttcagcttttttgtatttagaatcagtcatggcaatcacagatgtttgaatttgatttaacttcctcaaatctatttttcaacatgagaaaaagctgtcaaacagtataggcacaaatgccactggcaatactttaaggccttaagcccagaaaataatgttttcatattaaatatatccattttaaaaagttaccttcaaatttcctagaaactaagtgaaattagatagtttgtgtaatggtaaaatcacaaaagataccaagagcaaggaaaaaactaacatttttcaaagttataagaagcatgattacttgaatttttatgctagtcagtattataaaaatagaagcaatggtcgttaacattaactttgtaaccggtgtttcccttgcattgataaaagggtggatgcggatttaatataggcaatacatttgaaagaaaagcagattattccttcaggattctcatatgacattctgaacaattaagtacaaacgtatgcttaagtccaatttcatggaaagttgctaacttgttatctctatatattactacatgctaaagacaagcgaatcaaacagaacatggtattttgtcctgtcaaccagcattccattttgatcataagctagtagttgtcaggttgatataaataagatacttaaatataatttagtacaaattgtttaaagtagaaataatgttattaggcatctctagcaatcctaaaagaaaggaaaatattttatgattacctaattgatttgaaactaaacaattgactacacttttctagaatgtaagattttgtaaattttaccaatctgtatgaaataaaacaacaaaattttaccaaagtatataatccttataacaacctggttgtgtgatatattatccccatttacagtctggtggatatccacatcaaatagaaacaaaaatcataaaaaggaatgaagataaataaaaacatcttcaccaagattacttactgttactgcagaaatgagacacaagattgcatcctggatgtttctggtgcattattatttcttctatctacactgccttcgattttatgtggtgagctcaccaaaactccatattaagctatgggcaaggaaccccgtgcccttcattaatctgtgatggtggcttggttgaaactgttggttttgaagcctgattgcctggattaaaatcctacgtttatttctgaagtgtggctacctgaattcaaattctgtatcatctacctaaattcaaattctgtgtcatctatagcaatgctgctggttgtgtagccatagactggcgccggactctgaactggttattactggtctgtaatgagataagcccacacactgtatttagaaacttttatagaaacttgacagagtatacaaaaaaattaaccgggcatggtggcacatgcctgtaatcccagttgctcaagaggctgaggcaggagacttgcttgaacccgggaggcggaggttgcagtgaaccgagatcatgccactgcactccagcatgtgtgacagagccagactccatctagaaaaaaaaaaaaaaagaaaaaaaatccttgacagaataattacatgtctaatgaatcaagtaataaaatgtcaggacatgctatgcctgtgattttttttgtcaatttctgtttctagtaatttatttttgttttcttaaaaaataattgaaaaggattggaatgaaagaagactagtcccttgccatggagagtctgagaaacactgatctagaacagtactaaggcaaagctttaatgtccttatcattgaaatttgacaaaaagcaaggcagggcaatgatttttatacctttcaggtgacaacacttaaaggggtctactgtaccatataaaaattatttctctacatacttgcccatttggtttcttatatagttatcagacctacagcagatctgaccctggtatgacttacattttggggacccaagtggcaaactgagagagttttaaaagagaaggcagcttgagactttttccttcttttcataaaagtttctccttatttcgaggtgataactcatggtttaatagttcttaaactttaatgcgtgtaggaatcacctggagatgtgcatccatctctgactcagaggggtggagtctgagtttctgcatttctcacatggtgctgatgctgcagatgtgcagaccttgcttggtagcaatgatttgacaagtcttgtttcccaggtatgcactccacctagtgcctgtcagcagacacccccaacccctccacagcacctctctcagagatagaatctccctgcaaatattttgtaggtatccctagttcataggagatgttttatcctcaccctgaacttactctcaatgttggtgtttttcactggacctagagaccaccagaagccaaagatccagcaaagctaaagttctaagaattccaatgtaaatataattttatttaagccaaatagctttttaaattactaacttacaaatatgagtaggacaggctgactagtctgacacagccactgttgcttagtgttttgtaactcttgtaaaaatatatttgcctgaaatcagtagtccctagccaattacctttatttaggcatggatagttgagtgtttttgtatagacattttagaacagtcttgtggttctgataaagaacgtttggaggttgtagacacgaactgtgtgtttgtgtgtgtgtatgcgtaggtgtttgtatgtgtgttttcttcatacttatgccccatctgaatatgtgggaattagatccttggatcatttacaaaagaaagaaagagaattttcctagcagcttggactgcatgtgtgcaccaccatgcccagctaatttttgtatttttagtagggatgggttttcaccatgttggccaggatggtcttgcagtagaatcacttgaacccgggaggcggaggttgcagtgagctgagatcccaccactgcactccagcccggcaacagagggagactccgtctcaaaaaaaaagaaataaaactttcatagccttaattttaggagaaatcactactctaataatcttaggaattttaatgcaatagtgaaatattcattcttcaagttttctttttgtacataacataaacaattgaaattaaaaattataattgctgtgtttcatattgtacaagtcattcacctaggatatatatttcttcttttttgtatgaactaggtctctattttttgtgttatcacggttatctaagcacttaagtaatttgagctacatggttagagacggtttttaatatttgtgattcttgggtttataatattaatatgcttgcaaatcttggttttagtaaaacatccaagtagtttgcatgaataattaagtgaacaataggtaagtatccagcatctccgtgtggtctctctggtcttttaatgtaatcctatctgtctcaaaaagataatattttgaataagaattttattcttgacttggaataattttcaatctcattatcctaaattacattttgatccttggatatttaaaaagaaagggatgatttactcacttatgtgtggaacctttcttttatgatgctgagaaaagtgtgacaataaataaaaaatgaacaaatgaaaactgaatttaccattccttcattagactaacattaattgaatacctagtatgtcctaggcagaaagaatgccgagaagaacaaagcagaaactccgtaaagagttcccagacaaaaaaaaaaatcatttattagagtgcagtgtaaataccaataaaatagactcaaaccctgggtgtaaggataatgaagaggaggaacacatggtaggaatctgctatttctgtttggggtagggagtgacagtggtctgtcagtcttctcagaggagttaacgtatcatatgcttcataaggatcaaggtaaatggaagccaggcaaaggagggaaggaagggcatgccagtcagagggaatcttaactcaggggtaatgaaggggaatgttgtattcagtgcactataggacagaattcaaattggtttatcagaaatgaagtgtaattgctgaaggggttgggggagatgagactaaggttcaaataatgaagggccttatattccttgctaaggagtgaaacactggggagtccctcgaatttttcattttagaaaaacttatctgccagcatgatggggaatgataccaacagagaggaaagaagcaggaagatcagtttgggaggttatttttttgtcagccaggatagaaaagataagggcctaagcaatattagtgagactgaggagattaatttgaaagattattaagtgaaaagaataggatttggtgattgtagaaatgaagtttgatggagagggagttgtgtaggatggttctgtttgttacttggtaatctgcatagctggtatgtagtttgtacttaccaattattttgtcatgttttacatgaaggtcagaatcaccccactgttggtcagcatagattcccgacacccagcatagtgtctagctcatagtaagtgctctatgaatatattttgaatcaatgatcatctcatagttcaaaaagacagaaagtgtgaataatagaacatttggagaagaaaatgaagaatcgcattttggacatcttgaatttgttgtgttactagcccaaccagtggaagatgttcagtaagcagttggacaactggatatatgggtttatgaatttttatttttgtaaacaagaattgtgtcttactcatggttagagaccttagcagtgttatgcaagtttccaaatgtgtgctaactttaatcatagttagcactagtattcaaatagtattgcatagtttaagagtaagctagatcttttaggcatatatgaaaaactagatattgccctggattttaaaagcctacagtcttaaggaataaataaggcagagaaaagaggcggctttgattgtggaaagagcattgatttttgaattagaagatctgtaagccttaactttgctgttaactagattttagtcactaagaattgtaaaattttctagactgcagtttcctcagtgctaaaatgagacaatgatatttcatggtatccaatgtctcttcaacctgtaacattaaataatcctgtacattcatacttaaagattttaaaatacatattgaaaagtgtgcatcttgatgggtggggaggatgtatagttgatttatattagtgagtagtcgtgatgcttccctccattgctaatgaaaatgaagtggaacttagaattagctaactggatttaggcctcatctctgtgaataattagctataaaattttggacttgttaagccccttctaggggctaattgtccttgacatgccttttatctctagtctactatggttttattaaaagtatttatgtgtgattttatcctgtcaaacttgtgggggaaatcaactcagtcttataaatatcattcacataatatctattaaggcaacacttgatctactgaaaacacagagtaaaagtatttaaattattcatcagaaacattgatattaaactaattcttctagctcaagtctctaactcttgtagtaccttaacaccttacctatatctttataattattctttagtaaataaaatctcgggttatcctaatttaagtgtgacatttattttttgtagggattctgtttgatacaccctgtcataaaactttaaaaaatttttaataaactttgaagatttgcctcatttaaaaatattaattaagttttaaatcaccatatcccaataccatgtgtggaactacggtagctgctatataaaatttttcagttacttgaatatcaactcaatgagagaaattgctgagattacaagtaagatccatccctccccctggctcttcgtgagccagataattagataaaaggatgagctagtaaaggaaattcaaagactgttataatattgtatgtatgcacaaaggaaaataacatggtagaactgctacttttatgatctctgtagctactgccactatgacattatcctttctacttgtgcctttactaattattgatgtttgctaatacataatcatacccattgttgtctatttatcttatttctgtcatgtcctttgtgcctaaaaatctgtacattaggattcattttattacttaaacgctatattcatgctctagctctttccatttataattttaattagtaaatatatattgaacaaatgaacaaatttaaacacatattggcagatcatgcgttgaaaacaggtgtttcggaaagtctcaccagcacactcagtatgccccagatttctagatgtcgcatttaaggactttttgtgagtgaaaccacccaatagtttatgtaaaacagatgataaatatgaggatgcagaagagtaaaaaatttattaaagattttagtgacatgtccactctttttttctcatcattttcagagagttatgattgatttttatgagcacactgaacaaagagtgtgataaaggaaatattttccttaggaaagagggttcccagacttaaactcaattgactattaaccaccaaaattatcttttgactgtacaaatagactttacattcaattagtatatgatttaaacaaatttagataacttgcctagagaacaatgcctgttacaggaaggctgcttaataaatatttattgaaggaaggaaggaatcaagggaagggcagaaaaaaggaaagagagaaagggaaagagagagaaaagacatgtctgcccaacttggtttcaatatttttatgctactatttagcattttagggtagtaataaaaatgtgatggataacattcattctagattattcaaaactctataataatcagtaagaaaatttcaaaattagatataaactcttaatgaaaaaacatccatgtagtgttgtcctggccttgattatctcagtatttcagagaagcacatgctcatagaaaggaagcctcaggtaaatgacaactcttgctcagcactgggggcagcatagaggatgagggattgaagaaacaagcccaactgctatggtataatttgtcctgaggttttggaagacattttgcatataatcattaaagctaaaattaaagatatattaaagccaaaattaaagatattatttgctgcttaataaatgatatatgtcttataacttcattaaggatggtgccttccttaattgttgcatccatgagattttcagtgaggtgcatattaactgcagagataataatgtttctatatgttaataattttagatggcaaacacttaagctattttgcagccacatgggaggaatcatttacatctttaaaggcttgttttaccattaaccccttcatttgagtacagtggatagccatatgtaaagtattaatttttttttacattagtgctaatagcaagtattttagacccacttgtgtgaaaagattaaaagccacagcattaggcatgcaccaacatttctgagattaatccttgttagaccaccctaacaggaacatataacttgattttctatttattgatcagatgcctcctggttcttttatcgtgtgaaatgaaactccacagagacaatagtatattgcattaatatgctgaatttaaaaatgcaacaccatattaagttggtctattttgccctctctacttttaataccacttaatatcaatacagggcataaggggatctgtggaaataggatacatcctaaatatttgtcattatgtcccagattacacatgagccactcatgcatcttctagtcataaactaatgcttgaaggttatgttaacaataaagttatgagaatatttcctaacgcagtccttgcaacacggggagtgatgaatgtttatgaaagaatgaatgaatgaatcagaatacgttttactacaactaacacctgtgtagtaactattaagtaccacgagcactacttctaggtttgcttatattatctcatttaatcattacaaaaaatcctaatctcagtgctattaaggatcttattcttgttttgcagatgaaaaaatctgtagtaaaagatggtaagctaacttgctggaaagtagcagagtcaggactcaaacttaggttctggctcggatttgtctagcacagtacgtgatgcattgtgaatgtttgaaaactgctgtgatgatgtggaattggaaatgttatctgatgtatagaaaaagttatttaatactaattatagaattttcaaattgcagttgcatggattgcccctgtaacctcctagaacaccttatatttacttgattttcaacaataagatattttattttttctctctatagaaaaataagatttgtgcatttttgtataaactcactgatacggtttatcacccaaatgaaattctctgtccccacccaactctcatcttatagctcccataattcccatgtgttgtgggaggaacctggtgggaaatgattgaatcatgggggcaggtctttcctgtgttgttctcgtgatagtaaatgggtctcaccaaatctgatggttttaaaagcaagagtttctctgcacaggctctctttttgcctgctgccttccatgtaagatgtgacttgctcctccttgccttctggcatgattgtgaggccttcccagccacatggtactataagtccaataagtctctttcttttgtaaattgccctgtctcctgtatgtctttatcagcagtgtgaaaatggatgaatacatctattatcatatgtatgtttgtacatacgtacacagacacacacacacacatatatatatacacacacacaaacacaccgatatatagttacaaatagagatatgaaactaaaactggtaatgtctttcctctttctgacatcacggttactttgcattttaaagctccccagatgtatcaatgtacttggatatatgtattttgtaagcagctaatcatgatttgagcaaacaatgaattctttaattgcttaaaaataggattttcacatgaagaagttgggcaaaaaattgtaatctttatagagaaatctgaaatctgagatacaaaaatctgattccatctgaaatcatgtactgaaatcactatggagtctgtttctgtagttatttgatcatatgtccacgaagatagctttgctttttaacccatcgcgtacacagttttcagtatttagttctgtcaatagaggacctggaagcagtgagggtaaatgaggaggaatgatagtttagatgtgttctttcctgaaatgccagttgaattaaatctttcattcccactgcaaacatgcaaatctataatctcctttcaagatgaatccagaatcaggagtctgcactcttttattcttggtcaggagattaaaattgatcacaggtcacacaagggagtcggctgtggtatcacagctcaatgtggttaacgaggacagcacttgccttctgttctccttaaccgtgcacttacaagttacaaatattattgattccaggggttatctgagggtatggggggtggtgtgacttgacaatattttgctgtttttaagggataagaactatgaggcctgataacatctgggacagttatagtttaaatttgtcaaatgaagatttatacttttttgagctggcagaatccttcatgtagaaataatgaatgaaaatttgatagttgatttaacataggccaaatgacttgcagtgaaagaagaaaaataacactttaattattacctctttctcaaaatgaattgatttttgtcattgtagatctgtgctttaaacaaatgagtagtgcttagaagatacttttacaagacgccatttaagtttaagtgggtgtggcttacctaaaatcattccaaaatgtagtgtaggtgggatgataggtaagtaattacctactaatctttaaagcatatttttttctttcttatgaataaaatagctatattaacattcaagcaccacatagcattgtatgccaaattttcagactaggttaagcttcctttttctctctctaacaataaagattaaatgctgccctaaagtatattttatgaaatgatggaagaaacgatgtatttaacagtttttgctattttaaatctgtctttgccacttgtctgtgagattatagaaagctttttttactgccttgaacctcagtttgtcatctgtaaatgagcataaggatacctagtccatagtgtttttgtggggctcaagtatataagaaatatttttaagtaataaatcactttacaaatgcaaagttttaaaatatttattattactgagcttgtataatgttgagcctatatttaagacagttagtggtgaaagaccttctgaattagattctctctctttttctttatcttctgtagaatacattgacaaaacagcaagttagggtttcaaaagagtctagattgtggctggaatgtaaactgattgaactagacttcattgccggtagtggccctttatacagcctggtcttagaggatgaatcacatggcttagcattagaatatgccttctttaaaaaatataaacgtatttacaaatgattaaaaatggccctaaaaccatatgtcatcatagaaattacctattcagaaactgaaaagaaagtatcaaagcagactgctcagtttattaaaccaaaggcatttggaatgtaattcattattttacattgactttaaaaatgtgagatttttattgattctgtcaaaatgtatgctctctatactatcattagagtggttcagatgttagtataattcgtgaattggtatgtattatatagtttacagtgaacttaaatagtttctaaacagcaactgagaatttctatttgatctccctaattaatccaccatgaactgttgctatagattcttcacctagtagtgggataaatcaaaacatgactgtttgccaattgcacattaatatacatttatatgtgtattattaaatttatattaaatgcatattaatgtacattttaatgtgctccaattaaaatgaaaataattttcattattattaaatttctcatatctgtctacatgcttcataattcaagagcacttaggtcaggtgaggaagcactaaacatttcatttcacaggtgaggaaactaaggcacagggaagtaagctaatttgccatacatcacaaagctagtaggtagggaaaccgagagcaaacctaggtgtcgctacgttacccatatatttctactgtctaggagtctttatttggttttggtttcagaggtcagaaaatctgtggtagggtgaaccagacgtgaatgtacccttctgtgggatttccaaacccactagtagaaaaacaacacctccattgttcagggctttagttttgatgtatttatttaagattgtaagagaatattttctaaatgtagtttttaatcaaacaaatattacacaaattaagttatgtcccttttatattatttactcagaatgtaactgatgtgcagttgccattactgacttaatttttacttcttgagaaagtgctccagtgcgaatatattctccattgtactgattcctgggatttcatgtgatgtattctccttctggccaattcattcttttcatacttgtccaacattgccactagaatacttccccatgtggctattatagagttttcccctttcttcttctgagttggctcatttaaatagattctaatagttacaatatatgtatttgtgttttgttgcttttgttctgtttaatattctctttcaataaatcttttttgtttatattatttctaaaattaattgtaggctagtggccatgtattgtactgaaaaatcaagaaagatgactcctaaaatcaaaagtgttcttttgaacactgtttgtgctttacagtgtacatagtgttatgcgctgtataatgttttaaatttttgcatccagttttcttctgtgataacaagaaagtttgagctgatacctctctttttttgacttccagcatgccgctttttcctacccctcctcctgactgattggtccttcttcaatatctcctttagcttccttttctctttccttccttaaggtatgtgtgttatcttatgctcccctcttggccttctcttctgattattgtatacgctctccctggattaatgctcattagcatctctgactcccagcaccattttttttgctaacaattttcaaatctgtttatctagacgggatttccctcctgagcttcagatttttgttccacactccattaaatatgtccaaaaaggaacaacactcttcccttagaatctgcccctcttccactatactgaatcacagtgcagtagaagaaggacatgtaataaaaaaaaattagaatggagcaagacatgtgctatgagagaaggacgtataggctattgagatacaacagaaagctgagactcagctttgaccttgccatttataaccacaagggaccaaatcctatgaagttaatgcctaaatatattgagattatatttttattcttctgcatccccactgtcagtatcttagtataagtgctattttttctcatttaagttactgtaataggagaagagaatgaaaacatacctctagggaatctggaggcacagttttgaatgccatatatagaatgtctttgaagtattaaaatttcattcaaaatttgcatctcatttttcagtctctctacatttgtcgtaatatgaacactataatttaagttacttatctttgagtgaaattgttgccccaggagggtaagctgtgtttatactaagctatggataccccctgcaatgccatgttagtggaggttactagtaatcctggttaagaagaagaagagaagttttcctttcttatctggatttatgcagtatccccttatatccaccttcttccattcttattttctgcaaattatttctatatactactaccaatttgtccttgctaatgtacaaagctgattatatcatttcctaaaatgtttcctcagtgtaaaatccaaacatcctggtgtgacttgaatgacccctcatagtttggaccctgcctatttgtcaaatttcgcattttgcttcttcctgtctcctcctatctactcccctcatcataccccagttgttgtcagattgaactcataccccatcatgcccttgtatatgaagcttatactccccctttttctatgactggaaacattaatcttttaagactcagctttagaatgttgtctgcagtccaggtgaagtgcctttgtaactgctcctgtggtaacctatgcatccttctctcatagcaggtgtcttgctctattctaaatttttttattacatgtccttcttcctactaccccagaagctatttatctatatattcccagcacctaatatggtgtttagtacatagtaggtactcatctatgtatcttcatcacctaatatggtgtttagcacgtagtaggcattcagtaaatattaatgaataagtggttaaattaatacctaggatttgtatttccaactgattgtcctcatgattcttaaaacatcaagctggtttccagatccaaaagttgaatatgatagactattttaaaataattttatgcaacaaaaatttcagaactagatatataatgattatacaatgaaactgccaagttttgtatgcttaatcaccaatactcaaggaaatttcaattgggactgaatgttttaaagtgtccatagttttcattgttgttaaagttgtttttatggtgttttatataataattgtgttaaatatcaaggaagaaaaaatatcaagaaaggtatgcatatgaaaataatagattttttaagctttaagtacatcaagatcagttcatctgttaacattttccatatgccagtcagtatgctaagcaattatcatactattgagatatattatctcatttaatatcccagcagagcagattttatagttgagactgagacttaaaatttaaataactgtgattatgcaaggttaaacagctagtatttatagtgaagtagtatattagttggttctcacgctgctatgaagaaatacccaagactggataatttataaaggatagaggtttaattgactcacagtttcacattgctggggaggcctcaggaaacttacagtatggcagaaggcaaaggagaagcaagcaccttactcacagggtagcaggacggagtgagtgccagcaggggaaatcacagatgcttataaaaccatcagatctcatgagaactcactcactatcatgagaacagcatgggggaaatcacccccatgattcagttacctcccaccaggtccctcccacaacatgtgagaattaatggggattacagagattacaattcaagatgagatttgggtggggatacagtcaaaccatatcacatatcgatatgaacataaggatgtctgatattaaaaactgttgcttccgcttacactggacccaatattcttacaacttcttttataaacagatattctttcttttatgaacaggtatgtagtgattgttagatgtggaaaatcgcagtgcatttggcattttcagccatagtctgtacacttgaaaagacatttggatatggtatagtgtaattgatttaatgctagagtggggaaatgtgattctttaattatttttgagtcacaggatcctaggagaatgtcatgaaaagtgtgagccctctgtacacaataaaatgcatacttctaaaaggtactctgttttaatatagtcttggagtctgtaaaaaacacagacaaggcccagaactccatttctagatgatttacctattttatggatgaagaaactgaggtgcaaaaaggtcaaacatgtttctggaattgttgaccaagcgcatccatcaagaatgccctttagaaggtgattttcttgtggaattttctgaattcctagaaaagtactgtgattttaagtctcagcaatatgacagtaatactaaatatattccaagtatatttatgcatgaaaatgatttcatattttctaatatctaacatatttcttgtaaaaatctattgagaacagtaatttttttggaaaacttatgaaattacagtaatgacttagagtaaaataaaataaatttgcacagaagtttatcatttaaagaagaaaatgcagaattaaaatgaaataacactgatcgatgaatattatcaccagataaaataattatatggtagcacgacaaatttctatgtttgtgaattacattttctacctataaaattatttcagtatgacagagctattttatgcttacttgtccacataacagttctataaggagatgcggttttgtagcttctcattttaaagatgaggaaactgaggcttaaagtttaattatttatgcttggatttatagctatataagtaacagagccaagagctcattagagagatcttatccttctgaactgagcagctctccatcgtttcacatatatgcctggagaaaatcacatagatgtagaaaacaaattccagcagctaagagagtcacaagcgcgtttgctacatgttctttattttaaagcctgccacttgcttcctcagtcttgcattgtttcactttgcagagctctgaaggccagagcatacatgagtaattcagaacgattcttagctttcatttccgttttaatccatgaccctaactcatacattgtgtttcacctcatttttttccagtactatagcaaaggctagtttacttcaaaggaaactgtttaaatgccattatcaagatgcatgatatgttaacaattattacataaagtttttcaaatacagaatgtttcagtctcacaatatgattgtataatttgctagaacaattactgataaaggggttatcagtgcctgtgtttaagaatttacttgagtaaaaaatgtaaaagtacaatttttaaaaacgccttccagaaagtaactaatacaatacaatgaatgtgagttacatttactggtgattaacactttagtaatacttttgatattacatttttaaaggggtcttcttccttctacggaatgtgtgtttatggtggcagctttaatgctgtttcctactgtgcagttcaatagagtatgtttttaggtggttggttgagggtttttttccgttatgtatgtcgatggagataagtgttttaattacttttttaatgtctgtgcttttgtatttttctcctctctttccttttatttcctgctgttgagattactgcctcatctccacagcaggtggctgttgcaaatttgttttctttgtaagcctggaagatttattttgtaatataactgttcctttttagtattttattattaatgatttctttactttgggatatagtgtacttacacagtcctaaacagtaatttcctaacactatctaagaactccaatcattaagaaaaaaaatctttgcctgaggcgtattgtttgagatttttgcttacccttacttcacaatgcggggattaaaatttaaggaaattgttttatagcaaaagccaaatgagaaaaagaaacagagaaaatagaagggagggaaataaagaaaaggagaagagaaaaggctcaagagacaaagtatactttaataaataataccataaagcagagtaatgaggataaatttatggctgaaatatgaaattacattaacatcttttctagaaatgtttcaactaaaccaaatgcttatattaaagtataatttcaattattgcaataacttctactaattataagcaaattgcaatattataaaataataatgaagaaaaaggtacttcttttttttgtccaaagggtttgttgttctcattgtgtcataatgtcctatagatagaagaaaagatgcaacagatcctaatatagacatgatctgttataaaagtacaatatactcaaggatattttatccatctccataaagaaagccataattttgttaaacaaaataaaatctatgtattttttccaaatgtataaaggaagtaaaaagtatgagaccaaaaatgcatggtgaacccatattctcattgtgtttgtattaaatcactggacatttattacagataaaaaatcctctataagaatttcaaccactcaaattcaattcatttcatatgtgtacttgtacttcttaatacattcattgctttgttataaagaatatgttcacatcctttctcacctgtagatattctaaattgaagtctgatataagttctaacatgaagttaggtgaagtaattacattggcacgatagaatttgtgtgttttctacatgaagtatagaagccaattgaaatactataacttcataaaaattatttgattattttattctcttttctagtgctttttaaaattgtactgttttatacattaaatacaaagagaaattcagcatgtatcagattttcaaaatgatataataatactcagtaatccacttggttctggacttattgttatgtgctggtgtacaaaaagaatcttgtgtaatggaaaaaaatactatttaaatggtgtctccattcataacatttttaaaaatgttcttgttattctctaaccaattgtgtgatacacacaattaatgtgtgtggtcacatttagagaaagagtatagacagcagttatatgaaacagatgtttaatggggatttcaaaaatcaatgaaatgaatattattgtgatgcatggtgatctaatttcatatgtgttatattgaatcactccatttttttctgcattctgtctgaacactcagtactaaacgcatttacagcagcacatcgggaagaaaatggggagttttattgagaaaagaaccacaataggccatcattgatctattctctttctcatcaatatatagatcctagaatgataacccatatggcactattgtcccttagaagtaagacataaatcctttgagtgatctttaagtgacagatgaaacactttataatccattgtggaactgcgacatgcttagttagacacttgaaaggaatattttacttccatattgtaatctcaactgcttgggcttgaatcaggaatagcttatcttctctaatacatatataaacatatatatacatagatgcatatatttatgattttctacctacttttacacatcctgtatacagccacccaaatggcttatgattagtttgcaatatcttctttatttgaaagtgtttattatgaatctctttatcatgtaagcctttttcccccatagtttttatattttaccaaagacagtaataatgacttacattttaatgttattttagatttaccagcatgctttatgtgcacttttctacctaattttccaaagaaccctgtatagtaagcagggttgtctgcattctaaaatcaaggagtttgaaagccacaggattaagcaattttattcaattacagttagaaaatggaaataatgagattagaacccagttctttagaccctaggtcaatgctgtctgagacatgattttgttcttaatgctccaatttgaatgacactttgagcaggagtggactttatcttgctgttaatactttccttgttttgatgcacatgtagctggagttcattgtagtctatagaatgaatgaagttagaataatactcttatgtggctacatcctttcattttagccaaagatgctaagtttcgtggactgtgatactacctatccaatactgaccacttaaatatgtaataatataaactgtgtatatcatggattagatgatcatttaacttatatgtactcaaacgtatcatttcattaagtcaaacaaaggctttaaggaagcaaagaaaattaaaggaaacatttatttcacatctgtgcaaagagctttatatacctgtttttcgtgttaattctcccaacagtcctgtgatgaggaagctgttgcccagaaagtataatttatttggccaaggtcataatagctagtaagtgctagaactagaattttaatgcaggaagtctgacttcagagttttcagtcctatccagtatactgtttacaaataattatacaaataggtcagtcggccttaagatattttataagatttaataaacaaaaataaagacaaaagttgttacatggatttttcttttactaagacagagggggaagttagcctggtttattccataaatacatgtttaatctgtatattttaatactgtccctaatgcagcaccatttcccaagccagcattagaaaataaggactgagtaacataacatgtgagatctcacatacaaaagtactttggaaggtgaaaaacttacggtatttgccatcagctacattttgctgatctcatccagaaaacttgagagtagtgacaatcagtgttgttttatttgtctaccaaagtcttattgaaaaagcacctgtgtgaaataataagaattggtgttcctgtagagttcagtatactagagcattgtccatttgtttttgtttttgtttttgtttttttgagacagagtctcactctgtcacccagcctggagtgcagtggtgcgatctcagctcactgcaacctctgcctcccaggtgcagcgattcttgtgcctcagcctctggaatagctgggattacaggcatgagccagcacgcccggctaattttttttttttttttttttttttttttttttttttgtggagatgggtttttgtcatgttggtcaggctgatctcgaattcctgacctcaagtgatccacccaccttggcctcacaaagtgctgggattacaggcaggagccaccgtgactggccagcatcacccatttctgtgagccacagcctttggccagggacctgaggtagtttctctgtggtctgtgctatcttcttcacacctgggatttgtgagtctatctccaaagatgactgtctttctcatgatggcttagctgtcattcagatgaatcctttcaaggacaggaagcatcacacaaatgcttgcatcattcagttaacactaaacaagtggcttggtgaagtaacacaagcaaacattatagaatctgagtaattcttaaacatgccctaccatagctatgaaagcaaagccttaaaagcttttttttttctcttattacttcctagattttaatatgtaacagaacatctaatatcttgttcatgttaactgaagttgtgcaaaactttatgtgagcacaaggaaagaatttactatatatactgctgttatttattctgtagttgttccagagggaggtgctttggcaacaatgcaaggatacacatttcaaagaatatcaaatagtgaaaaataaccaggatatacccaagaggaattcacttaagaaggaaaacatttcagaaagggattgtactggagaaaataatcacaaaacaaaaatgctgacaagagaagcagccagtcctttctctgtcactagattggaacctggctgcagacacatcctgtgaggtacgcatatctgcagccttgtagagaaacttaatacatacatgttgaatgattactttagataggactggttatgtagcttcacattataacctggcctagttataaccttaaacatgaaaaaggcagccattttgaactcataacatagactctacaaccagtgtccacgttagaaattggcgctgcttcttacatgttctgtgatccttcagcgagttacttaatccctatatgcctcaatttcctcatatttaaaatgtggataataacatcagttgcctcatacaattattttgagaattaaaatgagttatataataatcacctgggggccaggcatttagagtagtgtctgtagtcaataaaagttaatttaaattttctgtaacataagcaggatccttccttccttccttcgttcctccctccctccctccttccctccctccctcccttctttttcagagaacgtgaaaatcaccatttaaaaataattcttaaggaggtgttcctttgtataaatgcatgctaaaacaccaaaaacttcaataactattctaaagaaacaaactatccggcctccttgaaagacaaagactatacatatctactacgctgaactgttttgtttgtcaaatctttgtcaattcatctttattcataaactctctttttcacactgaaaggtgaattaaaaagtcatttcagtgtcattttgaaatcatcctagtatagacacataccttatttattaatatgccacctactctcagagaagtcttcctttgatagatgactatttgcaagtttcattttctttcatatttcacttaaggttgcctcatttttctttctttgtggaacttgatttacatatgctaaggtttaatactttatttttatttaagcttttattctttccttgccatgcaatatgaagtatgaaataattgataaattatagaataaacctatcttaatattaatagctaatgtttaatgagtattcacgatgtgccagctctcaattatatatatggtttatccatatggatatatttttaatattttcataattttgtaatttttttaacatttttaaaaaatctcacatccatgagagaagtagaatttttatctctgtttttagaaatgaagtagtggaaaatcaatttcagggttctccagaaaaacataattagtaggatggacagatgggtagatagagatgacttattttagggaattgggctatttaattgtgggagctggtaagtccaactccttagcgcaggacaggagactggaactcccaagtaggagctgattgtgcagacttaagacagaatttctccttcctcagggaaaccacaattttgttcttaaggccttttgattaattgattggatagggcccacccacattattgaggcaatctccttaaagtcaagtggttgtagatattaatcacatcaacaaaaggctttcccagcaatacctaccttagtgtttgattgactaacgggtgttatagcctagccaaattgacatctaaccctaaccttcacaggattcacaggaacttatacaataccacagaactggtaaatgagagaggaaggactcataccaaagtctgtctagtgacaaaatccctgcttctgatcatcccacagcactatgattagcatagactatcaaagtatccacatggagaccttcagatgcactgtccctggccagaagggatgacctgtcacccaggtagaggaggagggctccgtggaccttgaggccctatgtgtgacctggggtgtggctaaataaactggaaagaaaagctaattatatgtagcatatgtatatgttggtttgaatagtcaaatgtagacctaacttcagtcttcttttaacaggtttcagaagaaatcattttgtcattagagagccttcaagaacatattcagctatttttaccaaccccatccctccaacccaggttttctaaaagaatcacataaacggccacccatttatataattgtttctgttactaatatacctttttatgtcataaaagggggaaacagtcttatccccatttcctttacagagaagctgaggcaaaggcaggtgaggtggctcccctaactatgctactacataatggaaatcattttgaaagcaaaagttcttttaaaatcatttatgagcaaatgctatggaaaaggagattcaggggatgctggatggggaagaaaaatgtttggtttaatctgaagagacaatggtggtttattgctgattacaggcaacccacagaaaccttcagctttcagatcagatatggcacccaccttatctcatatgacaaaagtcatccttcggctatgcttattactctgtatctaccagcaaatgtccattgcccttcatttcattgtaaaataaactcctgcctctctagaatgacccattggtagaatgagtcttagtaataaaataaaactacatgttttcccctgcatttatggaattgagatgaattatttctctacttgccttggatggggtgactgctataagattttcttcatttacactttggaaaaaatttagtctgccatttattttcctttcaaagttttggtaagaatttactaatttatagttgatatatgtacaatgtagaaaatttggaaaataaggaaataataaaaattggaatatccttaataccaccactctaaatgatctctgtttagattacatggtttatattaatacatttttttacaaaatttgaattatactatacagagttttgaatcctgcaggttcatttaagactgtattttgattacaatcttataccatatttctcaaatattcgttctgttgtctttttcttttatacggtaaaactaatttcttcatttacctgacattctggtactctctcatcttattttcctctttctgtattaatcatttttgtgcattaaacctttatttgcatgtgtcagtattttcttaagatagatttaagactattttctagatattgaacaccaatgtatatttccactgaaagagtatgacaagttccatgtctacccttggtgtatagtttaattttcttaaatatttttctttttatagagaagttacaattttattcttttaatttgcagtttaatgacttaatggagttaatatttttagtgcttataggtgatttatattttttcttctcccaatttttattattctttatgtttccattgaaaagctaatatgttccttactgatttggagaatttatacagtaaagacatttaattattaaaacatcttcttggttaataattttcgttttaattcatttatattttttaaatttagcagtggttgaattattgtggcaaaatacattgttttttcctttaatttttttctttcattaaaaaagaaatgattttacttattcaggaattagataaatatgtacccatttttaactttttttatatttagtactttaatgtagctgaaactgacttatttatgatatgaggcaagaatataacctgattttccctgtaatgttatatatgtttatgtgtgtatatacatatgtttccatatatttataggtatacattaatgtgtgatttacgatgtgtacttggttatatattaaagatatacataatatactctgagatccgttagactgtattatgtacattttatattgatttgcttacagatgttttcctctaagaatgacattatttcaaagattaaagttttcttttttgttttaatatctaataggaaaagcccctcctcctgctaatgatattttataaatttgattacttaggtttgccagaacccaataaagatgccatcttccaaggcctgacgcaggaccaggggttttatacatccaaagactttttgccacttgtagccaaaggcagtaaagcaggtataacatattgtcttttatgcttaatagtgagtatgctattttatttatgataaattaatatcaaaatcaagctcagcagcacattgttcagctctcacacccaaccttgcctaagacccaaatgtaaaattaaaaaaaaaaaggccgggtataacagtttgccagaatcatctgtttgttcattcttccaataaagtatcatcgtaaggaattttcactgtaatatatatgtctaaactacatcatgaaaaattgcttcaaggtaagcaagtccttaacaaacattggaagatgtttttcaaagaaatggcatgaatcgtcacatatcttatatgatttgtatctacacaggcagaaagattgactgtcttctcttaaacagtaattttatgatgttaaaataaaatactttgatagacaccctatcactttatacaccccaagaagaaccacctgaatgaaggttgtaccttggtttggcctgaccagagtcattgtctttggggaaaattgtaatattttatccaaagtcagataatctaaatccttcaaatgtatatttttaaagaggtctgagccacagctattcctacattaattacatgtagaaatgatacaaacttttatgcttctcccaggacttaaaacagtaagaaactttctatattaaattattcttcagaagtttacagctaaagatgcataccctctccaccttctgcctctcagtagaactggatgtttgtatgtctgaaaccctttctgaggaaggtcatagtgcacctagcttgtatttgaaaattacagagtgtcccaaatacaaaatcttccaagcaaaatgattacacttattgaaattataggtttattctattcttggtaccatttaaaaaattatagtaattgatcttataaacagttttatttaatcttattatacactgctacctaacacataaggaatacttgcattttactttttttacaaggatcttcatatggacagcaaatcttaatagagatgaccttgagaaatggatgcttagaaagtcatatttcttttactgcccagtttcacaaacaaaaccagaggaaagcagtgaaagggagaaagatttatttgaactatttcaagaaaatagttctcagaaattcttcagttacataaaggacacttattcagcacgttaatattcaaagttaacaaaatatataacagaggtatgtgttagaaattatataaggtaatacataaaaaagtattataatgaaatattgcaaaccgttaacacagatcataaggatcacttttttcttctagcaaaaggaaaattatgctgagttaaagatagatagcacaattttgatgaagagagttttaattgattgattccagtctgttatgacctaaacttctcaaaatgtgttgtaggaatcctagaagaaaaaagaaactaaagatactgactatgaaattacatatatgagcatatttttaaaatgggaataaaactgtctttcaatgaagcagaataatttgatagtgacacttcatcctggaaaactgcaagatgcaattttacactgctttgagtacaagtatcttttgagctgtcatgcagaaatggtttctctacttgaaaatggggttttcctttcatcattcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctgaggaggtaaaatggaaccatcagaaaatatggagttgtactccaacagattttaggagatgaaactgttaatgtttaaatcgctagaatgttgaaattgtcaaattcaagtttaaaaatttcagggctacacataattgtttcttttctaattcagacattccaagtaaaagaaaatttgtaatactgatttgggtaaaatgagaaatttaatctttgtcaatactcaagggcttcttgttagtgttaatatgcttgaaatgtattctatgtaactagtaacaatgtaaagtgctaagtcttccatatcctgaatagtaggtactcttcacaaaatgtatgcatattagaagaatgtggtaataagacacatacggaattttccgtaagccaatttacagactgcattctaagatgtataccttggtcatactttcagtcagttcattatttgtgaagcaaatagaaagaaaagggtgtcatgtatatttttaaagtgctctaatataagcactactcaaaattagtagttagttagcatactaaaaataacgtttggctgtgcgcggtggctcacgcctgtaatcccagcactttgggaggctgaggccggcggatcacaaggtcaggagatcaagaccatcctgactaacacggtgaaaccccgtctctactaaaaatacaaaaaaattagccgggcgtggtggtgggcgcctgtaatcccagctactcaggaggctgaggcaggagaatggcgtgaacccgggaggcggagcttgcagtgagcccagatcgtgccactgcactccagcctgggtgacagagagagactctgtctcaaaaaaatagtaataataacatgtttaaaatcatttcattcttaccagtgactggtgagtagtcttgggtgaggtatcggctatttacatgtactacacacttctcaaattttaatgctattagagaaatataataccttataaagaatattagttctgagaacaagaaccaaatgtatttatagaaagataaattactcatttaaatcaaatcagtattatgaacttgacttgcttcggaatgcctgaatgtgtttggagtctctatactaggcaagaattatagctgtagtcaataggtaatttgtcatatgtagattacccacattacaaattaatcttaccaaaatatcagggtcaccattggttcatggctgagtttcaaattccacgtttattatctggacttttctccatccaatctaccctttttagacttttttataaaatccaaggtagtttttatgatcataggtttcttttttttttttcctgggatacagtcttaggcaataattagtgtaatcatggtttttttttacacatagaaagaaacattttgatctttgtattcctgtgcatagcacaggacctggcacatagtttgtacttgagaaataggttttgaactaaacattttaaatattaagtcttatccttctgattccaatgttagaaaagtttcattaccaaaggtgacttcttgagggttggaaggggaagatgacactgattggcaatatcaatttacttcacattttatatcatagtcatcttccatttgcaagggtcactggaaatgaatggtggttatttcttctgtcttaggtagaactaagacacaaacaaactgagaccagataagaagagggtagcggtatgaatttatttattcattcattcattcatttattaaaactacatttactgagcatctattatgtaccaggtattgttctgggcaacttagatacaacagtcagcaaaccagttagaatttcatgccctcatggaatttgtacctagtgacagaagatacccaataattaaacaaataaactgtcacataaataatatattgaaaagtaattagaactgtggagaaaaattaatataggagtataatgagtgtgtgagagatgaggataatggtggaagagaaggcagggtttgccattttaaacagggtggccctggaagacctctccgatgagatgatttttgaacaaagagatgaggaagttgagggaaagtaggcatccaggagataaacattccatggcaagctaaatgccttcaccctttattgtggaagtcttctggatttgtggaatagaaaaaacgccagtatcatcagaatagagtaagagaggacagaatgtggctgaccggattatgtattgtaggcattcataagacctttagcttttactctcattgaaagagaaaaatcactgggctgctttgaacagagaagtgccaagctctgatttaaattttaaaatggctactctgctgagaattgactatagtggagtggcatcagaagcagagaggctagtcaggggctaagtaaaagagtgagctattggttaatgtgagtagattacaagaagcacaggatcagagtagaggcatagcaccttggaaggccagagctcagctgcctgaaacttgattaccaaagtgttgagaagcaacagatccttgagataataggtaacctgcctgcagtagagcttagtagaactcaaatgggtctggtcttaattaaaactagaagaacaaatgttagattgtttgaattattttattattagcttacaattaaccaaatttttatatgatattaaaactaattgaccttgagcttcatgagagaaagggccatgatcatctctctgggtcacttttaccttccgcctgtttagcaccttgggtgctacctataaaagattcaaccaataattgtggaatgaatatttactggagggaatcagcaccgaaggctttctagcattacacgggctaataccttccaagttagataaatattataacagtaggcctttgaaggttcatctcataattataggcaaaatttcttggagagatggaataataagtaatatatgattagattatgcaaagttttcaggattgattctcttaccaggggtaataccatgtaaggactgggaacttttggcattcatagaagtttcagtgttaatcctttatggccattgcttggttttgtatacatcaaaagaggagccaaaatattgcagtgctaacactcatgaaactggaaagtcaggagagtacaggtccaatatcattatctactttaagatacaggttttgaaaggttaggtctagcacataatttttagccaatatgaagaatttaatattggccctaatttcttgagtaattgtcttctttctcctacactgtctcccctagtaaaaacttcagccacatttggtttctttagagtcagtgaagattgagggacagggacatttagagatgtcgtcaaatatgtgtgttatttaatggtcatggactcttgggtgtaatttggaaatagcatggtttgtcagtaaaatgcctcaccattaggcatgtcaacatgtatatgtctgatggtgcagtctaattctcattctctgagtgagggaaatacagaacaatatgaagtttacttatcctttagtgacaaatatgaattatgacagaagccagttacatttaacatggtttattagtccattttcatactgctgtgaagaactgcccgagactgggtaatttataaaggcaagaggtttaattgactcacagttcagcatgactggggaggcctcaggaaacttaacgatcatggaggaaagcaaggcaccttcttcacaaggtggcaggaaggagaagtgctgagcaaaaagataagagccacttatacaatcatcagatctgtgagaactcactcaccatcatgagaacagcatgggggaaccacccccatgattctcccttgacaggtggggattatggggattacaattcaaaatgagaattgagtgggggcacaaagcttaaccatacacatggaattgtttgagaccatgtatattatgtggttagtaaccaagaactatatggttagactcaggaatgttttaatccacaaaagtaggagacatcatccaatagactctgtagtgacaaacacatcccatttctctaatgtagaggttttcaaactttagggtgcattaagtcacctagagggcttgttaaacacagattgctgggccctgtccctagagttgctgattcagtaagtctggggtgggtctgagaatttgcatttttaacaagtttccttgtgatgctgaggttgctggtccactgctctgatgtatcatcaacatgctttccagctgtctaattagagtcacaaacagtgtgctgtgtggaggtactttccatcttggctaagaaagcattaatactaaaggatataggtttgatgaaatgaagatatgcaggcatcatcagcatattgatgtaattctgattccaagtgtctttccagctcccttgtggcctcacacacatgctaaataggatgctactgacaaactagcgcttctcagccatgggtccttagggaaaccagccaatcactcgacactatcctctaagaagatgagggaaaatctgttaataattccctccagtactttctgcaagcttaaataggtgagattaaatttcacaggataacagaatcccccaaaatgctggtattaaaagctgttgacagatcagatagaactgcaaggatgctttaggcagttgggaatccctaaaaggaggcatgaaggtcagaactcaacagacctgctagagttgataaatttaaaggataaggttagagaaggactttatatttcttattaattattaccgagaagaggatggtttcaaatttacttttaatagcacaatcccacacacaaagtatatttcaaagatctgttatttacatattcaattttccaataggagcaaaacacgattgatctttaattctgctgcatttttatggggcctgcatgctacccctggtacgccttagcttccctttgtttgtttgtcaaaatggtaactgatttaactttggtatgtcagtttttacatgttttagctattgagagggttaactgttttgataattaatgctactttattattttaattagaaaaataacaataccggattgctcagtctgttcatcaaatttttcttcatctggtactacaactttgaaatagcacaacatttaaaagaatgtgccttttacctgatttttttccaccaccacacagcataccccataatagatcatttttgtggcatgacctataggcctcttctcagatatttttaatgtcaaaggaccatgttaaagctatgtctatggatagttttgtcatcaatttcttatggctaaacatgcttttttttttttcttttttttttttttggagatggagtcttgctctgtcacctaggctggagtgcagtggcgcgatctcgactcactgcaggctctgcctcccgggttcacgccattctcctgcagcctcctgagtagctgggactacaggcgcccaccaccatgcccgtctaattttttgtatttttaagttcgaaacggggtttcaccatgttagccaggagggtccccatctcctgaccttgtgatccgccctcctcggcctcccaaagtgcggggattaccggtgtgagccaccgtgcgtggcctaaacatgtattttctacagataactgatgttttctagttttaatttaattacaacaaatatgaacctgggactatttttagaaaatagcccccataagctgacaaatttaattttatttactaaaagtgatgcttacagcagttcttcaacgtttggcacctgcacgtcatttgagttggtgttcttcatggaaggtaatcagagacatgttgacatgatttgctctctgaaggtagctgaaaacgaacactcacacaaaatcttctctaggcacaaaaagctaattaacagtagttaggggctcccctggtactaagatattaaagtacacctttaagactttatgatgacagggggatgacacattccaaggatctgtatatatttatcttttggaaagttgtgaaacttcagtgtagtatgaaaaggtagaatggaatagtcaaaaaggaattacagttggagcacttggttcttgatttacattctagtctgagtatgcccatctataaaattagtgttgtaattatatgcttcttaaagttttttccattcctcattttatatttttaacattcagagaaatatatatgaatgatgtggaatctggacaggaaggctctatttcttcacagagtgacagctctatactgaaaattttagaaatgtgtataaatattacacttaaaacaaattgcaattaatgtatccccagccaattggtgaggtaaaatctaccatattcaagacatgagtataaagaaactgacaggtgaaattgtcagaattctacagtacatgtgataattcagatggtgagtggaaaaaaaagaagactgcaaataggccaggagccaacaaaagcttgtgcccatttaagattacatattttaaaagcataactattttcaaaattctgaaggaggttgttgcattatgttgaccaggaatatctgaggagctgaaaattatatgcttttaagaaatctttactaatcttctatatatatttttttcacagcatatatatatatatatatatatatatatatatatatatatatatatatatatatgtatgtatgtattttcacagataagcccacagattcattaaaagtgaacgttttttacctggtgtgtcactgtcaggccttatttaataacaacaagttgttattactctattaatttttttttcattttagtagtttgtaatgaaaattgtatataagactactttattcctgcaccatctctatcgtttctatcttatgtttgtcctgttcctttcccacttggtgagatttggctttccattcaaggatcttttgtgggtttttttcacttccaacctaataaccaccttgctggggcaatgcccaaacgaatagttgtcctattagcccagtctttttctgctgcacccgttcaatgtaaatgacataattcttcctgtaaccttggaccactttgccaacttgctgaactttttagtgtcctcacacaacctgaacttcatcatcctttcagatgggcatggatcaaacattgtacttctatctcagctctttggaaagagggaagacataattgttctgtgaacatgggaaggtgcattgaaataccttttatggttctttcttgctgtcagaagtcacaaaggagttgaacttccctttggccactgcctggcaataattgaaagtgggaagagatctgtatgctctacttcattcatttttaggtgaacattagaagcccctcttcatttaaaaatattcacctccgcttttcaatatcttttcttgtcctataaaatgaaaatattaaaaagtaatttgtataatctattaaacacacattagtcaatgtatatgctattcgaaagacataaatgaaaaatacacatgaattaacataaaaacaaagaattgtcattgttttaaaagtgattttttaaaaaattttaaaatttttttctaaaattctaaattctaaaattccattctaccttttcatactatactgaattttcacaactttcaaaaagataaacatatacagatccttggaatgtgtcatccccctgtcatcataaagtcttagaggtgtacttaatatcttagtaccaggggagcccctaactactacacgtgaactcatccttcaaggtctgctccaaatgtcattttctcttgaaggcttccttagttccctaccaatttaatttctcttttctgtgggctttttatgcttcctgctgttaatagaatttatcacatagggtacttattactttatacttattccataaactgaaatacaagcttctttattggattgatgaattcaacttggtatctgactcaacatatagtgcagcccttgattcaaggtggcagaccagtgaggcatgttgaattagccaatatattaaaagcattgaaaacttcataggaagactttaagttaatatgaaattttcaaaatatataattttacgtatgtacatacaactcaaaattatttctgatagcttttaaataagtacacattttattttatttctttattattattattattattattatactttaagttttagggtacatgtgcacaacgtgcaggtttgttacatatgtatacatgtgccatgttggtgtgctgcacccattaacttgtcatttagcattaggtatatgacctaatgctatccctcccccctccccccaccccacaacagtccccggtgtgtgatgttccccttcctgtgtccatgtgttctcattgttcaattcccacctatgaatgagaacatgcagtgtttggctttttgtcgttgcggtagtttgctgagaatgatggtttccagcttcatccatgtccctgcaaaggacatgaactcatcattttttatggctgcatagtattccatggtgtatatgtgccacaaaaattaattcaagatggattaaagacttacatgttagacctaaaaccataaaaaccctggaagaagacctaggcaataccattcaggacataggcatgggcaaggacttcatgtctaaaacactaaaaacaatggcaacaaaagccaaaattgacaaataggatctaattaaactaaagagcttctgcaaagcaaaagaaaccaccatcagagtgaacaggcaacctacagaatgggagaaaatttttgcaacctactcatctgacaaagggctaatatccagaatctacaatgaactcaaacaaatttacaagaaaaaaacaaccccgtcaaaaagtgggcaaaggatatgaacagacacttctcaaaagaagacatttatgcggccaaaaaacacatgaaaaaatgctcatcatcactggccatcagagaaatgcaaatcaaaaccacaatgagataccatctcacaccagttagaatggcgatcattaaaagtcaggaaaccacaggtgctggagaggatgtggagaaataggaacacttttacactgttcgtgggactgtaaactagttcaaccattgtggaaagtcagtgtggctattcctcagggatctagaactagaaataccatttgacccagccatcctattactgggtatatacccaaaggattataaatcatggtgctatgaagacacatgcacatgtatgtttattgcggcactattcacaatagcaaagacttggaaccaacccaaatgtccaacaatgatagactggaataagtacacattttattttaaactgttaaaaaaaatattgcgtcacatttttatgtcaatctaacattaaaagtagactgaaaaaagtaaattatccctagttttcagtctcttaaaagatacctgagaactaaaaaaaaaaaaaaaaaggaaatacgagcaagcaatatataaaaaagcaaaaaataataaaaattactagaatccgagagtattagcaggtggcagaaaacagatgatcctaatttgtaaagaatttgtacatggaggcattttaagattaaaggaggaactacaaaggcaccaagttacacagaacgtagttttgtgagatactccaacagctgccagggaggcttgaatccatcaaaacctaagatgaagaaaataggtgttaggtttaagaaaacgtcatcatatgtaactaacctgcacattgtgcacatgtaccctaaatcttaaagtataataataataaaaaaagaaaatgtcatcaatagtaaatgaatagtgtttaaaaatactctttttggtcaggcgcagtggttcacgcctgtaatcccagcactttgggaagccggggcgggtggatcacgaggtcaggagctcgagaccatcctggctaacacagtgaaaccccgtctctactaaaaatacaaaaaaattagcggggtgtggtggcgggcgcctgtagtcccagctactcgggaggctgagacaggagaatggcgtgaacccgggaggcagagctcgcaatgagtggagatcacacccctgcactccagcctgggcgacagagtcagactccatctcaaaaaacaaacaacaacaacaaaaaatcaaccctttacttgttaaaagagatgtatttaatgatagttgtgtcaagccattttaagcctctaaattattccttacattgcatatctgggttttgcagcacaatagtgacacaataaaattagtaaggactcagttaagggacgactatatttatccaatgtgtagtacaactctcatttggttaaatgtttctttatgttcaagattcttcaactttaaaaaacttaaaatgaaaacattctatatgtgaatgaagcctgtaataccataccaggtactaaaagaaggaatgtcaatttgtggtctcagcaaactttttttgcctaattaaaagaataattgcagaatttgcttgtacaggccagagattaattaacatataaaaattgttctgcatttcaccactcaaaataaaataagtcaaaaattactaaatattaaaaaactgtttagtaaattaaagaatatgagatcaagtgtgaatgggccgagtttgatgcctcttcctttaccctccttcatgtccttggtaaccaagataactagaagattggattgtgaaatcaaattcatatgaattaaatatcactctgtatcaaactttattattaacttcaaggatacaattaaaaacaaactcaggtaaacaagaagtgcaggaccactgcccacagatttcctcaggttctatcttgctgcattaggatttgctctaaaccagattaacatgtggtctctaagtcatgtaagtagctccatcacttaggtcaaaaaacttgtttcacttatgagacatctaatttatactcagatagttatgtaacttgcattactctttatagtgatctatgccccctaaattcacgtttccaggtttgtttactatagcaatcctaaactaacagatacgccatgccaaaagcattccattggtaaggactcttccacttataaatgacaatagtttgtttcccagtaggatgtttacatattacatagagctttaaccaagctgctttccttcttttcttcttgagataaactcctttacccttccacacccacttcttcaaagagagagaatggattccatacaagaacttcctagtaactaattcctttccagtgattaattcctacttttctttcaagattagcttatatagcaccttttccatgctgtcctttcttttttttttttttttttttttgagacaggatcttgctgtgtcaccaaggccagaatgcagtggcgtgatcacagctcattgcaatctgaaacatctgggctctacagatcctcccacctcagccttccaagtagctgggactacaggcagatgccaccatacctggcaaattttttaaaaaaaatttagtagagatgaggtttctctattttacccaggctagtcttcaactcatagccttaaacagttctcccacctcaaccttccaaagcactgagattataggcctgagctaccatgcccagcaatgctgcccttccttgatctgcactactgctaggtgaaatgcccatttatgtgccattcaagtacactgcctttacacatgacaaagattcctaacttggccaatttttttttttttttttttttttttttttgagactgagtctcgctctgtcgcccaggctggagtgcagtggtgcgatctcagctcactgcaacctccacttcccgggttcatgccattctcctgcctcagcatcctgagtagctgggactacaggcgcccgccaccaccccagctaatttttgttgttgttgttgttgttgttgttgcatttttaatagagacagggtttcaccgtgctagccaggatggtctggatctccagacctcgtgatctgcctgccttggcctcccaaaggccaaattttaatcaggctcctaaaccttctccaaggcccacctgtgtacttccccataaagtgcagttttagcaagaaccctccattatcaatatctgatgacactttttatcccccaaatgcgagttaaactccaaatacagaatgcggaggtaggaagtaatagccaaggagtaggttgcgggttagtagataaaatattactgaaaggaaacatcaaggtaaggcttaatcctgttggctaaatcaatctaacaggattcttgcagaagacaggcgagggtaagacatcacctgggtcatagtggaggatgaggtacctgatgagatattgaagatgattagatatcaagggtgagggattttgctaaactgacttagcagggttattgctaaatctggattttacaaaaaagcacacaagtgggcttaggaaaaggttcagaaacctgactaaagttgggtcaagcaaataatgtttgtcatacattattacctacaaatgctgattttctgcttctatgagatttttaaggcagagtttattttaactgtagctcacagcactatttttgtacataatatttaacaaatgtttggttagatttatgcatagagcgtgctcttaccacatggctctgaatgtttctggtacatccaataatttaacagtgatgaaatgagataatattttctaggtttatcactggccaaagtggacttctaaacaattttgcttctaaataatatttttaggtttttgtgttcatatagaatggataaatggtcaattagtattagagggtaacctttataaagaatgttgtttcttcatattgcttctcaaactttggcttattagaagttattccagaatttaatatatgctggttttgagctctgctcattatactttataacctattcttgctttgcctatgtgcaatctaaaagtgagttgacatcatgcttttaattatagaaaattaagttgtttcataatttctagagtatgatgcctgtaatattaatcagaccaaatcatcgcattacataaagttaatcattaaaatgatgatcattattgcaagtttatagcatgctatttttatttcactcagcatcagccacatatctttcctgaatatggaggtgaaaatcaaagctgagaattttttttaactttcccactactgtgtaaaaagaaagtgacaacctgatttgtcaaatgtaaaaaatggacccttatagctgcttactactttattggtggagactaggaaaagagaggttggcatgtttgcttgataaaccagttgtccctcataaagacatgctccatcaaacaaataaatatatatgggtgccatgaggagaagcattcatatccagattcagagttactgattattaatgattattgacaaacattagttgttaaaaggcactaacactgacatgtgtgaattacttgtcacagaaggctggttaatttaaacagtaacgctgcatgtggttagaccacaggtcaatttggtccatgttttctgatagcagcataacttgacaactgatgaggaacaccatttgcttttttatttcaacctcgcaacataggatgatctgggcaggtagcatgtcttctgctgtgtcctgttacttacattgggatggatgtttaatagccattcactcagtatactactagttggttgtactttccttaatttgaatgttcttcagattttcataataatttgtccttcattctactaaacaaaactgtattcaaggtctactgtgtgccaatcattttgatagacacaggtagggctgtgaccagtcttgatgccctgtccttccatgtgacattcacttgatgcctcttcgttggcttattgactggcatatattctgatttgctgggtgtctatcttaatgttcatgggcttatacttatcaattgttgactattttaatatcactcttggacataaaggatagaatgttaaataaggtattcttcctctaaagagtgttgagaacgagtttactatcgaacaaacttatttaaattctgttagtttttaaattttgtatcttaagataatatgttctgtgtatctaatatccactttgtgaagtagtacttttttttgttctaaatttactctttatctggattcaaggtgtctctattaactcgtttacagtattgggttcataaatccatcatgtggttcctatatttcatgattttatagtacctgtaaatgagcttagactgggaagcttgagtctcctcttcccacaaagggaactatgtctagccaagcccttcacctttcactttagcttttccttttccactttgctttgtttgaggttcagcaactagaatcatacagtctcattatttcaaatatactacagttgttattcttggacataatgaagatcacataggatttcgtttcagccagatcctaatttcagataagttttttcatcccttagtgtatttttggcttctctgagcctcagtttctcctctgtaggaagaaaataatgcttgtccacagattttttttttctttgtgaggccagcaagcagcagtgtgcctaaggctgtatgctaaatctgtaaaatcatgatgatgcccagtgcggttttggctttttgcaccacagcacggagacaaagtcggtttgaagctaaatactttttttttgtaacaaatatatgggtgtcataacattttctgtctgaagattgagttacaggtaaagcattatatgtattttctgtgtgaagattaagtgaattacctgtaaagcacttaaaagaatacttttaagtgttataaatacttattaccattattatttatcttcttataaaacaagatttatggctgggcgtggtgtcttacgcctgtattcccagtactttgggaggctgaggtgggcggaacacttgaggtcaggagtttgagaccaacctggccaacagagtgaaaccccgtctctactaaaaatacaaaaattagccaggcatggtggcgggtgcctgtaatttcagctacttggaaggctgaggcaggagaatcacttgaactggggaggcggagactgcagtgagctgagatcttgccactaccctccagcctgggcaactggcaacagagcgaaactccgtctcaaattaattaattaattaattaaaataaaataaaaaataacaaaaataataagacaatacttataacaagacaaataatagatttgttaaatagtgaaagtaaatccttataatgtccaaaaatatttcaaagtatatttcacttcacatgtaatgtcaattttaatttaggatctttaagatgagagcattccttcaatgattgggacaggctcaagatggaaataaagattttattacttacagttcctgaaggggtacacataatgcacagaggccacacacacggaggttaggagtgcatggagagagagaaagagaaagagagaaaatgggacctgcgggccagtgcctttatttatgggtccagggcgttatccaaacaggtttctcgtgggaaattttaactggttggtttaaagcaagcaggcacaagttccaggacgtcaagcattgactgagaggcagtcactgtggtgtgtctgcacagtccatgcagggtggagggtcagcaggaccagtccagcaggctgcatctactcgtttcatagggatgtggtgatcagggagcaggtgtataagggaaatatcttgatccaccacactgagaaacgggggtgctgcagggaggtagagtatagaattggaaactatgtgtgtcaagggtgactgaatctttcttctgctataacaaagtccagcttatatttaaaatagatgccaaggcagcataaaatgataagcattcactatacaagtttaccctgtgttttcattgtcctagtatttccctatttcccaagataaatcttaacatgatctcactctcccaatattaatactttccaaacaaatatatatatgcaaatgatattactattttttctttaaacaattttccctttcttatgtaaaatggaaaatctagctatcgagctaaatagcagaagtggtgtgatttatgtctgctgcttaatagtctagttctacatgtactagtgagtgaagaaaatctccaaagtttcaaaagcaaaaatgcagatgaatctctgtggggtccagtgctcatgccatccccagtgcactgtcggataattggtaagaatgccagatatttgaatacatgtaatcaaacctggggcacatagatgagcatatgctaaagccagtttttttatgtttgtaactatatatggttatacaaggtcctcaaaaatcaaaaccatggtgagaacattactaaacattactaaaacatgcttaggcattcagtgattaataatctttattttaaattcatagaagtttttgatttagtcatgtccaattttttgtttccaaatttaatgccaaatttgccaaaatatataagagattatctatatgtaataacagatactgtagaggtattaatagatagcaaagatagagtgggatcaaacagatcctaaatcgatctgtaagacatattcccaataggtacagcatagttcagtgtttcatttctgccctccacagaaaacagtactgttacaggtacacattgtatattgatttattcaaaccataaacatttggagttgttattcagtcaagtgtggcattatcattaaaatgtagcaccacttgacattttgaaacacaataaactggtttatattgatgagttataaggtgatatgtggcacaaatatgacaaaagcgatacagaaaacatattttacatattggaatcatatttattttgtaatttgaattattcaaggaataatttgccttccagaaatcatacatttttattttgtagaaaactaaagaggagtctaaggtttgtctttgtgctgccttttactaacctttgttattgggccacctttctcttgaaatcacaatcttatttctaagtgatattgaatagctgaagaatgattcagagaaaaaaaaagtgaattcagaaaatagcaactatgagtacatagccttctatatgctaaattctgctttaggcattttacattttggagttgttttaagtaacaccacacataccgattaatgagatggtgttctccccattttatatataaggaaactatcccaaataagcagcagagcagttttcaaatttgattcaattccgcttacctctaatcttcctgtctgaggagtgagcagttttatatcaactgttttgtatgtttaccagcataacatcccacatgttttgttttatattgctaatttcttgattttcataataaaaagggaaagactgtgtaataatttttatgtggttccaatttttaagcctttaatgacaatattaaaaatatcctaaataagacatagattgaatagcttcaaaataatgtatagtatagatcagtgtttcccaaccattttcttcttaccctttttgggagtatctttagatttttttcttaatcctccctgctatgattttaataccatagatatactgtataactgtttacatactttagctcttcttgaagggacaagaccattatgatatctgaggatttttttctttcccccaagaattaatttttgctccctaggggcaatattcctgtctttgaaaatgcatcatagagaacaagtgctgagccagtcagctataatctaataaagacagtggttaacaaagtatcatctgtgcactagaagcatagcatcaccttaggcatttgttagacatgcaaatcctcagtccccacttaaccctccaaagttagaaactctgaaaatgggcctgcgcagtctggtttaattagccttccaggtgattgtgatgcatggcactagctctggataggttgttgaaagatgggcccatggcttgattacagcattgagttaattattttatgtctcagtttttccatcttgacaaagctcagataactcttagtttgaagcctcatacacacaacctcagtggaaacattacccagggagcctattgagaatctacctggctttcagagtgaaggaaaataataagacaacatcccaaaacacttcagtaggacatttttgcattttttaaaaaaagaacattcaacatagtacttctgattgcattgacaaaggcctggatttctccaaaaacaattaatggaaaaataagcaaatgagtaaacattaatattctgtctcaatgaacattccattatgcatatgaaaacaaacagaaaccgaggtatccagattttatggcaaaatgaattacgtaggaaatggggaagaactgggcattcatcaggaggacatgcttgtttcgctgtcctcagtttttcatttatagtatttgcttctgtggttttataaagggaagaaaaaatgttttttatttcttagttctacagagtttctctagtctttttctcctacctaccattctaatcatgtacttgcacagattggctcacccactttattgacttttttccagcttggatgtatgcaacctggtaataaacagaagtatttattttaatatgcagcatgattaaaaaaagagaccttaatctactgaattgaaaacataaaaataataggctactatggtcagaaacctcacaaactaccaaatgtagagcatgcagtacttaaaacttgagaaataccttatgatgccgtgatctataaacgtccacattacaactccaattcaagactccctgagtcagtgatttacaaaatgcaaataactggtaactgaaactcaggtttggtgaaagaaaaagctgcatattgacttaatatcataagctttagcatgtgtaattcaattagaaatcaaatactgtgtggaataagaaacattttcaagtttcttctctgttctgttttgttttagatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaaggtacagtgctgggagctgaaatgtgtgatgcaattgtctgttattttagtgctgtaatagtttctagctttcagggaattgtttttcactttaaaatttattttcctcttctagttaagaagtaaaagcaatcttgattcaaaaggcttagaaatgttatttaatgcttatatagaattatttttaaagtggcaagtattgaaaagaacattaatctttcttttaagcttataaccaaaacacatattctactctataatgatatttgccttgtttcttatagaagaatggctttttcttcaattagactagagtaagaaaatgaggcagagtagttggaacagccagtcttcaatgattcagacaaatcaaaatctaatgaatggccaaaaatagaatttgtgtttattaccatccttgtgccagatcatcacttcagatgtcagaattatcaaattagaaagtttaaatgtctgtcattttcacctggatggcataaatgagcatgctaagaaaaacaaaatgttttttaaaaagataatgagagaaagaaatgttttatataacatttcaactgaataatgattcagtcaagtaagactactttatgttatacttttcccacatacagtgtttctgtgggtcattgtagatgaaagcttatgtatctaggtactttcattttacaaatccttttaccttttaattcacattattgaaatgacaattaactcttttgttttctgaagggaaaataaaatatgtttttctaggtcagagattcattaagaacaaccataccaaaaatctctctaaacctgatgattcctatgacttcctactatatccatgctaaaattacattttttgtctgaagttggaagagatatatacatgaaaatgtatatttttatgccacagataagtaaaggattcaactagtcatcagatattttatctgcagggcatcaaacatcttggtatgtggaaacatccagatgtttaatgtcatcgagataaatgttttcaaatagctggatgatggcctaaatttgtcactttttatctagacatttatgtggtatgtagacacagtcagagtatagtttatttatttaactgaattcaggaaggaaaaaagaatgatatataaagtgcttatattatcttaaaaatcccattcttcttactattaaatactatgtacatcaccaaaaattgagtaaaatgttgaatcatgtttaactagcaattctgttgattatttgcctatccaaaaaggttagcttaactatttaaatttgtgttccataattgacaatcctaatattaataataattatattttcctaaacaaacctgaacagatttggctcagaaaacagcttttgcaatctcagatacgattttataagcttgtgcttgtgtgtgtgtgcgcgcaggcatgtgtatttgtgtatgtatgtatgaagaataaaagatttaagttagcatataaaatatgaagaaggagaaaatttgatctattcaagtttgactaggtcatttcagaatttatgcattttattccagaatttactgtgtatatttcttctagtacttcacatatgccacctcttataaatttagagaagtcaaggaaaaaaatgtttcttcgctatttttttttcctcttctggtttgaaataataaactgcctgtagaaattatccttaagtagaattactaactttaccaggagccttccatgtttactttaataagaagttattctccaagtgagaggggagctggcagagctgcagtgtgagatagcattcattcctggactcccatctaaatgttttcagtactgttcttttggatggaaaacattaaataaaggagtcacagaagcagtgtttgttagaatttgatcaagaagatcttactcaataggatttaaaatcttaatagtttcaaagtcagaaaactgtcatgtgcacacatatatgtaaaataaaatgaaaagcattttattggaagcaagatgtccatttgggtaagaagagaagatattcatgttaatcctcttctaccataaattcttccccatcctaacactatgtcatgtcatttctggatggtacctagtgattatcacatatgtgatacctgttttaatgcattcatcttttaaaatgtttacttctctttccacccctccacttttctccttttcaacctcactttgcccagacttcagtgaactgcatgccaaatgcagtgacatcctttcagtccttagtatattttctgcattttatgattgataatgttaagaattctgtttaaaatgctctcctccaagtcacttaaactttctgaggctcaatttctttatctactaaaaaaaagcgtagtaatacattatctttctacctctcaggactattgtcagaattaaaatgaaataatgtaaaagacttggaaacaaaactagagcatattcttgtttgtgacactctattaccttgctgcttcttttaactattcctttccaagcctatcactgactgcttttcttcctctagctttttactttccaaagttcagaatttgttcattttctctccttatcgtatttatttcttcagtgaaatgaatgtcttgttcattctttcatttatccattcatacgtgcattcattcctcaagacatataaatgaacttctctgtgccagacagtggctagacttacagtaggcactatttcctttttgtgtaaaaatgactcttaaatctagttttccactccccatttcgcagaagacctcctttcatcctaaatttttgctcaggcatgtgacaaacatttactgagtacctaatgaatgccaggtgccaaattatattctagagagtatgaaaatgagcgagtcattgcatgggctttaaaattccatagactagggtggaggcagatctgtaatcaattaattttattacaaagtgaggaatgtgtacattaagagagatttgcacaaagtaaaaaaaaaaaagttcaccttatcagatttacctaaaacagatcttttctcaaattcactattattgcaaatggtaccattagtactccccatagccaaagttcaaaattttaccccagttcaaatttctaattataatatttattaaatgtaccaatgttatcttatactatggtataaagcttccacttctcaacacttgagaacatcagcaaatggccttatatacattctgtgtatccacctatattttcttctgttccctgttgaattattcctgccagcatccagcacagggaacattccatagtggcaacacagaaaatctttggtaaatgcattacataaagacatactgaaaaattcaagtaatgaagtaaacttgacagagtacatataaagtacagtgataaattacactctcagaagtctctggttgcaataatattgtaaatgaaaatacttttaaaatctcaaatatatcaataataagaacttgaaaagctaagctaattggaaaattgaaaggagattacatttttaatgtcagttttttctgaaatattccacaatctttgtaagtttctaaatttgtttcacaatggagaatgtaaaataacttttttagtgttatacacctaatatatctgtaataaatattccctatcataaaatgataagtgcctcaacagcttatagaaaagataagtatatcatttataaaataaacttggataagagtttgggattatagttgctaattatttcgttgccactaaggataataagagtgataagtaatcatcattactttacataattctgtttcttccatcactttttggattgtaccagggagtgggaagtaggaacaaaagactacatattccatatccatgtgcatggaatatgttatgtgccgatcagcataatttaattgaatacttcattaaacactagctcaaattttaaaggcaatggtgtccaatttctgactcaattgatataacgtcagccttaaatatctttcttgtgaaaaactcaaaatggttctacttttaaaaagtctcctctattccctctaagaatgtacgactccatatcacgtcacattaacttgggattttgttgttctagatagactgtaaaggctatcaggagattaagcacaaactttctgtaactgcatttctgctttacaaatattgtccattcactggaaagttctaaacgtttatttaaaatatgtatatgtatattttattatacatatatgtataatataaatataatataaatatatgaatatatatttctatatatgatataaatatatatatttcctaatataggatgtttcctcttctgctaaacactattttcaatatttattgaattgaattgtgtttcttcttgtttgttggtacagtgtcaggtttaatcgatttattgtttgttttatagtgtatctctccttctctttcttgttggaaccaaactggcagttgttaagtgggcccaaatttctgttagttttgcattagtaagaattcttccaccctttcactaatctcactgcttcatttttacaaccaaggcaataaggttgcctgtgtcctcacattcctaggagatctggatgacataattttatgatttgttgaatatgctttcagacaactgaatgaatgtactttagctcattctgtgattctgtgcctcctccataccctgtaccacaaccactctttcattatatgaaattttgactctgtaaagatttatgttctgtgatcttccggaatctattttattttcaaattatcctataaaccccaaggagagcaaggagtgcacctttatactaaattgtagtcccaatagcaactgacatattagtgtgcccataatagatccacaaaaatatttgtgcatttgacttgacttgcttcatgttagggtattaattttcttatgagttactattttctcctatgatgggatctgcttggtttatttttcttcgaaaatgtaaaagttagaaaaataattctattattctattgctctgaatttttcctttgttgtggcataaattgttgtattcttcataatacaataaatattacactaattagagtctatctggtatattggctgagagtggggtctctggagccaggctgccccagctggaaacctggctgtcctccttctaacttcatcgtcttaatgagttacttagtctacctgttcttcatggtcctcatgctgtaagggggatgactatagtatgaatatcctagagttatttagaagaaatgaattaataatatatgtaaatcatttacatataggcgtagcatatagtaagcttaagttacagatgttattattaatctgtaacaaaaccatattttagtaattaaattgatttatattaacttttatgtagctattcatgttgtttgggaataaagtcatttgaatatcaatacttcatcaggaactttggaggctctgtcaacatgactttgtaaataagtgaagcagatgctcatacattcatgatttttttaatgagaaattgttcaatatatttggttagtttttttcctgaaaaaaagattgaacagtctgtaactgtattatatatttttaaactattatcaattctaatgtttttcatgccatcgaaaacaatttttcaactatttttagttgttagaaatctccattttgccaaattttcttgatccagatgcagcgcaccaacatggcacgtgtatacatacgtaacaaacctacacgttgtgcatatgtaccctaaaacttaaagtataataaaaaaaaaagaaatctccattttgaatttctgcaaatgaggtatgtaaaaagcacatatttttaaatgacttttgttcttcctcttagaaatggtgaaaattggaccacatttttttgtttagtgtaaggatcattcatttgtattttaagacaagaaaggcacttttgaattttcaactaagtttgagattttaaatgcttgaaaattatgggattacataactaagattaaaaacccatgttttgggaaggaagatgttaggatgaatggtgagggactcagcatcatgttgcaccacactgctcagtagagcggagacaaggtgactgagctcagggcacagccagggaagatacgacccttctgttaggaaaggaatttacgtacttcacccactgcttacattttctttctgctcactcactgggaactagagataacaaggaaacacaaaacctagatagttctgaatcttaaatgcaactctcagaaatcagctcccttgataacattgattgcagttagttccataagggagtgtttgcaggaaaaaaaaaaaggtttttaaatcactcatcagttcctcttattagaaggccctcagaaaagtttttgaaagcctcatggggtaaatcaaacattctgtcaatagcagctttgagtgtagctttgattcacttgcccccatactgagaaaaggtgcaggccatgggttaatttgccttgttctggcctaactcagaactagaaattgccagttaggcaagaaatggcctgctaagattcttacgatgcaaaaattcaagaatttttcaaatgtgtccatttttcttttctcaattgtttaagtgttgggaagagcctatgaaaaatgttttaatgttggcattatattatttaggtattcaaaaatggtagttagctatgttttaaaagacctggaatcagtatgtttgatttgatttactccttattaaaatgtaacttatttggtaatttataatgaaattgagaatgctagaacattttaataaaccacagtttttggttaacatcatgttctatttttcaaacaacaaaacatatcttatagaagctactggtggcaaaattttctttgaacaactaaccactctttatgaccttcagcttacgtaatttctcatatcaaaaataaaggggaagggggaaaaattgaatactaatttgagaaactatcataattcatcaaattttcactgttgcatgcattttaataaacaaatatttacaatgaagtttcaaagaacagattaaagaatactgcattatattgctaattaggatacctttttgactaatggcaaaacattagaggaagggacttattaaggattaatataagtaagaatgaatgacattcttacctaacattaagaactaaagtaatcagtccggtataatacactggatacaatacaataacttgcattaggattttccttatttatatttctgaatgtgctagaaggaccttagagatcatatattctaatcccctcacttcacaggtttttaaataacgtatggtggctagtgcagactctttttaaagatacgtttcagggataaagtagtgaaaagagaaatgcaaactttgcctccaagaatgcacattttaacaggggaggctcagaattacaataaattgtactttgagaagtttagattcccgaggaagcacagaacagagtctaagcattcagggaagcttcctagaggaagtgggttgtaaattgaagtctgagtgatgtgtaggagtttccaggtggaacgggggtggaagggagggaagccacagggagattatgcaatttgctcaacaccgcactgttagattaaatagtcattttacagtcattttaaaaagctgtaaaaaatatatgtctttagaaagttgtcatcagcctacttacttcatgcatgttctcatcttcgtaaatgatggtctgaatttttcatttgtatttctaaatagaactttttattttatgatttctactattcattctctcattattcaccatgcaatgaacatttcttgatgcacaactgtgttccaggcactactcaggcactaggaatacagacacaagtaaaagagtcattgcccttcagggacctataggctaatgagagaaatagacatgtaaatacatatatagcaacacagtgtgctaatttgagatcacatttggaatgggttttagagcttgagtaggagttttcctgttacagagaacatcatatacaaaagtatgggccgacaaaatgacctcatatgcccagacaacggggaggcattctgttttgctggaccagatggtgtgtggttacataagggtagggagcaggtagggataagatggcaggaaatatggctaaaatatatgtggagtcaaaggattatatgctaaagtagggattttgaattttatgctgtagacatgcaggtgacaaatgaggaggtttaaataaggaagagctctttgtcttgaatgaggtaattctagcaggtgttagagcttccttctctctgcttggattgtgcaccatttgtaataatcttcaaatagttgggggttagaaaataagcaaccacattttgagatggttcatgttagtaggcaaatgcattttctaacatttggtgacctgaattaggtggttattcagtcacagggtatgatcccacacagtaaatgccgttatgagaagctgacccagtaacattttcagtatcaggggcgactgagaacctatgctcagatgggcagctctcaagttataggtttgaccagggtggattatatatgccttatttcttcttccagattcactaatttggattctattttagtgttttggagagaggcgagaaaggtacaatgcgacaccctgactgttatacaaatgattgtttctttacatggaaggcaacatcaggagtgtggaactacagtgtcagtaattttgggaaagatggcctggaattaagaaagacaagttaaaggattaaaataattttttcagtagttaccgtgactaagttagaggaagtggaaatacaggagaaaatttggaatcaagatatatttcttaagtagaatagtcaggatttggttatctgcttgataaagagattggatgtggggtagctagctgggaggtaaacaggtgtttatagtgctgacagaactcacagatagaagagatctgagtgaaatggtggtgtgttgaatttggatttgctattgaacaactgaagcaggggactagaactaaggaaacagagaatgactgaaaacagacattgggaattagtacacatcatcttcctgtcttttcactactataccttaatgcctacagcaggagctgttcattgatttaattaattaatgaaaggtgttgtagcctatcatttaaataacagcttcttaagagtgtgattaaagagtatatgtggcattgattctggaaatccagaagcctgtcatattccataatatgaagagaaaaaaggtcagcttttgttactgttgatttcctgatggtaaatattttaaggaggttatgacatgaagggacagttttattccatggtactctctctaccacctgttcgctttttaataacacacatgattcctcatgtgctgccatgttgttttaaaatgcctgaataataacattgatagatcctgtgtaccgattgcgaaatgatgaaaatgaactatttttgccttctttgtacagtgctttgcctttaattatattttgggcaagaagaattttcaggaacctaactgaaacactgtacatgtttcaaaaattgttctgattatcagaagtatttttgcttggttgaaagatttatcatctttctattacgaaatatgttgtgcagggtgaggatgaagtggtggaatctagtgtaagtactggcatttctgcagaataactatccaaactaatggaatccttgcacaggttttctttggaattattttgaaagggtggaggtgatgaggatggaggtcaaactgataacagtgttgaaagtgattgggaatcaacaccacatcacttacatctgccttagatatccatttgaagcacaacatgatatttctgtaattattttacttccctctaataactgcataggaataggtttgtttccccagtgaatagctctgctcagagcctttccttatctttattttccaggtttcactactggttgatatcatatgcattcttacagggagacagtggataaatcagtagttttccatcaaattgaagattacatacaagaagtagagcagtggcatgtaacaagttttgttagggaaagaaggtagaaaatgggaaaaaataacgtaattgtttcagagaacagaaatcataaaacatagccaatggttttgaacacacagtgagtgtaatagatgtatttaatgtaatagatacggtgagtgtaatagataaactgagctttattgaccacagcctataatatttttattttaaaaactagttagcttatagtatagtaaaaggttattctgaaacctaacatgctggtgaaatgttaaactaaaactaagccgctgtgagatgtaaaatcaagatgtaagatttaattaaactataaaatgataatatagagtatagtaaggttcttaattatatgtattttgtattgcagagtgagattattattgttaattactttgtgtttctgttcttgactcaaagcacaatataaataggacaacatccctatctaaaatactctggttaaattagatatttggccgggcatggtggctcacgcctgtaatcccagcactttgggcggctgaggcaggtggatcacttgaggtcaggagtttgagaccagctggccaacatggtgaaaccctgtctctactgaaaaaacaaaaattagccaggtgtaatggcgcacacctgtaatcccagctactcgggggggctgaggcaggagaatcacttgaacccaggaggcagaggttgcagcgagccaagatcatgccactgcactctggcctgggcaacagagtgagactccatctcaaaaaaataagacattgatctgcatatatgctattgtataaattagaaaattacattaaatcttattcaatatctactcccaaaatatggaagctactcaattcaaatgtaatatactgccattgttggaggaggaaaccagtattaatgttaacatccatttggggatcctgcctaacagtatgtggattaatgctaaccagtgctaatctttttttcctctttaacaaccatacttgttatattttgtaattctaaagctctttaaagtgttttcaagacttacctgaccattttttccatacaagtatgtgaaagaatggcaagcatgttgcatagtaagtgtttgccaaatatccagtgattttccaagccctcctcaaagtgtatttacaattcatttggtttaacatgacccagtgtttctccctgtatttgcatactgatgccaaatgaactttacatcaccagtctcatcacattactctcatactttggaatctaaaactattcttccctgatggtgggattaaaaccaaatgcttcaatttaattttgacatcctactaatctgccctcctacatacttgtgggatgttacttcccattctttcattctgtatttattatatgtgttttgtattaattatacaagattcttttaggttctctaaagttcacaaaaatgaatacattgtccccatctgcaggagcttgcagtctaataaaggaggaaagatgcatgcaaataaagttacctttaggtagaaagtgactcaggagaaacagataaatttctggtgtaacatacagggtagagagatgacttgcagcagcaagaattaaaaggttttgtggaggcagtgacatttataatagttgaggattgggtaggaattaggagaacagagacagggattgaaagcccattccagttatagtaaacaggctggatgaatacatgggggagtttcttcgtctagattataaggtatatgcgaaataatagagtaagggtggaaaaacatatcattgctaattcatgaaatgtttttagtgtttaactatgtgaattttattccagaattgtggtactggaaatctaaagaggcacgtagattaaatatgtttgctacacacatatagggaccatgtagttaaatatgcttctcctttttgattcttgctcttctatttcactctgtatatcttacatattctgaagtatattgacagtaccactgcagggtactttatttatattttaacccaaagatccagcacagtccttaactcaataaatattcaccaaatggatgaatgagtgaagagatgaataaatggttgaatgaaaagaatgaagtgacttattctaaatgtctgtactgaaaattaacagtaagggcaaaatcatgtgaaagtgttgtatttgtgaggtgtcatgaaggccagccagccctccttctgttcagggaatggtcagacgctggatgctttctctttgcattgagaatggtttcctaagactggtcatcctgcttctactctcacttccatataatcctaccagaatgagcttctaaacagagattatttaatttcttttttgttgttgttctaaatctacaaatgctgtcctattttattgtaacaaacttcttactacagtttctaacacactccttggtttggcccctgcctatttctcagacttcctctcttgtctcacttgctttccttcacccacataaaaccttccttctactcctcacgtgctataactgcatctcatccttaacacccttgccactgttcccgcttcttggaataatctgcctctaagtcatcacgtgactggttcattcttatcctttatgttttagctctgatggcatctcatcaaagaggcgctctctgaccctccataattgctatgatctaaagcaccccttctgcttctcacatccctcatcttgtactagtctctttcatgtaaccctattcataaccattttcactatcatatagttcacttacttatttacttttcattttttatcttctgccagatgaaatttacaacacacaaggatgggtctcttatctgtggtttactacggtgcctgcagcaggatgtaatacatgagagaccaaaaacaattttttttttttttttttgctaattgaatgaatgaaggcaaggtaatgccttgctttttttcctattaaaaattatgaaacacctgggaagaatagcttgtgtacactgtcttatgtctttgccagatactttgtccataacttcagaattctgttttttgcctttactatttaactgcaagtgtcacctttttacggttcattgacctccacgtcatcaatctatttacctacattatatttcttttgtatttaatacttgttgaatttacctctttacttggcttttgtggcttagaaatattttgattctcacgtaactctgaggaattattctctagctttagttcaggttatgcttgctgacactttaaaaataagtggatgattctattgtcacctgtttttgcactctttctttggaaactttacccagccttgtgatttatttgatcccaagttgcagtgccttcatctgaggtctaggtgtgtatctccaaatgcttctgtggatttttcaggcattttccaactacatatgtagttaatttctagtgaggtttaaatcctaagggtgtgaccttggtaacttatctcaatctcacattcctcaactataaaattgagttatacctattttgtgaggatccaaagagatagtatatacagtgcctagcctagagccagctacatgctgatgaaagcgctcaataaatgttttccattattatagttttatccccattagatatagcctttgccaatgttgatattttttgagtgcatgataatacagctagttctctatataaagaaactatacttttgaattgcacatttacttatgtactaaaattgtttaaacaaaattctactgtgtgttttaagtttgcattgaagtgtgcctactgacgattgacaaggaaaaaaaaaagccgtaagatggatatcaaaaaataacattaatgagctgctaaagctaaaattacaggaacttatgaaattggttaaacataaaaaccattaaactgtttactgaagcttcacagatatactgcagctaatgagcatttctgctatttaaataagcccaaattgaacacacattacatggatacataattagtcatggcagtcagacacacatagacttacttttaaagctctatttagggaatcttttccatttgatttattttgttaattaaaatatttttcagtgttcacttatattttaataatattgttttcacaagtagtataatttactactggtttcctatttgtttttatttttccgttaaatgcagcaaatgggaattttatatgaaacatttttcttaacccctttcagtaattgtttatatcatttgatgacataattgagcatttaaaaaattttgtttgctgagaagtatacaaaaaatatttcaatacgctattttttcactatctcataattatcaagaaatattaagcacccaaatgtgcatagaattataatgattatggtccaaaccagattaaaggatgatctattccttcaagcagtttgcagtcttaaagagatggtatcattgaatataaataagcaaatcaaagtacagcatttgggaatccaacagagaatttgaaaacaattcccatatatttacttcaaggacactgacctcctggaggagatctcttccaggtaaaatgaaatccaatgttcaaggagttcagcgtcttaaatagatagaattatttcagagacataagcagatcaaggtgaagtgcttggactattttaattctgaattggtttgttggtcagtttaggaagtggaaatgaaacttccaatagaatacaaataacacaaaaggagttgctataggctattattgacatccatcgtttccattcaacttggggagcctaagtttatcctgaatagggtgagggagaagatcagatctgtattttaccctgactgaattctactagcatattcaaactgaaaattatctaaccatagcagtaggaaaatcagatatttaaattgatcaaaagaaattcactatgtgcccattcttccctagtcagtatgtttgtcagtgtagaaatactttttctccacatgatgaactgactaattgtgaaaataagatctacaagaaaaataactaagacagaataatatgaatgctaaataaatggaatggacaaatactacattttttgaccaaaaaacatatactagattccccttatatgccaattatatgctagatgctggggggaagtagctgacttaaataagttatctgaacttaggagtagtagaggtaaaacaaatacttgaaataaagtcacatagtgcctagcgtaacagaaagtcgttagtggttaattcactagaaagggggggaaaaaggtttcattggaaaggatgctctcaaggctgaatctgtgaagctagccaagactagaattctttgctgttcctgtcttcactttagttattcccatgatccccaatgctgaattttatgagactgtggagagtctatttattctggctttctcttgcccccacacccaaagtcagaagcagcaggactttggagatgaaataattggattcaaatactgcctctgccacctcttggctttattgaggatgataatatccaccttcaagggttcttttgtgatctaataagatattctatggaaatatccagcagtatgcctgccatgtactagagatccataagtgctgattgattattttttctaacattcttctttagttgacagtgatgttaatggaatgtaagaagtaactaggataaaattttcattggatggattggcacaacatgttaactgactggatgttgatatatttggaaacaagattcatggattatactaagatttgtaagctctatttttagttttgaagaagggaatgggaccagatgcgatggctcatgcctgtaattccagcactttgggaggccgaggctggtaaatcacttgaggtcaggagtttgagaccagcctggccaacctgctgaaaccccatccctactaaaaatacaaaaattagctgtgcgtggtgacaagcgcctgtaatcccagctacttgggaggctgaagcacgagaatcacttgatcacttgaacctagtaggtggaggttacagtgagcggaggtcatgccactgcactccagactgggcggcagagtgagactcctcaaaaaaaaaaaaaaaaaaaagaaaagaaaaagggaatagaaaattttcgcaacctactcatctgacaaagggctaatatccagaatctacaatgaactcaaacaaatttacaagaaaaaaacaaacagccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccacctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactggaaataccatttgacccagccatcccattactgggtatatacccaaaggactataaatcatgctgctataaagacacatgcacatgtatgtttattgcgacattattcacaatagcaaagacttggaaccaacccaaatgtccaacaatgatagactggattaagaaaatgtggcacatatacaccatggaatactatgcagccataaaaaatgatgagttcatgtcttttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaaaagaaaaaaatcataataaaataaaataaaaaaaaagggaatagaaaaaagcagcaatgactattaaaaatgcatcatgaggacaggtggaaagcagaaagtatgatgtcacagaagccaggctaaaagactttcatgaggaggaagtggttatctgttgaattttgctgagaaatcaaggagcacaacaagggggaggcaccttaggtgcctgtccaacaactttgcctttgcatgaccctgagagtaaggacctccttaaattttgttctttgtctgcctcactcacctcaccctatttcaggctctgaagcaagatgatcactgagaagaatcactggacttggcgacctggaaccaattaatcatatcagtgaaaagaggtttagtgaagctttggagtcaaatgcagatgtggaatggttttaaattgggaggtactactgtacatgtatgtacctacatatgggaaacctctaatttgtagagagtggctggtaatagagaagagagtggatatagtgtcaggggcaaaattcctaccaggtcagaggagaggattcttgggcccatgtggagagaatggcttctgatagtagggagagttccttagtggtattaaaaaggaagagagagagagcgaaggtatagatccagtaggtttgtagttttgctgatgggaagaaaagagagttcccatgtgatggcttttatattctctgtgaattgtgggacaaggccttctcctgacagtgggggcaagagaaaggagtcaagtctatagaagttttgaggagtgaagcaaaggtaagacgtgttcacaatgagtggaggaaatgaaagagtaaggtcaccaataataaatcatgaggtgggaaggcccaggggaagcttgtgaactgagttttggatgtgatgatttggaagggacattagagcatacaggttataatcttaaacaggcatccagaagttccagaataaaaggaagaactcaagggagagttcgaggccatctttatagagatgaaattgaaggccctaaatgactatgatttctgacagagaaagtgcagtggactgaatatttgagagctgagaagaggaaaatgaagaggtgaagaggggctagagcccaagaaggacagtttaaagataagcagagccagggtagaggagcattctgcaaatcaaaaaagatcaaaattaatgccattcaactgttggatgctacagaaaggcaaaagagctgaagactaaggtcacagaatttggtgaccgtggagaccatactttcattcaaggaataatttggtggtgagacaagtaagcagtccaagtatatgaccgagaaattgggtaaaggaagatataagaatggcagtgagaaaagataaccatgtcaaaaacaaagtttttttcaaattggagaggagaggagaaaatgacacatacaatatactgaaaagagtaagagacagtgtttgaggacctggaggagcaggaaggtacagaatcaaggttatcttctgagagactggcagaaggaaaacaatgaatcttcattgtggagagcatactgattaaagtactgagaagtggaagggagatgtgaagacaaagctcaagccatccagacttgatattcttagttggaggcattctctggttctggcccttccttaccccaggttattctatttaaacagaactctgatatcctggccttgtaattagaatttattttgatcttgctgagattttgctttcagcgctgaattactgagattactgcctcagcacaccttttagtttcattgtgatttggtcctagtgggtgataggttatgtaaaattaaacaacaaggacatagatgaattcatctatgttttcaaggtatcattttattgtaaatgttgaaagtttttattccccccattgttttataacacatcaaactctccaaagaatactaataatccttcttcattatgatatctgttgtattgttttattgtttatggagaattaatttatatttgtgtactaaaatataacattcttgacatctttttataaaaactgagaaatatacttgtcatatgcttgtgggtttctcttttacatatgtgacagcacagctacatcagtttaattgaccttggcaatctgcatctgctagtgatgtgtccctgagggacggtttctgcaattttaagctgtggcttattgaagaacttgtgtgtcacaataccattaagtctgtataaaaaatcatttcatgcacagcattaaattgactaaaagttccaatttcaaaaccgtttcttgttataaagctacctcagagtgtctttgttttttaaataagctcatttgaacatagtagtaattaaagcagaaaattaacataaatcttgaatgtttggtatgaattaaggacgttttcattctttataaagactgcataaaattccaggcaccatatcatttaacaaatttctcttccaattgcagaataatatagactgtgaataagcatgttttgggattctttttcaagttctttttctgttcaactatggagctcctgggacatatgccacagtctccatcaagatgcaatctcatggaaaatctgagaaaactgtgcatgaacataacagaaaatcccccccgttttataaacaagaaaggaataatacaatccttctattaatattcatttaacacttcagaggaaatggcaagcagttatttggtttgcagatgtaaatatacatttttcattcacttatgctttcactccttccaagctgggtaaagacagaacagaagatttgcttctgagttttatttttattgtattccaagttaaatctatcagcagagatgtaaaagagctctgaggagttcatagaagaacagttacaatgatgaggatgatagtcttcctcataaggagcaactaaataaatgaattcctttctgagaaattatgaataacatgcacgtggattttttcactgaatccttgatttgagttctaagcttaagaaaatgattaaataattaaaataatggctatattttaaaagaattgttgaaattaggaaaggtatttagctccagatttaacaaagtttcagtaaattcatatatagtatgaatcaaattcatactatatatgaatattacatgtgcttagagtctactacatgtacaaggaaatgatcctaaccatttgatattccagttgtgatagtcattcttggtgcttagggctactgaaagaaatatttctgacccactgtagcattgcttatatttataaatgttgtccatattctactttcttagtgatctttttgtagatatttgatgagccaaatattgggtattaaaatatatacagatggtctctattttgattgatgttagtaacctcataaccagctgtgtgatctctcagctttttctttttatttctggaatgaaattaggaacatgttaaacttgaaggtctccaaaatgagcaggaggaaatttggtagttaattttcaaaaggagactgagatgatttttaatatgaaagaaaatcctttttctattttagaatagagtatcaaagaattgtttgatttttaatgaggttagctggatattacaaatgataaaataattaaaacagttgatattcaggtttaagacttcacagaataaataaatcaaatattaaggaaagaaagcttatttttaaaagtatacatgagtattatgaatgtttaaggatacataataacacaatgcatatacaatagaaatgcccatgagcagaagagtgcttttgaattcacaaataaatgcccctagggtggcttatgatgttggtgctaaatattttaagaaacataaagttacttattaaactcagagtaacatttcctgactacttatggaccgagtttgtgacaggtggagtgttaaagtgaattgttctatgtacattttttgcatcctaaaatatggtaaagcacattcttcaagaacttcaatttaatttgtgaagcatttattcagcacctcctgtgtacaattcactgtgctcaagtgaagattcaaattttatgaggcctgaagtgtatacaatttgagagctcttctttaagaaaagaaaaattcatagatttgaaattaggcgcagggctttgaaagagtcccatgcaagtgagggaccctacttaagcttcagtaacttcatgataaagttatcccttcacatctaggggggcttggttccaggatcccccatggataccaaaatccatctatgctcttaagtctgttatagaaaatagtgtattatttgcatataatctacacatatccttccatatactttaaatcatctttggattacttatggtatatctaatacaatgtatatgctgtatatatacttgatatactatattgtttagggaataatggaaagaaaaaagtatgtacacgttcagtacagacataaacattctatttttttcccaaatattttcaatgcacagttgattgaatcctcagatgtggaacccacagatatggagggccgactgtaaacatgtctttgactctaatttatgttgtgggactcagagataactaaggaattattcctaccttgctcaagcatagaatgaaatctctacttaaatttcaaggatattgctgtgaaacatgagataaatgtaaaaaaaaatgctttgatctcctagtgataaaattttgaatttcttatctttttattaattatctttatttcagatctgttgtaggccaaagttttggaaacataagatcatttctgatagaacagaattcatttttaccccttgccactatttataaagctcattacatatatcattcaatgatgatgtgttacagttgccattattaaaataggttgaattgatgagccatactcactattgactttcttgcaactcaagtaactgtcaacagatggtagtgatgatctgttatgcaacagggaacaaatgataaagatctcttttcatgtgacctttaaaaacattagaaaaatttccttaaaatgcctttctgctttgaaaataattacatgaatatttaattttcctctcaatgaaagacgaaaaaacaaatagaaacagtagaagattttaaaataaaaacctgagtatgatagcattgacccatctactcattcattcattcatccatcaatccaattgagtgtcctctgctccaaaaactgtagtgtgctctgtggaacacaggcaagcagtgtggacaaattgctgttctcatggaacctatgatcttgtgggaaaaacacaatcaacagtaaaccctcaataattttctacaactctaacattctttaagtagaaagctacaaatatataccagtgtttattttatttctatttttttcctctattttactcagaagaaactggttttaggtgtcaaaaataacattttttgtatttggctattttgtgttatacttgattcataaataaattcaacaactaacttttctgttccaaaatctcccaagctctcttcctttagtttaagttgttactaatattttctctttggagttggagtaaagaataaggcccttagtctgtctgagatgctgtgcttaaaaattatgacgttacctggagagaacattttatcctaaacactggcttactcagtttactccatcaaatagggtgttgtccacctttcttcatttcttctcttactcaaccctttctctaaattgcatccattgatctcttccacatgtcaggattatgctttcaaaatgttcgttagatatttttcttaaagaaacacagcttcattcctcttccatgactcttttagattcattagaatgcagcatatttagtaaataattgcaaaactactttacagagcaatttccacaaggaattaatggtaatgtttgcatttgttgcttttaacaaaacaaagcagaaattgctggctaaatgtaactgtatactagatccattaaattgcttaatagtaagtgcaaataatttaatgaaaatgttatatatgttgtctcattttgctttataaaatgttttgttgtaaaagggagattagccattgacctgaattcatgatgtaactttcaaaagtgacacacatgaacaagttggggataatataagtagtaacagatttgtaaaaatgatggctatgaataaagttttagaaaaatgtattttgtatgtatttaaaaggttgtactttccttctttatagatccatacttcgtagacataaatgtccgctctgaaacattgaccaaatctgtggtctttaattcctgtatgtgaggtgtaaagttaagtcagtgcccttcaaatgtgttgttaactccaatatttcgttagcttttcatttttatagtttactaaaaacagttgtttgaatccctggaacaataattaaaccataatttttcttaattttaaaattattgttatggaattgtctgttgactagtgattgtctattgtttttcacttgttttttcagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacaggtaggcatttgccatcatttccacttaattcttttccaatggataagtgcttcatttatttttgatactcatctataagagcatttctatttggtatataataagcatatatacaatatgtcacgtacatacttggatacaaattttaaaatgtagactaggtagtagaactgttgagttgattaaaaattgggccaggcgggcatgccacctaatgcctataatcccagcaattttggaggctgaagcgggaggatgcttgagcccggtgttcaagatcagcctgggcaacataggaatatcccatctctacaaaaaataaaaaattagatgggcatggtggcacacgcctgtggtacgagcttcttgggaggctgaggtgggaggatctcttgagctgaggaggtcaaggctgcagtaagccatgatcgtgccacttgcacttcaacctggacaacagagagagaccttgtctcaaaaaaaaaaaataagaaagaaaatttatcatgcattcctaccatttgagtactgtgaagtcattagtcctgatgtgttcaaaatatttattattggcttaaatacatagatcatacacttatcaaatctgatggtatacaatattataggacatatactagaatctacattaattataatcttacatactccaaaagatggtttgatctgttcatttggaccagataaggtcctgtctgttttccaaattctatgcacctaagtggaaaggaaacaaacatttgatgaatttcagttgtaatttttattttttaaattaaattaaatttaatttttttatattttttgagacaaagtctcgctctaatgcccaggctggagtgcagtggcacgatcttggctcactgcagcctccacctcctgggttcaagcaattcttatgcctcagcccctgagtagctgggactataggttcatgccaccacacccagctaatttttgtatttttagtagagatggggtttcactatgttggccaagctggtctcaaactcctggcctcaagtgatccgcccacctcagcctcccaaagtgctgggattacagacataagccaccgtgcccagccttcagttgtaatttttgaaaacaatttagtttttaacaatttaggatacagaatgtgaaatgatgagatgtgaagctgagcatactttgccacaacgactgtggtcttgaggaagaaaagtgtaactaccagatctcagtagcttactttccgactaaatgctttgttttctttttgttctgtgatttaattaaatgtagatacagttacctcatttatgtaaaatgttcctggaaaatttgctcttgttaataaaatttttattctttctttcctattcaaggaagagtgctcacactatgcctttttaccactcttgtttttaccactcttgttttggttctcttgtttgtttcccacatgctaacaaaattcactttatctttaatgcttcctttaatttcttcctcttttccatgaccattttgtctattctagttgtccttctcatgtttgtgtaactaatgcaggacctacttatttgctaggtagggcctggacttgacactgatagtatcatcttttaaaagtttgattcacctgcctacttccacctcctccttggcatctttgagtagtggggcttgagttgttgggccaaaccgtggtgtcccagaaatgtaggaatctcaaaatgaatgaggtaattgggagactgaggtgggaggattacttaagcccagaagttggaggctatagtgagctatgatcacaccactgcactctagcctgggtgacagagtgagacctcatctttaaacaacaacaacaacaacaaaacaacgagagagaaagagagagaaaggagcctgtggattttgcaaagagacaaagctttgattcaggaaatagcatctagggagatgccaaatctaaaattttaaaactttaaaaagttatacatcaaaagggactaggctaggcaaagaaagaaagaaagaaaaagaacacaatttaaacagagacagacactggaaaacccaaaggagacaagttggtgagtggttcaggctccagtctttgcagtgactgaaggatagatagcagcactatgctttaccaagtgtttattgcctcagacagaggaagcagcaaaggacagctatccactcagggagtggatggttccctactttgcctccttctgcatttcctgccccccaaactatcttcctgtttttattttctcattctactcttattttcagagtaatttcacagttttttttaataataacaaaggatttattatcatttgcagatgaaataaatgcaccatcccatacttgaaaggtttcagtaagccttaacatttttcaggttgtaccaaggcactgccactgcctagttatattatgcacccatttctagagtaaaaaaactacacctccctcaacatcagttctgtactgtttctggtttatgataaacttccaaaacagcaaaaaattgcaaatatgtgcaaacactatggtccattcagagtactgcttagtcatcatcttcctcttcctcctcttcttcctcaaagctatcttcaaagccctcactgtcctcctggtcttcatccccctctattgctgtatcccactgtgggtgattttctggcacaggcttggcctcatgaacttccaacttcaatggtttaatctgatccaaacccatataggagtctgatctcagaaacacagtatactgataatttccaggcttgcctggtgcaggaaacttcagctctacttcctctgtatcttttagtgtacacacatgatatggcatggatattaatgtctgctccttcctatctgcaatgtaaagccaccaccattcttgtttttcctcaggaaagtaaaggctatacacaggatgtgttatttttgatttggtttccaatagagcgctctcttcttgctgtatgctttgtagtaattcttgccactctgcttcatcatctttgttttgtttttcatcttgctctctatcagagtctctgtcactaccatcatctttctcacttcaggaatctctattggtttcttcttcttcagaatcactgcccttatctgaaacttcttcttcatcttcctttactgcagcttcattcccaacaactccatttgccagcttttgtttctgttgctttgactgtggtaatagcacaggtgcaggtttttttttttaaaggtttctttttttttgatttagcagttttcttgggtcctttactcttctgttgccatcctcgttttgtcctgttcttgttagtttcaccctgcccatcttctgctggctgttcctctgcagcacagaaggactgctccttttcaaatacttcagccattgtttgccttgtcaacttaaccagcactgtaactaaggatcctactgtgatgttgttgctgtcttcatcatctaacacctgtgattttatattcatggtcacatatggaaaactcccaaggacagccataacctcttcatatttttcatcttcaaggaagtgcagtagagtatgacaatctgattctttaaactcaccaaatcctggatagtttaaattttatacttcttatgattagaaacctgtctaagattgtcctcttcaatgtaagggagctgcagaaggggagacttaaattgctgaagtccctgaacggccatctgagaaagcttcatgcagttttctagggatgccaaagttggagcacgaaattccctttcttcacggttcggggccattactattagttggcagtttttagtttcacagtttttaatcttacctcctgctgtgtaactctctaatctgtacctccaacagggcactctcttgcataatccagcagtccactgaatatcttcccttgtgtctctaatctacttttcatattcaccaaacatcttcatgtaaatgtctttcctacatttcagattcactgcttttaagtcaaacatttcttcccaacttgctccaactccagtatttaacattttttatttccaggttcaaacctactaagttagtggtcctcataaattactcagaataattaaaatttcaacattgatttggaaatcaatacaatgctgatggcttcttcttttacagaataacaatattagaacaaaggaaactgacatttatttatataaattaataggacactttatgaaaaagttaggaaaggctagagtctcagaataagagatacgctcaagaaagtacagttaaaagatttacattggtgcacatatacaacatgcacataattttttttcattataagacaaaacggtacatagctgtatttaccaactacttatctaagttttattcttctctcttttctatataactggtcaattcttattctatctcttaaaaactcttttatacccttattttattttatcttttgtgtggagttataattttgattgaccagaaatcttactgagcagcctgctagctcctttaagaaatgaaagtggaatcaagggataagagatgaggttcttgtgttagaccagatgaagcccagtgaatgtgtgaattcatagtgaaaatggtatgtgggcagagaagctaaaaagatttgaaaaagtaaaattgaacacaggtcagtggaggattttgttttttgttcttatcctaaatatttaaatccatttatagattttaaattaaaatgaataaacaatgcttaaatatatttatgattgtagtttggtggtgtttcacaatatcattctaaaggaatcttaatgttttttttttttctgttcatttcactgttgtcttgtaacttcctgaatctaataaatgtgtactggaaaaaaaaagaaattattttacttccatgtaatggcagataggaagtttgaatagaaatctgatgtgtagagaaaggagagaaacagacctttagctataatgaagaaaacatgcatgtgctttaaaaacacatattgctaggaatgatagtgtttgaaatataaaataaaggttgtgccatgtaagaattttggatttggttgaaggattcagacttgtcaaactaagtgttgaattacatgttaaaatggagtagagatggaaggtaggtaaaaatctctgtcaagtaaaatcaacatttccaccttcctgccagggtgttggatgcaaagtgctaagcagcgataaggctaacaaggtacatatagacaaagtgggatttttctctctccacattgtcattaacttagttctggcctctatcacctctcttgaaattgcctccactttctctcctgtcaaatccaatgcccctacactgcagccagagtcatctttctagattatcagttgaatcctaattagctcatttaaaacccttcaatgacttttactcacactcaaggtaaaggccaaacttcttagctttgagatgctgatttgaatgtccccaagcataccaagatttctcctgaatctgggcctttcccccacttcacccatttccctctggttgagtcccacttgtccttcaggattggctttctcctcctcgtccagggagtttgtgacatgaacttcctttgtgctccttgtttgaagcctgcttactggtctgtctctgcacaagctaggaaccatgtttatgtattgctgtaccctcaaaataaagtattcatctattacataggaaaaatatgcagaaatcatttatcttaaatacatttaaggaggagttaagaaaactaatgagtttgttatatgataagttcattagcatataatattgttttctcacaaatgtagcatttgttaaaaaaatttctgtaatgtctatagtatgtttcacaactaaggcttatgacattttgtcttatattttacattagtttgttttgggggaaaaggtaacattgaatagcttattttaaaatatgattttataaacagattatagtattaatgcatgcaattgggtgtttagaaattctttgtaatatgcattttcagataaatgtgattgtttgaagacatccatgttgggagaaagtggaggcaatttctctgaggagagcttcacttaaatttcatcagttaatttgctcaattaccacttattaagtaatagcctttgggcccacacttgacttcgggagggtaccacaatgcataaataagagcagtataatatagtggttataaatttgggctctctgaactacagagaagacatcagatccagttccaacactttccaatcatgttaccttggacaggttacttcagcactccagggtatagaagtgaataagcaattataaattattattattacttaaaataataattagagctgctatcttcttgggtcttgcagaagattatgaaagaaagtatggaaagctcttggtaaagactaagctttgtgaatatttgttgtgtataccattgttgtgggttattagaaatcattcaccttgtattgttaaaacgagatcaggaaaaagatggcaaataggaaatttgaatagaaatctgatgtatagagtcttaacagatgaatattgaaataggatattttaggtagttgcaaaagcattttatttagtcattaatttattcatccacatacatccatcaatctcatttatgcattaattaattcattcattcaaaagatgcattttaaaaagtagtggatataatagatagcaccaattattagatttaaatttgcaagtaagaatcctattgtctagtaaagaagtgagttgtgtaaatgtaagcccaatatagcatacttaacacaataataaaaagcatcaagttacaaaggtaacctggaagagacaatgactgattccatctggatgtgggtattaggatgtggaatcagcaaggacatcacaaacaacaagaaacaaaatttaaaaagaataagaaaaattagaataatactgggtaattagatttactgggatttaaagaaggctactggataagattttatatgttgctcactccatgaggggtacccagaccagggtacaagctggctgaaatccagaccaagctccactaatcaaacaataaaaccttttgttgttctgcttctatacagaggagggagtaccttcctcaaattttcataaagatgttctctgtttggtccataagttttgcactgtgcagcaactcctttttatttcaccaaaaagcatagggtggacaaatggaagctctgaatatagagattatataggaaaaatgagagagagaaagttcagtaattataccaggagtagaacatgatgagattgcctagctaggatttcaatttggagtaggtaatgtggtaggaattgttcatgtatagaaatgatatggtagtgtcagatctggtattaatgtgaagaaaagcgttttccagtttgtcagaaattcccttcttaagtgtcattctgttataatattaaatttacttttttagttacttctactaataattcaatatgacttcaccttaattgtttataatgtgatattagtggagtccaggcatatttattttcttctaccaaatgaataagaattactgaatacgaaagataattttgacagtgtacctaaagaaagaatttgtaactgaaagaatgactatagctaaatgaattccttaattagtttaattccttaatttctcttttcctatgaaaccaaaattaatactttgttggttaatcagaaaaagttaaaatgggaaactgtaaaaaggatatacacatacattaacctcatcattttattatttattacataagcagcacatgaccaaagcttataattttatttaaagcatatagatattttctcattttcctttttcttttaaaaaaatccagggccaagatgtttttaaataaaatagccagatgtgtattatgtatcttgcctaaatctatctataacatattgtctaccattttcatttttaaaagtggtacaagaccttcgagaatcatacaatgcaattttccagatttttatgtttgtcctgcagtcatttcagtggtttgaccaacacctaatttgacagcagtattttttaagtaactcatttttatcatatccttcaagaacattcaacttagttttcatagaatcaaccttctttctttttgcatccatataactaattaatgtttatttatttacatttatatccaacagaaacagggcgagaaacatacagctgactcttgataagtagacaactcaactaataaaagcagaaatttcgtaggtatacaggggtaccactggttataaagcatcagcattacttggccatcttttgtgtctcttagggaggaaaacaagggaaggaaatagtccagtaaatctgtcagatgcaaccaacttggttaagagagcatgtagaggacctcagtttcttcattacaaaagcaccaaatagagactgaattaatatccaatgttactaatttataaaaacacatggtgatattgtgaaattttcatctttaccctgtttcctggcatacaactcctaaaatctttggaatctccaaagtgatgagtatgtgtgtgtgtgtgtatgctaatgagttgactgatggctgacagcccataggtaactacaggataggggctagtcaccagaaggactgaggcaggactaggattgggactttcagccctgctccccaacctccggggagagtcaaggggctgaaggttaagttgattgacagtggccaatgatctaatcaatcatgcctatgtaatgaactttccataaaaactcaaatggactaggttctgagaacttgccaatagacaaatatgggtgacgggggtgcttccaggaaagtaaactagaacgcttccgtgtgccaagaaggtggcacaccccagctccacagggacagaagcttctgctctgggggccctttcagaccttgccctatgtgtctcttcatctgactgttgtgtttgtatcctttaaaatactctttgtaataaactagtaaaagtttggtttttgttttgttttgttttgttttgttttgttttgttccctgccccgccgccacccccaccccccaccccccaccccgggttctgtaagctgctctaaccagttaatctaacccgaagaaggggttgtgggaatcccagtttatagctggttggtcagaagcacaggtaaaataacctggggcttgttattggcatttgaagtggtagggggcagttttggggaatgagctctcaacctgtaggaactggtgctatcatcaggtagatagtgtcagaattgagctgaattagaagacattcagcttgtgtccactacagaattgattgcttgcttgcttgctggtggggagcagttcgcacacacctggtgtcagaagcgtgttgtgagattttagtggagaaactgagtttgttttatccactcacacagcattcagaaggcggagcacttactttgttctagtattagcatatagacagatttggttgcaaaaagtggagagaaaaaggctatatggatatctcatcatgttttgtcctgccactgagaaaaaacttggagatagaacacaaactaaattattctaaattataatcccagatcagaagctcattgtcccttcagtagtcatggtagtcctgagaaggagctcttataaacatggaacattttgtcaaataatgttgatctttatagaaattataatcacaaaactaactggtttgttacatcattagagttatttttgccgtgtcattattcttttattaagaattgttttcaattctctatattttagatgcaacgtttaaaaagccacagtatttattaccagtagtggaagggaacaactaaatgtacatgttgctgctacaaaagcagttgtggtagaaatatatatatattgagagacaaaaaataagagttattaatagaaggataaatatggaatcaacaggtagaggtagaaattcaaataaaataatttgtatagagcaccattttaaatataggcaagaaatgaaaaggaaaagatctattttcttccaagtgggattcattccatgaaaatcaaacatttaggggaaaatgcaaagtgtaaggaaggaggcgtcagggcattaaatttaaaaaaaatttgagtacatatttctaagtgacttcaggagtcactgcctacttagttatgtacagaataattgccgttgaatagttatagaatattgtttattagcagccagcatttgaagtcaaccttcaacaacaataaaaacaacaacaaaaagttaattttttcattgttggcttaggttcaatatttctactactgtatatatatatgtttgcctaaatatatgttcctaaatactattcttctgttttcttcagcaaactttatccttattaaaatatgctgtattcctatagtaagtgtccacgttaaggtgtttgataatgttttgattatttcatttatgaatctatattatttcttccaatttgtcaacccccctctgaaactaacttgtgaggcagaattattttagaatagatacacaagacacacacacaaatattctggaatgatactgaatctaaaatacattccttaaccctgtaagctcatgaagcacaagtatcttcagtttctctgcagtgtttttcagcttaatggtagcttatgtgaaatactattgaaagttacaatgaagttctttaacagttactgtgattctactcaggtacatgtagtatatgggtatattttgaaataggtgtttattaggttcatgagaactatcatagatgtcttgcattggtgacctacttttctactgcttagattttttctgtgtgtattttcttctggcttgactgaggcacaaaaaaaatcactagtggttgagggaactaagtatctcaggggattggtaatgagatacagagcctttaacctcttggtcactagttcaaatctgccccaggtcaagagtgacagaaagtcattaccatctgatggcagttcaataggctatgtgaaatgaatgtgtgatttcaagacctagtggagacaaattcatgccatagacctgcagtagagtgagtacaaatggtagctgtggttttggtttgaagagaaatgagaagtccagtcattgctagatattccatcttctttctgtgagctgagcttccttttggtggattcgttaatggaatggcatgagaaaactaggtttatgccgtgatttggggccaagaggtgcacatccattgctaatgaggtacaattcagcatcactaaattgacttttttttttttttttgagacagagtttcactattgttgcccaggctggagtgcaatggcacgatcttggctcactgcaacctccgcctcccgggttcaagcgattctctggcctcagcctcccaagtagctgggattacaggcatatgccaccacgcccagttagttttgttggtcaggctggtcctgaacttttaaaaagtgattttagtctcagatgatgatgaattcaagattgaaagttacatcattcatgtcttccatttcttcaatgccctcaacgtatattttttaaaggtttcagtttcctttttaatcatgacattaatttcatctaatttggacatatgactgaacatttagggaagccttttcattcttgttaatctttcacttgaaaaatacttagttaacaaacaagaacagacaattataaagacaattaaaaatatggaattccaaattgagtatcatggaaaaagatcattgtgataaaatctaattgaattgtgtgcattcatatcaataaatgaaattttttacattcttttttgggttgagattatgtgaggaattttgtctttctgctatctttaataaactgtcattttattaacaatttctgatttggggacattttaaaggaattatctttctgaagaggaaaaaaggcttgtttatacctgaaaattttataagatgacagcattttaataatggcatatttactattttattttatgttgggggcagtaatttttgaaatgaatccacaatgctgggttgtaagaattttaaagctaccttcaataatgcttatgatgtgggaaaaaaagtgaagaatggtaataactctgcctcgtgttaaagatttctgctctggacaaagatgaacagttgttgaaaatatgacagtcagggattttagaaaacaaacttacaagaacttctctgtgttgaagtccctgttacttagaagaccttcagtcccaactttaaataaaagacacttgttatcattatcattgcttaaaatatcactttaatttcacatcttcaaaggcattcttttgccctgaaatataccagtgatttctacaatatctgaagaactatgattcgagaattagaaatttaaattgcacaggcttaatattagagtatttccgttaccctttgcaggttttgaggcagcttattcgaccttacagtctcaccaggaagctaatgggaaagccttgcagcaatcttcacaggaaagtttccaaatgtcaagtgtcatctttccagctgttagatgaatgggtagccaagaggcatttatttgggtgtgcagcccctgtgaaatctgggtgaggcaagagaaaaggctataatttggtgtttagtttaccagcatcagtatagttgcaaatctcctagccaggcaaaggatttcattttgtagtttaatgattgacagccagctgcagtgttcttgcacttaaagaataaaaatgcctgaagaaagggcatcatcgatatgtcatactaatttttgaatcctctactgcttcagataaaaacaatcttatcaacagagctgacttcttcttctctaaacctttccaactgagaagaggtaggcttttgaaatgacaactgtattaaaatcttgagacttactgaaaaagtgtccttcagtttaagatatgttgcaaactcttttattcctgtgttaagagaagattgatataaatcattggccactgtcaggttgaaaaacaatgaatatcaataaaaagacagttttaaatcataatgggtttagtttgagatagtgatagcctccaaaaaataatattgaagtatgtcatggctaaatgctgtttccatgctaagtttttccactgggtcaggatcatactgttgagatgacttcaggtcagtctcattgggaaactgggcctttagacttaactagtaccagaaatgtatgtgatctcacctttatctctcgcaatggcaagtagtaaagtcaaatttgcttacagtcatagaaaaatgaagtcttcttcagttgcttataaataaacatacattaaaccctatagtactctccacataattttcctctttgatagtacattcaggttaaattgtgatgtgttcttcagctaatatttttaaataattattatgcatcagatacttgacactttttctattaacaattatattcctaataatgtgaaggtttttgtttgtaaaggagaatttattttttgtaacatccatatgttctaaaaggaagtcaaggaaaaaatgagcaatgaggctgtacctaatggagctatcaaaacaaaactgtctagttggtgatagagaaagaaaataccatgactaataagtaattttaatgccttttattgactttgtataggttccaaacttttattaaatggcagtgtttgacctgaaaagtaatttaaaatgaaattgtctccataaagacagaatatttccttacccatatagcaatagattgctacttcaggcagagataattgaagattagaatggcagaaataaaaactaactgaaaaatctgatccaatacgtagggaatctaaccttagttcatgttgatggagtattaaggaaattaaccactgcagtatcaattggtccaaatagagtagaagtgttatgcatcccatgccaaattttcagcgctctaatgcatggggtctgctgggtctaatggcaatgtagcacaataaaacaaaacacccaaaatctttagtttgctgtggagaatttaaatacaaaataacctagttagaaattttgaccagaattgtgttcttctgaattcagtgatttagtaaagttgaatctcaaacaagctgtaaaggatcagatcaaaaaatatccaggatggtataatggcatcctgaaagtcaagcagtctgggttcaagttgtgaactaattgctcagtaattctgccttcagacttttgggaatatcatgttgcctttttggttttctcacttatgtctctgagacagaactttgtcatcatagaggtagaattcccagctcaaggacttaacaacttttaaaatctccaatacgttatcttgaacctcatcattttcattcatggaaggggcagaattataattttatatggttctaaaactcaaataatatatataaaaaattaaaaatctaatttattgaatacccattatggttgattgtttttagaggcttagcattcacattgtgtgcaaaattacctatggattaaccattttcccatttaaaaaaatggagaactatactggatttggttaagatgtagttggccatgagttaggaagctgaggaactggatttaaaagagtaaattcacatagtaagataatttactcagaagaatacaacaataatagaattatctgaaaatgttgtaaaaattgttaaatatcctcaaagagataaagaaaagaataacatccataaaaaataaaagaaaaaaatgtaatgcctttcttaaggtgttaaaactagttaatggcaatgctgggggtagaacccaagtttttctgttctcggttctactgttcttttcaataaccagcttactttttcctcatgatgttcttttctctttttttgagttccagctgagcatgtggaagtcagaacacataagtaagttcctaccagttatcagagaactctgctccagggtggggacaagtattggactttttgtgattcttataaccaatactcaaaattttaccttatttcattttagatcacttcccatatattgaacagtcactgtataccagacaacatcctgtgagaatgtagccttcaaatacatttttaatcagttttgttctctgttgtatccctagaacagtggttaccttattgttggtggttggccaatgaaatgcctgccatatgtaggcacttaataaatacaattgaaacaatgggtaggttttggaaatgttttagattatgaggacaccgagtttaggaaatggattttataagttcacatggctcagtggtgatagatactaccttagactactaaaagatctggtgtttgatggtggggtagagttaccatgggaacagaaggatacaaatgagcatgcttggggtttgtagtttttctcatttgatcttcacaaccatccttccctatagatattgttatttctattttgaagtgacctctgggcaactacgctggttttctcttcacactctatcctcaccttagtctatttcagagaattctccttctagaaatataagggttaataggttaacacaagagcaagtattggctgatatgttgttgacttacaattttgaacttcttattccaaggcttaatatttaacatcactgctgtcacctgtcttaaatgtcagcttatttgatttaccttcgtcactctcaccttgatcatactgactcctttatgttacatggatttgctgtcaggcaccaccctgagctggtcaccatgtttttattactttagtcattgacatcttgtcagcagtatcaccacctttgccccggggcctgtcagtatggcaattgttacctttttgattgacacttttgaaaatttgtcaacatgttatttattattttagggggatctctgtctaacttaaagtcatttcttgaagttaatttactgttttattctttgaacagactctttggtttgtatgcagtagaggctataatagtctacatgctattatattaacagataatattataactagtagaatgtgaaagaaaccaacatattactgtagttcagtgatatggtttagatctgtgtctccaccaaatctcatgttgaattgtaatccccagtgctggaggtgcggcatggtggggggtgattgaatcatgggggcaggattagagtatctctcaggacaaactaaaacaaaaacacaaaataccaaaagactaataaaaaaaaacttaatgcaagaacagtactaagagatgttttatagcagtaaatgtctgcattacaaaagaaagaagatctgaaataaataacctaactttaaacatcgatgaacaataacaacaaaacaacaacaacaacaaaaaaaaaaaacaactaagcccaaagttagcagaaggatggaaataataaagattagagcaggaataaatgataaaatgaataaaaatacaatagaacaaaatcaacaaaattaagaattgtttttcaaaagataaaattgacaatttgttatctgaaccaagaaaaaaaaagagtattcaaaaataaaatcggaaatgaaacaggagacattacaactaatgccagagaaataaaaagcaagaccataagggactattatgaacaaatttgacaacctagaagaagtggataaattcctaaaaacatacaacctataaagacagaattaagaagaaatagaaaacctgaaaagaccaataacaaataaggagattgagtcagtaataaaaaaccaacccaaacaggaaagcctacgaccaggtggcttcacaggttaattttactgtacatttaaagaagaattaatatcctttcttcctaaaggcttgtaaaaagtagaagagtaaatacttccatactcattttatgaggccagcatcacactgttaccaaatccagacaaagacaccacaaacaaagaaaatgacaggccaatatccctgatgaatatggatgcaaaaactttcaatgaaatattagcaaaccaaattcaacagtacattaaaaagatcatattctatgacctataaatctctataaagcaagacttattcctaggatgcaaagatggttcaacatacacaaatcaataaatgtgataacaccgcattaacagaatgatgggcaaaaaccatatgccaaaccaaagaaataaaaggcatccatatcagataacaagaagaaaaattaactatttgcagaggacatgatcttatacatacaaaaccctgaaaactgcacacacacacacaaaaactggagatctaataaacaaattcagtaaagttgcaggattcaaatcaacatacaaaaagcagttgtgtttctgtatgccaacaataaactatccaaaaaattaagaaaaaaatccatttacaataagaccagaaagaataaagtacttaggaatacactgaatcaaggacatgaaatacttttaaaataaaaactctaaaatactgccagaaagtaaagcagacaaaactaaatggaaagacatcttatattcttggattggaaaaactaatgttaaaatatccatttcacctaaagcaatgtacagattcaatgaaatccttatcaaaattccaaatacatttttacagaaatagaaaatgtaatcctaaaatatgtatgaatccacaaaatacccaaataacaaaaacaattttaaataagaataaagctagaaacattatacttcctgatttcaaaataattacaaagcaataatcagagtagtatgctactggcataaaaacaaacatgtagagcattggaacaatagagagcttatatcctacagccatgtcatgtacagtcaactatacaacatatacaatgactttcaatacgaaagtcaagaatgcatagcggggaaaggattgtctcttcaataaatgttacattgggaaaagtggctatgtacatgcaaaataattaaattggaatgttttctttcaccacagacaaaaattaactcacaattaattaaagactaaaatgtaagacctgcaactctaaaactccttagaaggaagcatatgggaaaagcttcatgacattggttttggcaataatttcatggatatgacaccaaaagtgcagtcaacaaaagcaaaaggagattaagtgagattacaacaaactaaaagaacttctgcatagctaaggaaacaatcaacagagtaataaagcagcctttagaatgggaagaaatatttaccattaattaaccagcagttaatttccaaaaaatataagaaacttttaaaattcaatagcaaaatatttaaatagtccaattttaaaaattagcaagggacttgaatagatattttttcaaacaagccatacaaatggccaacaggtacatgaaaaaatgcttatcactgatcatcaggaaaatgaaaatcaaaaccacattgagatattacctcacacttgatacaatgactattatcagaaaaacaaaagtttgacaagtttgtggagaaattgaaacccttatacaactgttggtgcaatgtaaaatggtgaaactgctatagaaaacagtatagatgtttctcaaaaaatttaaaatagaactatcatatgatccaacagtcccacttctgggtatatatctaaaataactgaaatcattatctcaaagagatatctgcacccacatgttcactgcaacattattcacaatagccaagatataacctaaatgtctactgatagataaatggataatggccaggcgcggtggctcacgcctgtaatcccagccctttgggaggccgaggcgggcggatcacgaggtcaggagatcgagaccatcctggctaacatggtgaaaacccgtctctactaaaaatacaaaaaattagcctggcgtggtggtgggcgcctgtagtcccagctgctcgggaggttgaggcaggagaatggcgtgaacctgggaggcagagtttgcagtgagctgagattgtgccgctgcactccagcctgggtgacagagcgagactccgtctcaaaaaaaaaaaaaaaaaaaaagaaaaaaaaagaaattctgatgtatacatccaagagaatattagtcagacttaaaaaagaaagaaattgtactgtttgtgaaagaatggatagaccgggaagacatgccaaatgaagtggccatcacagaaggacacatactgcatgattccctctatatgaggcatctaaggtagtcaaatgtatagaaatagacaatagaatgatggtttccaggagatgggtgagagggatgctgggtatattggaaagaaagaaggaaagaaaagaaaagtaaagaaggaaagaaagagaaagaaaagaaaagaaggaagggaggaaggagaaagaaggaaagaggaaagaaggaaagggaagacaggagggaagggagagagaagagagagaaaaagaaaaggaaaggaaagaaagaaaaagggaaaaaagaaaaagagaaagaaagaagaaagagaaagaaagaaaggaagggaaagaaggaaagaaaggaaagaaaagaaaggaagaaagaaaaaagaaaggaaagaaagaaaagaaaagagaaagagaaaagaaaaaaaggaagggataaagtaagcaacaataaagggacacaagtaaacttttgaacgtgatggatatgtttgtgacgtggattgtagtgatagtaacatgagtgtatgcatatatccaaagcactgacttttatacattaattatgtttattgtagactgattgtacctcaataaggctgtggaaaaaaaggtgtgtaataatactgctctcagcatattaatatttaaataacaaaacaatgtttagtgaagccgttttttaaccattaataaataaaatagactactttttttaaaaaagaaagaaaagatactctgttaactgttgtgttcctagcacctggacagaatgcctgccgtatagaatgcacttgatagatatagataaattttatatgctaaggaaatattttagatcatgggacaaatggggtttaggaagcatattttacaagttcacttggctcattggtgatactacctcaggttgctaaagagctggtacgtggcagtgggagaagagtttacaaggaaatagaagtatggaaaaagaatacatcagaaagagaaaatagcaagtgtaaatgtccagttaaaggcagagtttggtagaaggcacatgtgactatgatgtgtatatttatagagattggcataaggtaagtttggataggcagacaggaccatatcatgaaagagcttgtaggctatcatgaaaagttgaatattaacaaaatccaatgaaaaactaatgaaaagtttaagcaggtgcataacacaatcaaatttctgttttaaaaaccctactctggtacagagtaaagaacagatttgagtaggaggcaaggagaatgcagaagtcagtaagaaaaagtctcagtaagagataatagtggcaaagagaatggagtcaaaaataattagatttgctgtagaatagaaatgggatttgagagagaagaaatatcaaaaataatacaattaacaggttttaacaagcttgatggatggtagtgtcataaagtaaatgggggaaaactggggaggaatagttattttttgttgaaggaggaggagtttttgcatgttactacattaagttgctaaagagctgataattgggggtagaggtagagtttagatggagaaagatgggacatggatttgaattaatatcatttaattttcagagtccagatatgctgaccattatgccatggagccaattaatattatttaattttctagtcttattttatgctcagattacaagtatagaagaatgtgaacacagtcttttaaagaaatgcgtaaaatggaatcattattttgtagaaacttctgaagcctcaaatcagaaaagattttatatcagaaggaaattttattatgaataataatttctcaaaatggagaatgaaatctgtttttatattataattgtaatcactggagctaggcctttccatcatggaaacagctaatccaaattaatttttaccctgtaagatttttccctcaatagatatttcttcaaagagcgaaggaactgatcttgagttaattattaatgcattaatccagtctgtgaattaatctagccacaagcagctatgcaatgttatttattcttttccttaaaataatttcagaatggatgtttctatagcagctgtactccaagatagggcccgttgtagcatatcacaatgaaatataaacaaaatgactaagtgaaagctgtttgattattttgaattgcatggaacatagtgatggtgatttcttcttcaatcaaatataacaaacactaccactagtattgcttttagtagtgcttttctcttcctttttttttttttttttttccaaatttcattctagcaaagcaaatcaggagaaaatgccactgggatgtatacttaccatgtgagttactttttcccaacaacataatcattacacatccaaatgtctctgctataattccatgaccccacgaggtataacagaggaaaccagtggtaaagagtaataatttaataataaaataatgggttattatagtttgactgtatttttatttctattctttaatggcattatgattgtcttaatgatatttgaatagggtatggtttttatttttgataagatttttcaatgtgtgtgtatatgtactctgtgtgttcaatcaaaccatcatgaataactttttaggttagtttcttgttttgaggacattaataatttagaaaattcatgtttatgtaagatgggggcagcagctgggcatggtggctcacgcctgtaatcccagcactttgggaggccaaggcaggcagatcacgaggtcaggaaatcaagaccatcctggccaacatggtgaaaccctgtctctacaaaaaatacaaaaattagctgggcgtggtggcaggcgcctgtggtcccagctactcgagaggctgagacaggaaaatggcgtgaacccgggaggtagatcttgcagtgagccgagatcacgccactgcactccagcctgggcgacagagcaacacaccgtctcaaaaaaaaagaaaaaaaaaaaaggttgggggcagtttgatataatgtagtttgtgtaaactttcaattcaggtcttgctctaccacttattaatctttggacaagcagtttactttctttgggcctcactttcctcatcttcaataggagaataatgcataccttaaaaatcgtgattaaaaaatacttatcactggatctggtataaatattacttgcaaatggacaactgtcttgttgattttaagaataaaatagaaaaacattttaactgtcctatttttacagtagaccttaacatttggacaatgtgttgatgcttgtcagagctgacactttattagcagatgagaggtccacatgagcaccttttagactatcttccgaacttaaacggtctgttctcttgaacagacccccagtagccacgtagttgaataaaatagacacctaacacaatattggccaagcctgaatctcttacttgataattaggaactaggaaaagaactcatgttactggagaagtgacctcatccttgaatgctctgtgtaatttcttggagggatttttaaaatatttttaaaaatactattatttgagtccccctccaagggattctgatataattagtaggaaggtacctggcctggacatcataatttttaaaactctctacgtgtttctggtaagtagagtaaaaaattactggtctagacctacacaatattaatcattctggataaagaagtagagaaagccaattggaagagggagaagaataaagtagctgtacatagaaagaaagaggacaaagcacgaaaaatcttcttactttcctcgagaattcccagctcttcctggaggcctggctgcatttctgcatgagtttcatgagatcttcctgtaactcatgataagtatctgaggccaattcattacttcccaccaaaggagttcattctaaattggaagtcagaattccagtagggagaaaaatgctctattttaggcaagaccttggcaaaagtgtgatgttggtgaatctttgtgtcatttaatgtgactgaattatagaaacacacacacacacacacacacacacacacacacacactcttaattacccagggcaattacttactcttcccactagatagctcttggagagactggcctaaaacacacacacacacacacgcgcgcgcgcacacacacacacacgcacactcttaattacccagggcaattacttactcttcccactagatgctcttggagagactggcctaaaacacacacacactctctctctctctctctctctctctctctctaattacccagggcaattacttactcttcccactagatggctcttggagagactggcctaaaatcagcaatcttccagagcttcaatgccactctatgttagaatcatagaataatgggcttttatagatttggaataaagctaatgattatttcatctaaactgattatcaccttactggaaactaatttgaaaaagacactaagtacccaaggtcactagtctaatacattcagtaaatatgttgagtatctctctgccaagtcttatgctaggtgctgaaattaaatcaagcgggagatagcatatatgtaagcaaataagtacagagtacgattaggaagcagctttgcttgtgggaagctgaggaggtttttttttctttctttcttttctgttttcatcagctatactgcaatataatttgtatataataacatttgccaatttccattataccatttgatgagttttgactgatgtatggagtcatgcaaccatcaccacaatcactcaccataaatgttgagtaggaatcatcagcctactgtgattcctgtgctgcgaaagactgagacatgaagcaaagggatgagttaagaggttattgtggtaaattcagtgagagataaccatgcttagaccaggaggtagtagtggagatgagaaacgtaatatatttggaaaaagggacaatagatttttctgacagactggctgtaaggtgtaaaagaaaaggcacaaatgattgtaaggtttttggccaaaggtattggaaggatacagttgccattcattgaaatgggcaaggctgtagaagaagcaggtttgatggcagaaaatttgcgtcaggggttttcagtttaaaatgcctaataaatattcaagtgtaataagtttaaaatacaaatcagaaatatccaactgattgcaacaatctaatcagaggagaggtctgagttagggatagaaatttgggggtgtaaattatatcctgaataaactgtaatgtgtccatcaagaaggataacatcctaggggtgtttgatgatggatacagactgttttcaaaaaaagaaagaaagaagagatgattagcacacaatgtccagaggtgaggcttcctggatgctcagtaactgaaacatccagaaatattcttgggttatatatcggtaagttatcttggcctcagaactttgtgggaatatatcttagaccatgactagttctgatttttgaataggccttttctgagttcgttgttctacactttaccacaagccccttgtggaaaatgtgcccagccaagacttcagagtttatggcgataataatcacaaagtcatggaattagggcttggaaaatatcctaaagtttatctagctccaacttcacacccatggcatgactaatagataatctgagtcatatccaatggaaatgagctcacatctcccaggacagaccctacccctaatggacaactctatttcaaaattctttcttatgtgaaatacaaacataactcgctgtagttaattttcttttctgcatctaagggaccccaatgactatattcctgcagtttgtgagtttcaacttgaccataagtttcttgggtttctccccgttacagagcctgttacacagtttaggttttaaaacttcaacccttggccttcatgacacctttgcggtatcttctgtcaagaggcttactagactttttttttttagtttaaaataattattcatggttaaattgtgataaaacatacataatataaaatttaccatcttagacatctttaagtgtacagttccagtggcattaagcacatacatcatgtttctccagaacttttttaccttgcaaaactaaaacactatacgcattaaatgatagtttatcatttccccctctgtctcccttttttacacataaggaggatttttagtggagaggacaacaggactgacttttgaaggcttagttggaattttcaaagcattaacaccggcaggaaagaacattctaagcaaaaacaaaaaacgaaaggcaaaatgcaaagatgcattaatgatattgttttatttgagaaattataactagttcaataagtggaagcaaaaaatattttgaaggagggataggagatgagattagaaagggcggggagggagaagggcccagatcacaattgggattatataatgctgaggttctgctttattctgtatgtagtaaagaagcttgaaggaacttgcagatgacaatgaaatgaaaaaaattaagtgtaatgcatatatatttggggctcctgatggtctatacttgtcatggagttaatttttagaaattttattgtaagtgaataaaacctttactcagtctccccccaaaaattctaagggtgaagaaagcaaactttaaaaaaatagtctttaaacatccttgttattttcaatttttcttatgtctaggaaggacttctaaaaaggaaaggttgctctttatctttacactctaaaacttggacatttagcttttccttaatctccatttttaccattctcatctcagttctttaggacttcagcttcttttccttttgtagttttctttagttttcattgagtgtattttgaacaatcaaagaggtcatggtgatgtccaggttataaaatgattcttgctttacaatgggaagggagggagggaaatggcaaaaattcgagttctcatttttaaccttttcaactatgttagcggattcctcaatttcatagcatataggtaaatgagatatctgacaaaggataactagaatactaaaagcattttgtattaaaaataattattaaagataaaaatgtttagcctagagaaaaaaaggagatgtaggaagtatatgttagttctgcaaaatatacttgaggaatgccatgtgaaaaggtgattttatttatatctctacagaggaaagaattgccttcaagaataagtattttatatagatggatttttttttttttttgagacagagtctcacttgttgcccaggctggagagcagtggcgtgatcttggcacaatgcaagatccaccttccgggttcacgccattctcctgcctcagcctcccaagtagctgggactacaggtgcccgccactatgcccagctaattttttgtatttttagtagagacggggtttcaccatagccaggatggtctcgatctactgacctcatgatccacgcacctcagcctcccaaagtgctgggattacaggtgtgagccaccacgcccgacatacatgcatatttttaattgcaatggagataataatttggttaagatatgtttggtcactgtcctcaaggagcttgtttttgaagagaaaattaacatgtacagccgactatgatgacagctgagtagcagcatattttaaactgtggaatagccacataaatatcttcttttgagaagtgtctgttcatacccttcatctactttttgatggggttgtttgtttgttttcttgtaagtttgtttaagttctttgtagattctggatattagccctttgtcagatggatagactacagaaatcttctcctgttctgtaggttgcctgttcactctgatgatagtttcttttgatgtgcagaagctctttagtttagttagatcccatttgtcaattttggcttttgttgccattgctcttggtgttttagtcatgaagtctgcccatgcctatgtcctgaggtatttgactaggttttcttctagggtttttatggttttaggtcttacatttaagtctttaatccatcttgagttattttttgtataaggtgtaaggaaggggtccagtttcagttttcggcatatggctagccagttttaccaacaccatttattaaatagggaatcctttccccatttcttgtttttgtcaggtttgtcaaagatcagatatttgtagatgtgtgatattatttctgagggttctgttctgttccattggtctatgtctctgttttggtaccagtaccatgctgttttggttactgtagccttgtagtatagtttgaagttagatagagtgatgcctccagctttgttctttttgcttaggattgtgttggttatacaggctcttttttggttccatatgaaatttaaagtacttttttctaattctctgaagaaagtcactggtagcttgattgggatagcattgaatctgtaaattactttaggcagtatggccattttcatgatattgattcttcctatccgtggaaatgtttttccatttgtttgtgtcctctcttatttccttgagcagtggtttgtagttctccttgaagaagtccttcacattccttgtaagttgtatttcttggtattttattctctttgtagcaattgtgaataggagttcactcatgacttggctctctgtttgaagacatttgtgcagccaacaaacatgtgaaaaaaaggtcatcatcactggtcattagagaaatgcaaatcaaaaccacaatgagataccatctcacgccagttagcatggcgataacttaaaagtcaggaaacaacacatgctggagaggatatggagaaataagaacacttttacactgttggtgggagtgtaaattagttcaaccattgtggaagacagtgtggtgattcctcaaggatctagaaccagaaataccatttgacccagcaatcccattactaagtatatacccaaaggattataaatcattctactataaagagatatgcacacacatgtttattgaagcactattcacaattgcaaagacttgaaaccaacccaaatgcccatcagagatagactagataaagaaaatgtggctcatatataccatggaatactacgcagcctccaaaagggattagttcatgtgctttgcagggacatggatgaagctggaaaccaccattctcagcaaactaacacaggaacagagaaccaaacaccacatattatcacttatatgtggtagttgaacaatgagaacacatggacacagggaggggaacatcacacattggggcctgttggggagtggggggttaggggagggatagcattaggagaaatacctaatgtagatgactggttgataggtgtagcaaaccaccatagcatcctatgtaacaaacctgcacattgtgcacatgtatcccagaactcaaagaataatactaaagtaaaattgtggaatagtaaataaaaaagaggtaactacttcagaaaagtgtataggtggtagtaaggaaatgtcccaagaagtatatgcttgaatgaatcagttgagtttggaaggattatgaagagtttaacgcatgagtaaagtcttagatttatttgtattttaggcaggtaaaatacatgtaacagtgtgatgaactattggtagtttaaattttgtgtttatttggtggtaggtggtagatttatttgtatttttttgcatataaatgtcagagaccttgtctgttttgttcatctttttaaccccaagttcttaacaaatacctgctgaataagtaaatgaatgaaaatagttctatatgaacattaataactgagtctaacaggtatattggcactatgttataaaaaaatcagactatgccatgcaaagaaattttaagttggtttcctgaaaaatatggggaagttaatgcattttaatacttaaacatataaccaaatattttcaatgtaattaattaaaataattatattttttatgatctataagtgtctcagataaaataatttctctgtaatgacaagggaaggactttagaatgggtaattttcagcagatggagaagaaagatggaatgtgaaaagtgcagaggtagggaggcacaaagtattttggagaagcaatgattgaaacattttatttctgaggggtggcttaagaacataagccaacaagacagcaaactatatattttattgtggctttaccagtaactgagcaacttacagatattcatttagcctcctttggcttttgttttctctttgtaaaataaagcttttaaagtagatagtctctttgattgttctagctctacataataatacatagaactgaaaaagttgattcaggacactctatggaggaaactaaagggcaggctctttactttgagcttcacttaatgggttttagagtatcaggatgatatggtttgactgtgtccccactcaaatctcatcttgtattcccatgtgttgtgggagggacccgttgggaggaaattgaatcatggggccaggtctttcctgtgctgttctcctgatagtgaataagtctcacaagatctaatggttttaaaaagaggagttccactgcataagctctccctctttgcctgctgtcatccatgtaagatgtgacttgctcctccttgcctcccaccatgattgtgaggcttccccagccaggtggaactgtaagtccagttaaacctctttcctttgtaaattgcccagttttgagcatgtctttaacagcagtgtaaaaatgaactaacacacatggcttttaaaaattgttttagtttaccttcaaatctatctcaattaacttgtatttattattgaaaatatgaaaattataataagcaaaaatttaaaaattaaaggtcatctaaaaccctgattctgagatgtaattctcctagcatgttgatgtttatcttttgtgattgatggataaacagaaacgtacagcaaaatagatatatgtgtttttccaccaaaaacttggaatttacatataatattataatattaactcacagttttactttgtacataataaaccctctttcatgtcaataaattattttcttctgtatcatttctgatactagcatagcattcctttttacaatatagccattatggaacctatccccattgttcaacacctaggttgtttccttatatctgttatttactaacactactggatgaatggaaaaatagtattttctgaaattgaaaatctaaataacatatttgttaggagggaatatgatgagataaaagagttgaggttaaagtgtaagagcaaagcatctacatccaaaggccttgatgtctcttggaaatctgagtttggagattgcaattgaggtttgggaggaattaaccttgtgatgggagctgaaagtagatatgcttgagttctctgagcaagggtacagagggggaacaggcttttaaaattcagaaaaggaggtgtacattagggcttggatatatgatgaagctgaacagactgagttgctatagcacgacaaagacaaagctaaaaatagccctgtgttgcacagtatgaaaaaagactgcctatgacaagtgaagattttagattatattataaacacatatacatagtagcacttttgtgaataaaagaaaaaatatataagaagctgtatttctcatttgaaagaattgtgtctgtgtgtgtgtgtgtgtattttattattgtttgctttgttgtgtttggtttttgttttgttttgaagcttaaggaaaatcttgcaaaatgtgtccaaatcattttctttctaagtattaaggcagcaatgttcgtaagaatttcaaagcaattacttatttatttaaaactacataaattaagcaatgcaagttgaactacacatatatctgcctccttgggctgttgcctaatgccatatatagctacaattatgaacaaaccaaaattcatctgtaagattgaaaaaaatagatatttcaacacacagccataaaaagagaagaatacttgtaagttcacttatttcaccttgtaaagtacagacacatgggaccatatgtagttatgctattgccatcaaaggcaagttggctcaacattgtttctaagacagagaagttgcttctatacttttactgatattaatcaacctgtagtgtcaggaaattcttctttagtctaaccctaaaacttgcttgattgaatttacattatgattacacaaagctaagaaaataccatcaagcaaggtttcataaattaagtacaaagaggctggttagtgggaccaggagaaaaattctgaaattattcccttttgtgtttgaatttcagtatgttttaaataaagttgtttgtttgtttatttaattgataatactttccatacttcctttgaaatttaaaaaggatgatatcgtatatattcggtttactgctaactgactttttgccagtttttgtcattgttaacatccatgcgtggacagatatacatacacacacctcaaattaacctccaatttcctatattttacattgtagcttttgtatttgctaataatccttttaatagtatagcaatcctgtgtgaggacagaaaaattatgttcacacccagactaaccaatattcagaaatgtgccttgaagcccagaacatccctgggagaaggtgcctgccatagctgaagcctggatcccatcaggcatctctttgcatgtaccagagacacattagtgtttcaattgacaagtttgatgcctttttacatattaagtgaactttgctttgcattgtaagtggtggagggccagaaataatttctatgcaagtcatggaaatctttatctacacaagacacactcctataaaattaaagttctgctcaaataacttttcttttgagtgatgattcacaagagaatggatttctacttttgaattaactagccctgtccattcagtaactgctttggctgagaaaattcatcctttttatattttccaatgttatttgtcttttggagatagagagagagaaggggagggaggaatggagtgagagagacactttacaaacaaaaggcctgatgcaatctttaataacctccccagtcagaaaaagagacaacatttagcaagcacctatgtatgatgtttcagtgtgccatgtgctaagagtaagtgtttttattaaatcattccaataatcctgcaaagaagcattattaccatgatcatttaacaaaggtaaatttacagttttgagtgccagtcgaagattttgacgtaaactatttgggacctatttggtttcagaaaaaagaacaaacccccgtaatgcatgagaacactacccactttccaaattaaatgtctccctgcagcttatgatttcctgaattttccagtcttcctgtgaggtagaaattaggcaagcagcattcctgctgctatactgaaaactatagagaagaaaagacagggacttattagttccctttcctaaaatcgcctaaacagtagtgaaattactggaaattgaatttaggcctcctgacttgccgttgcccatatctctgagcactaaaggtattttcataacttaagtacaaagagactggattggaccagggagaaaaattctaaaattattcccttttgtatttgaatctcagtatgttttaaatacagttgtttgttgatttaattgattttatttctgctagtactcttcatactgcctttgaaattaaaaggccatattatatgaattcagttcactgctcactgactttttgccagtttttttcattgtaaacagactgttgtaatctatattaattcggatgctgtgttgaagtgatttttttggtaaaatattatatggacaatttagatgtaatatgaaaccaagtattggtttgtattttgcagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggtaagaaaatattattgaagtcatatagaaatgtctatcatatattttaattaaggtataaacattataatggattttttttactaagaaatactacttattaaactatttgacaagacctatcattacacattaatctttagtttctttccttcctttctgtcccatggaagaaggggcaggcatatattgctcatttagtattgtctaggaagcaacaaagatataaatattatgaaagtgactttttcatttaataatctcaaactcttatttttgtattattaattgtttcattatttttggatgcctcagctcaaagatagggacacaattgatttggtttgcacaaaattctggaattcaatttatgttgaaaagaatctcagtgtaacttattggtattggtgataagatagattctttataaatttggaatacagaaacctttctcaaaaacaaataccctgagtttcatttaacattatgactttgtacttaaccagaagtggacatcttatacttagtaggaaataaactacgtattaaagttgagattgagtctttaaagtacacaaagcatataaatgcatgttttcaaagtaagatgctttatacaagaggattgcatccttatatggttttgaattagaaaagaacaacagactttaacatttttagaccatttattgataaattacaaatgctaaacctctcaatgtatttaatactaactggtagttagtaataattaatgtatatgaatgtgtgaatttagtgactaagaaaagagtatcattatttgaatcagctttatccttaggcaaagaaaataatagagaacaaacatgccccattaagcacattctctctttttcctcttactaggatcaatagctggcattattatggctaaaacattaaggctgtcttactctgacagctttacaagatgcaatgtgtaagtgtggtcaggaaaatctagagaattctcaaaagtcagaaaaaaaaacagtgcaggaaaaaaatccttcgtaaagattttttatatttaaagagaagttattttttcaaatagatcaactgaatattttattaaacaaagtgtgaagcgtaacagaatatactagattcagctttagaataccatgaatcaattgtttataaccttgtagaatattgatagtatatttgtctttgtttcaattgattcgttaagaattactgagaagctgtaatcaaatgtttaatctattggagaaaactgagtctcagatagcatatactgactatattagttatgctattaaaaaacatatatgtaaaccgaaataggtggctaattgggcacaggtgaagaattatagctgaaaaaaagaggtgtttgctgctttgaatttgatgttttcttcgcttgcaataattgaattctgattaatcagagacatcagtctttacactgttggtgacatgcattgatttgtgatgctgtgtctttcagtaacctaggagcacttgcctttattaggatcaccagcagaaataaatgtggaagctaacttccttctaaacctccaatttgaatttaatctatcaatttagaagtgtgtgatgctggttcaaaaggggagttatgaacaaatggaaattaaatttggcacatgaaatgtaaccatgcggggttttttggaaaccctattttacttactttgatggtgggtacaacaaaatattgtgcagactattttaaacatatttctgcaaattgcaatgacaaaaataatgaagccaccttgggcttatgtaatgccattttcaaaaaagattattttccatacgtgattttgcagagtagtccgtttgcctcatagaggtctactttttttgtttccttatctggttcctaattagtgattaaatttgtgaatatataattacatcgtatgtgcttatttcttatttctatgctttcctattgatgaaatgttggtagtatacaactcagtagtatgaacatacttatttccccacagccttttactaaagacgtctattaaaatattacatgtactatacatttcggtgacattatagtataccaatttagattagccttattataatttattatggcaattgaagaatctatttaaaatgaattaaaattcagaatcttgacatttgaaatttggatgctcttaatatgacaaaggttattctatggggttttgttatcatatgaaatattaatatttcacaatacaattttgatgaagtacaatttgccaagcttgcatatgataaagaaattaaatgcttaccaagggagttcggtgaaaattagagccctgactgaacatctgctagaaattttattatcctgtcctactgacagtgtggctccctcgttgtttttctggattgacagctgaatattgcactgatttctgcagcaaatatgtttgcgtgaactttgtttccctttttttatttttttgggagtttggaacatgcttttgattttcatcctgtatatatatatatattttatactcttgacatttgtagatgccagattgaggtctaatatgctgtagcaccgatagaccattgacttacagtgaaatgccagttgatatctcagtaaacagaaatattattattctttactgtgcagtctatataaaagctgtatgtgctttctttagaaaggcaaatgatcatatttttaatgtcaaatatgaaaagatctgtttgcttttgtgttaaataacatcaaaaatggcttttattaactatattcttcctcttcaaatctgtctttccaagaatgtttcaaaataacaaggttgcttttcttgagattctatttatgttttataaagatagtaaagtcatatttaaaatatagttatgaaatcatttttctatacaaatgtatatcggctccaagtttaaattttgaaaggtgggagagaaatcgatctgtcaagcttgattaaagctaaattatcatgacaaaacagagaagtgatctgtttaagagggaatattagaaatggtttggacttcacataaaataaccccttgacctgtgttcacattatattgataggaagtagataaaaacattttgttttcattaattttgtccataaattttgttctcttggagagctacatattatatactgcaaatctgtaacatgaaactgcaagttgcatagctttattactgcacagataaataaactaagaagtatttatttctatcctaaatcaaatctaaacccaagcaacagttcacttcacttgtaagccctttctatacatagattaacttgtgattaactttaattatgaaaatatctcaaatgaatagattttgttttaataagtatcaaattaggtaaataagtatccatgtaataggtctctcttataaaatgctaagaagtaaagactgaaaatatttaagcctctttttttggcatcaaagtatttatgtagctgtttctgtaaaacacaaccttataccccatagcacaaagcttaatgtataggagaggcttgataaatgtttcataaatattcgctggataaatgaatacatagatttttttggcaagagcatatcgagtttatttttttcccagtatatgaacagacagttaacacataaaagaattgaatgttttgagtattgatctcaatcgaaggagaaaaggccaattaaaaaattttcatattctatgttgcttttctatagtgcatctatacgtgtctaaaaatgaaaatgtcagtgaaatttctgaatgtatagattgtggtttaagacttagattgttgtataagcctttaaaatgcagagaatttttgagaaaacagggcaagtatcacacaatattaagaagatacgtaaaaatcggctggcctaacttctaactgcatgtattggtagtcctgagagaagaaatgtaacctgttcttgaatgcttttagtgacaaggaatatactacatctttaaggcaatataacctgtatgactgtagaaagatctgttttagaaatatgttccttttattgaccccatatcacccttctcataaatttcatccatgttttatatatagttctgccctctgatacatcatggaataaataagagtaatattaatataaatgaattatttaaaataaaatgttgttgttgttgttttccacaagtaaataaatacgttagaaaaaaatctaacaaatatggagaagcagtgtagtgtggggaaaggtactttggcctgggaggccctggtcttaatccaaagctgcttctaaatcactgtcttggacatgtgtaatattataggtcattgttatagttgttatcattattcacattattagataccctatattcagtgcttaggatgtatagactaaatgtttttgtaaattatttcatttaatcctcacaatctgtttataagatagatagtattgttttcagatgaaataatagtctgagaaagttaaataaattgtccaggacttaagacaacagttatctatttgactatagtcatgtgggttggcaatttgggctcagcacgcatgatcagttctcctacttcacagggtgtcagctggcctcaatcatgcatttacagttggttgtttggatccctggggatcaagatgttccactaatgtgtctggagcctcatgtggggcatatagcaatcatgtgggattgctataattgcggagatggctgagcttttctctctatctcttcataatctctcttgcctcacaatgtcttatcaaggtggctggtttaggtttgataaggctacttcacaaggctagtagtgttctaggaggacaagagtggaagctgaaagatctcttgacacaaagactccaaagtctacacagtgttacttccgtattttattcaaagcatgttacaaagtcaatgtatgttcatgaagtaggtaaataccatccacttattgataaaaagaagtgcaaaaccacattacaaagggacatgcatagaagtagggaaggattattgcagccatctttgcaaacagtcctaacttgccctctgattagagcaattcacatccctcccaaatgtaaactgcatccactcctttccaagacacccaaaatatcatctaatcatggcattaggctcaaggttcattatcttatgatcttcatcaagtccaaatgcctatgagattatttggttttagtttctttttactgaggattctgtgatatagaaagacatgttttctatcttccatatacccaacacaaaacgatacagtcaagagaaccacagtagataaaatctcctttagaaactggagaaatggaaggcacatagcaatcacttgtccatagcaattttgaaattcagtttggcacatattttcagggcctcttgctccagggatggagaatcagggtccatttatgctccttggtaaggatgtcctaatacatttttcctatctactgttggctctgccttctgggctactgattatctctgggctactggttttctcctctgagtttttttttttttgttgttgtttgtttgtttgttttgtaaatggctaatgatggcccctgttgacagctgagtagttttgtcagcctgttcctgcccaaataaagttatagcaccctattcctctctttgttttgaattgtttcttttaatcctaactcatggtgatatcatcataaaactctgttaacataattttgaatctattaaggactaaattgatgcccaaagtcacatccataattctttttaaacagatttcttttatttttggatatgccttgctgttgtggtacaatgtctttaggaatgttagaagccctgagagaatctactaggacctgccttaggtctttctaaagtcttaacaaactgtcttactgcaatattcttgagatgatctttaaggtactttattttgagaaccttttttccatctaggagagaacaaatataaagaatagtttattttctgacccagtgtgtcctaggtcccttggattctgtctgttttgcatggcaaatttaaatatagccttatttagctcttttctctcttttagtaccttatcacacttgggtagaaacactcaactgaacacgttcagtgttctttctagagatgtattatgttcactttctgttttccaaattatcactgctgacattcttgccaattgttctgtcaccacataatacaggccacttttccaaccctccaataacaattttcataccatattttaaacctctacaacagtttgttcaccattcttccagcctttactaagatcttactcttggtttttcaaggctctgcctgcctcacaatgccaaagccagggccacatgttttatattttgttatgctagcaaacataacctatttcagcatcacgtacctattgctgcatatcagacaaccttaccaaaagcagcaacacgttttctgctcttgtttcgacagtttggcagtatggccaaggctcagctgggttgacttgcctttgcttcacatgatattagttcttctcactcatggatttgcaatcagttgacagactgtttggtggctggctgatggccggtcctggatgatttcattcacatgcctgggtcctcagctgacgtgattaggcctgtatctccgtatggtcttatcttcaaagagactacactggacttgttcacaagttgtcagtgctacaaaaaaggcaggaggagaagttgcaaatcctcttgatgccaaggctcggaagttgcacaatataattttcattgtgttccattctttagggcacatcacaagaccagatcaggttgtaacagcatggaaatggcccctcccatcaaaacactgaaatccaccacgtcaggatttgaaccaaggtctatttgatacaaatccctgcaatttccactatatcatgcttttacataatgtatcctctctggaccatattactttatgtctaaaatgaaggcagtttgactgcactcatgtcttcagagacttagagttcagcctgagcatttacactgaggactttctacccactgcttcgtatagagtggcacctatgcttgtctttctattgagaaataaaagttgcacagaaattttatatttctatgtgcaatttcagagagaatacaagagagcattttgatttaacagcttctgtgaatctgctgtcatcagaagccaattttttgccagccacactggccccctttctagttctccaacatggcaacttcctccctgtcttaggaccattttgcttggtgtttgatctgcctggaatgctcttctctcagatatttatatgactggctcttttttcttaatcagttctcagatcaaaagttacctcctcagagaagctcttgttaaccattcaaaacccaggctctccatcccacattacattggttgtttttttcttcactgcacttatcaccatatgaaattgccatgctcttggacatctatttctgttttagccacttgaagtaagctctgtaagtagagagatattgtctttcttgctcactacagcatgcccagtgccaagaacaatgtctggcagatagaaaggacgcaatacatacttgttagatgaatgaataattatagtattctaatttgaaccacaattccacatgacagctcttcagttacttggagacagctctcatgtcctatccataagccttttctttttcctttctaaatagttctgtttttcttttcataataaggtttgcagactttttaccatgtaggttgtctgttctcccatgtggattccaagaaacttgtttcaatccacattatcttaattgagaggaagttgctcctgcgtttgcacaaattgcacaaattgccagcacctatcaacgagatgagaactgaggaataacattgtcaggactgtaaatgctaaagataatatttaaagttgaaaatttcacaaacatgtcatgtaataatattttagagcctgggtaattctctatggattacaatacaaaacatcacaatttatttttgaaactcattttggaaaccttgttagaaataaagatctggattttttaaaaagattaaataaaactgatttacttatttattattaagagtttatctattacctcatcatgaaagtctatgaaacaataaattaacaatagtccagtgcattatttttgctgctatagttctagcttccaattttgtatatgattattttctatttattgcatagtattgttttcctgataatatacattaactaggagttataattgtttaaataaattcaatgtaagctttttatctgggagacttttaacatgctgaaaactgagatgacttctgtatactaatagtttatcacctagctaggttcttataacttagacgtattttattgaaattcataaaatcaactcatcctccaattataaagaattagtttattaaatggctacagttcacatatagtactcctatgggacatttcatccaagtgttcacttcaagactatttagcaagctcttctatgacgtaaccctcatttcttcatcaacaaaagaacctgtatgtgtgcttgcacactcgtgtgtacacattcaatattgaagctaaatcttgcaagttagaatctaatgaatacaccactgtctatccttaaagttttaaatcagtctctgttcgcaatcataccatgtttgccagacttagtctgttaagtaaaaaatatagattaagatgctttcaaacacaatttaatgcatgtatttcgaatattaagtaaaaatcttttaattatagccaaagtaatatttttaaccatgaagcagactaatcaattttccaatataattacatcttcaccactttcccatttcaggctgtgatttcacacctgttaattagttaatcattttggtagagtggacaaagtgaaactcaaatagactttttaataatataaattgacgtgtacaattttgatctgggttagctggtagatgaatctaacttgtaatggaaagtacctcttattcagtttccttttttaaaaaaagcaagtggtgtcaaggttaatggaaaattctcataattatggttaatggaaatttccttaaagtacagtcctgctgtttgagaaactgattttacccttattctgtctcacataattcttctgtgaattttaaatttaaccagttaaaaatctccatattttgggtatgtttagatgatacaatctttggttgaaattagttggattgaattccataatattctccttgcctttgtattttctttattgctttttaataagattctagtaactactatgtaatgatattctttatactcattttaaatactttataccatgattaccttactgtcagatttttattaaaggcatacctacattggctattttgttacaagactgactctgttttagtaaaattacagttcgctgtatgctcctttttcctaaaggactagcaatgtgcttaatgttcaagtaccactatttctgaaatgaggtgtcatgagaaataaagtgtcactaactcaaggaagttactggtgtgttagttaaatattcactcaaactgccctatcacacaccaattaccttttcttaccccactgcctcatctgcttctttcacttcagctaagcccattgcccttttcatcctgccctgctttcctcatttgcatgtttttctacaatatctcatgtgtctgaaacagtttctcacttctatcctgccaaatttaccctctatttatgtgaaaaattagcttaaaatgtcattaaagaaagtaccatttttaggtatctgggcaagatttgatgtattttgagagctcttataatgtccttttatatatactatttttcgagtgtgtgtttgtgtgtgtgtatatgtgtgtaatgtatggtattcactttagacaacttaaactgtagttcagaaaatatatacaccaaaagatgtaagatgacttaaggccacaggaattcttagactaaaatgttacttaatactaaaatgttacttaatatgcaatattttattttttaaattattttataattttaattttttaataattttttattttcaatattttatttttttattttcttcacatttgaactgtctttattctagggagaagggatagcacacggatagtcacggtcatgagagaaccgagcatatgtaagatgcagcataatgtctcatgaaatgttataagtagctgtagagatagtgagaaaggcctgtggggttaggaatttaaatgttgttgtataaacagggaacctgttgttaagaggtttaagcaaagaaattacataattcaatttggaagagactgttaatcataatacaactactgtttatcatttcaacaataactttcacttctctcctcatacaaactctcttttctgacaaaactggttttatcaccaggtttatgtttgcatcgtctataccttaattttaccattctttatcggtaaggagacatttattgttcttcaaatattaaaaggccaatgaccacccaagtcccctggagctacattaatcaatggttatcttctctccattgtctgagctcttatagaattttactcaatggacacaagagggaatggattccttttaaactccaccccaccccccggcccctttcctgaatggaagcctttggagatcagatctcgtgaccaccaggccctgcaaagggaacctgctgactgactacctccctcctcttatcaaccagttttattttgcaatgtaatacattgttcagcaatataatgaattttaaattgataaatattattacctcttgaagagtattttcactttcatggctaaatataattttgtacagctataatattcctctttaggagacatacttttgtttagactaacgtttatctaatgggtacctccaagcattcttcaaaaatacttcccatcacttgggaactcttccctatggtgcttttgaatctttggtcatagcttgctctctaggaaactcctaggaagctattgagtaacttagcttttctctgctgcaacacatttgcctttccaagggaccatattgaacagagcttaaggtgacttcacattacttatttaaatatgggtcccttaattggtccacaggaaaatcttacatttcctttcccctgacaaattctaggaatataggctagttgctgtacagttgcatctcttttagctcatcttttagcaacagacaactcacaccttttcgatatatcaagcagagtgggacactgtatacggtgcaccaacctccaaaaaagaaaataaaactgcggggaacacatataaagtgctctgaagggtcccttttaaaagctgtctctcaggatttgggatgacagtgggactcatataatcccagaagcatgctccaaagaaaccatgtcataatctccaacatccatccctaactttttgttaacattttgtttccatattggagtgaagggtgtaagagttccctaagcagatttttgttatctacttgaacatttctgtaagggaaaaatttatttttgtgatttatctcaatgccccttaaggtctcagccaaaatgtatattttaatattctgttgcattaataatatccatattgaattttacttatggacatttagtatatgaaaatgcattatttaaaaacccttacatttcatacaactatttgcatatagagatttttttttctggattttgtcagtaacatttaatttttttaatatggcagcaggttttagttcagatcttccaagaaaccgttgccaagatgtgattaaacatgcatggatttgattaggtgaaataattgtgggagacaatatggagggtgttgaggaggactgggagagccataagacagcaatagaagtcaagccatacattggggagagaagaaagaaaggttgagtaggagcatcatagagtgccttgcagactgagaaagcttcgacaaagccatctagagtcttcatgtctctcaggaaggggcctgcttagtatctctgccctgctcagtcattggctaagccacaggaagcatggctgcagtgaaaatccaggagtggattcattcacagcacagcagctggggtccttgctcagttatactcctgatagttggagttacgtgagattgccacaaagatatttggatcttttacaatactcagcataaggtaggcagccacttagtatatggcttttaaatggggggaataaacaaacattggtgtgatttttggacatctcctgttgatcaatataaagagaaatattgtatagacaacagagatccacaggtaaataaaatgtatacaaatattatcttattaagtattataatatgaaaagagaaaaacaagcttgcatgcagaaggctagagaggcacaatatactcttaagttttaaattatggttttcatagtgaatcatactagttattattgaaacgttacagttgtctccctttgttttgagaaaagtgttgagggttacctcttctgtaagtaatttgactgttaataaattagttaacttatctaaacttccacatgttgaattacaaaatagaccataatacctgctctgcctttttacagtattctagtgaggcttagattgaattttttttaaataaatatattaaaatgattcgtaacatgtaaaataccctgtcaataaaagttataattcttattaccataatctgtatgccagactaaaacattaatagttatgtgatcagttattaaagggtagaaagtcacttcccatctccactggtaccacccacatcacagcccccatcatttctcacagaatagtataccagcttcctaaaagagtcttgctgcttctactcttatcctaaattccggcctccacaccaccgtcagagtggactttgacatcttaaatcagatcgtggctgtttgcttaaaacatttcaatggcttctcttagcccttaaaataaaatccagaatctttgtacaaatcatgtcagcaaacagctcctgcctgtctctcggtcctcatctcattctactttacctggtaccaataaggccacaatggacttctctagattcctccaacctgtggcctttcaataactgttcttgctggtaattttcaggcccttacattcaaaaagaagaaaaagaaaattgctgctaatggcaaagtttagataatgcagaaataattatgttgtcatagtggttttatacttatggaagtttatcaggtgttagaaaatgtatgtggcagttaaccaattaaactatgaaggagtggtcacaaattctttcctcctgttctttttggttaacagaagatcttatgacttttaaatcattcaataaaatttatcctcttctgtaatatttctgaaagaaaagcgataaaggatcattctttgttacagttgttgggatctcattagttacaagtcatgaaatctcgagataatggaaaatattttatataggtcagaaattgcattacaaagagcagtgggtattatatgacatatacatgacctcagaggaatacatttgtaaacatgcttttctatgtaaaattaatgtgttaatttaaatgttaaaatcatgtaactcatgtaaagtgttaatgtaaacattaaaatgctgaggtgtgatttcttcgtagctgactcaaagaaaactaaaaaacgcttccctaccccagagcactttttatcagtgtttgtaggatttgtgtctacaactgctattaacatgagtaagatttctttttttgagacagggtctcatactgtcatccaggctggagtgtagattcactgtatccttgaactcctgagctcaagtgatcctcctgtctcagcctcccaagtagctaggactataggcgtgcactaccacacctggctaatgtgtttctgtttggttttgtttttaaagacagggtgttgttatgttgcccaggctggtctcaaacttctgggctcaagtgatcctcctgtgctggccttccaaagttctgggattataggtgtgcgtcactgcaccaggccacattaattggatttaattgagtagatctctgatacactgattgaaaatttactcaagttactataggcagagccaatcgggggtataattcatagtaaatttaaagtgttttacattaaaacatgaaatagaacatattaagaagttggctctataaccattttgaagcagatattaaagtagttttaatgttagacttctggtattaaataaaagacaagtttataaacagttcagtaattggacaggctccatattgattttttcctttgttatataatattacccacttctccgtccagaactatgtcgtacagggtttcagagtgctagaaacatggtcgctgttgtgtattggaatgttggaatgtgcaaagactgaaaggctgtcacagcagtcaataagatctgagaggtgttgactaattgcctgctaattacacagtaaattgtctaattaagctgatggttaattagggtacgcttgcacagcagtcttgtggaatttgtgtctgatgtctgggaagcagcttgtataattggcaaactggtaaggactggcagagaacatgactggaaaactccctgccagtggatgacagaatacggatttagtggaaacaaaagggttgtcatttttgtactgaaggttttgtttcagttctgcagctattctgcagtgagcaattgagaaatgcatctgaagcctaaattacgtgagtaaaagaaggcttaaaatgtgtgtcagaatgtaaaatatgctgcttgcgtggcatgtatcacctctgatacactatctcacattatattaatctacgccttgtatgattctacagttcctccttttaacatatatatttggcaaaaaataaaaaacgataatcccatgcatctaaaacaatgcctcttttatgaaaatataagataacaaaatgactgattagaagacatttgaaataagagctttgaattcattatttaattattaatttatatatcactgtgaatcataaaaatattagacatgatacaaatataagtttggatgatattttaactgagtaaaaattgtatttgtaatgagagcattttcattttactgtttatgcagttttgtcatgcaactggattttgcctgtagtttaatttgtaagaaaaaatatttcaatacataattaaatgtatttgatttctgtgtggatgtgagtggtgtttgatgaattacctgtaaaatttgagtgcctttaaaactaaaagttctagaagtttgctttgttgtttttattgttctttgtagctgaggaagtttaacttttcatttcaataagtcacctatggctgaaatactaacataaaaattcaccctgcaaataaattaaatgaatccattggagaatataggtcctttacagatgatgttaggtacatacacattgcctcttcataagagacctgaatgtaaatgattgcctctattaccatttgccacccagattcatcatattttgaggattttgcaataagactttgaatagaacattaggttgcagttgtaacaaagaaccacaagttcacagtgacccttggattgacttacactattgtgtaaataaaacttgaaaaacttttcagtatttccaaactagattactaaataaaaattgtatttgtaatgagataagaaggcctaaattaaattatagtatcaaaaattgttgtgactttcttattaaataaaataaatttccctttgttttgagaaaagtgttgagggtcacctcttttgtaagtaatttttgtaagtaagtctgtatgtgattagatagatatggatgtttttttgttcccgctgttctccaaggagaatttgaagttgtatatatactatatatgtttttagatagagagaaatacacatcatgcagtctctgaaatgtctttgccttagcattaatcttggagatatatgcatagtaaatgaaaatatttactgttttaacacaaaaggtgtttttcaatgttctaaaatactagttctcagacataaaaatggatgtaaaataaaaatatttatttcaagaatgtagaaaaattatattcattccatttgaagcataggttacaaagtcttggaagacttcataaacaaattattcaagatagcagaaaaatgaatttaccaaatttaccaaaggaatacaaggctaaacaaacagaaatttgttttatttaaagatatattctgttttaaataaacagaaattgtttatttaaagatatatctcctgagggagaaaaatcagatagaggtcagtgctgtaactccaacccatctatattttgatccactcaacttttcatcttagtcctcatgaaaataacttttaaagttatttattataagttataaaggtttacataaaagaaataccaagtagatctatcagtgaaattaaggtcttagagaagaactctttataaatcataacttttaagaaaaaatatttctttatgtttacaaataaatttcaatgttgttttctattaaattttaatctatttcaatacattgtatgttcattatcactaagaataaatttctaatgttctaatcacaaaaaatgttaaatatttgaggtgatggatatgtttgaggtgatatgttaaatggtttaatttaatctttccacattgtattcaaaagtcatgacaccactttgtataccataaatatatgcaactataatttgtcaatatataaaaaatgtaaaataatttttaaaatgtagctggcttccattaatatatagccatcacaagagtgaattctgtatatcatgattttatgcaattatctgttgagaacttcatgtaatactttactttggcttttaaataagtacacacacacacacacacacacacacagagaaagagagagagaggcaaagtactgtgtgtgtatatttagtgtaaagacagtttctcttttaaccacttggaaagctttatccctgtaatttaaaaaattcagaatacgaaaatataatatttagtgttcttaaccatcaacttcatctccagaattatttgtttttataatttacgtataaaatccattctttaaagtgtaacttttcatggtttttagtatattcacaaatgtgtatccatcatcactatctaatttcaaaacatttctatcaccctaagaaagaaactccatacccattagcagttactccccattccccacatcccgcagcctctggaatccagtaatgtattttctatctctatggatttacctattgagtacatttgatataaacaaaatcatataatatatgactttaatgtctggtttcttttatgtatttagtataatatttcagggtttacctgtgttgtagcatttatcaatgtaatgcttcatttctttctgtggatataccactcttgtttatccattcattagttcataacccttcatggggtatttttctacttttacctattataaatatttcttcattcatatgtaagttttgaggggagatacatatatattcaattccctttggaatatagttaggagtggagtttctgggtaatatggtaactctatttttaactttttgggaattgctaaactgttttccaaagcagctaccccaatttacattctcaccagcaatgtatgatatttccagtttcttcacatactcgccaacattgttgtttgttgttcatcttttttgttataaacttcatagtgggtatgaagttgtttcccattatgatattgactcctagtgttattgataagtagaaaaagtaaaaatatgaaggcctaataatttccttaatattcttattaacaatcattgtggcaactggttaatataattgacagttaaagtagcttccactttccatatttttttccccttattcagaaagtgtggtcatcaggggcaatttgacccagttctgttagaaacatggtgtaatagcaaatctaaaaatagagttttggagttacaggcaacttccaaagaatagctagttatataggttctttgccgttggaagaaagtgttacaggatcatctatattcaatgagtagtctcttactgtttatatatagttcaaagaaatgaataaatattcctagctaaattttgagcaaaacatacagaattagaagccaaaaggaaagcatttaatatactgtagatagcaaggagaaagatcattactctaggagtctgaatcaattgtcgttccctgctcacttctgccctgcttggtaattttatcattctagatataatagcacagactgtgagtgttaaaaaaagacttgcctgagatctagcttgagtctaagagctttcatttacagataatgaaaattattctttaatcaaaagatttgttcaaattcatttggatggcaatagagtgctcttaaaccacatacttggcccccttagcattgtatttttatagtattttatactctgtgtaatttgtttgttcatttttatagatcatgtattgtataacaataagatacaatcctggttctcagagaacctaaaatctagatgtgatgtgcgtgagaaaacatgctatgagagaattagaaacgaagagctataaaactacagaggaagcaccaaaccaagctagagcaaggaatgccattggaaaaaagatgataccaaacagttgccctgcatagtgcctgtccaaagaatagagaatacattatagatgaatatcatgagcaaagtcagagagaaaaagaaagccccgtaaaaatgggtgtttactttcactggaaggatgatgtagtgagaataagaattagaatggaaccacataataaaggcccttgtttgatcatcaaagagagtttgaactttatcttaaaggataatgaactatatgcaaagaaggataagacaggcttggatgtgcattttagagaggattatctgataatagtgtagaaaatagtcacaagagtgagagcagatgaacatgttcattgacaaattatttctaggcaatgtgcttggatgttgaggatagagtggagaggaatataaggccctaaattcatggagcttacagtgtaatacagtaaggaagaaaagatattggctcaaggttgtatctagagcaaagtgaacgtatttgacatgtataaaagagagtaaagtagcagtcctggtgactgattgcatgaggctagatatgggaagagagaagttaggaaaaactctggtatctctgacttgccagctgtttattgttgttttgcaaaggaagtgaacataagatgagaaaaacatggttactatgttctgtgcagttactgaagcaggacctttcaatatcaaaagaaaactgtcaataggtacttttattctccaactataatgatgtcaaatatttggaaagaaaaggtcaacctaataaaggacctgcagttattaaaattgatctgaaaatgttaataatttttcagatgtgatataggtactaatgcagagttctaaatttcaaattctatttaattattctaaaattagatctaaaactaacatagaaaggggaaaagttaaataacagaacaggatgttaaatcaatatgattaattaacttgatataaataacttgagtattgctatgtttatctgtaaatcatttatcatgataccagctgtaaaagaaaatcttaataataatgataatgatgtgtgtcatcctcccacccagcagaggtgtcatgacaaattgttaacaaactgtcttacagcacttcacagattcaaatgctaatgtaataataatataatcaataataataaaatcaacaatataacaaaccattttgatgtggcttgggaagagaaatttattaaaacattgagttcacatgaataaagttgaaaaacagaatgatttacccttttaagtctgtatttacattttgacttttaactttcaatgaagggaagagggagcacaaagaaaggacactgcctgaaactcttaaaatctgatttctgtattctttctggacattacagaaattaatctacatattttcatccaactgtatctccccaaagtatgttttgacatctctctctctcctgcttatctgcaggagaaaggccataaatcttagcatgcctacaatgccctctctcatcttaactttctcttagtcttaattcctcccaccaacctcttcccataaaggagacacaataacagaagccttaacatgtttaaaatatttgtccctttggaacctgataaaatttctcagacttcacatgatgtttttgttattcaatccacaaactatgattgtgcacatggatgcgcaggccgctcattactcaaggtaaaactgcctgagggtgccatgcacagtctctgaagatggcttgtgcttttctgccccagcacttgtgcatgcattgtgctcgtatctgaagagctctgcccagtattttgacttttgagaatacaattcatcctcaggagccggcttagatgtgacccaccctggaagctttcttttatcttaaaattatgtgtgtgtgtgcgtatgtgtgtgtgtgtgtgtgtgtgtgtgttttcttttttgagacaaactttcactctgtcatccaggctggagtgcagttgcatgattacagctcactgtagcctgatctcctgggctcaagagatccacccgcctcagcctcctgagcagctgggactacaggagtgtgacactatgcctggctaatttttgtatttttcatagatttggggtcttgccatgttgcccaggcttaaagttgtgttcttataaactgtaggagtcctagaaccgcctgtgttaagaggaaaaagacagaaattgcaatgaaattgcaaatctgccactaacacactatgaagccttttaaaatgagataggtgaaccagctatcagctcttttcagttctatcatgctaaatttaaattcttttttttaagctgagcatggtggcacatgcctgtagtcccagctaattagcaggctaagatggaaagatcacttgagcccaggagtttgaggatgcagtgagctatgctcgcacctctgcactccaacctgggcaacagcaagaccttatctttaaaacaaacaaacaaaaattaaaacattttaaatttttttagagttatctgtataccaggtccattttcctctgtgaaactagcattgggtagttattgtgtatatattatttgtcaagcatttcgaaagccatataatttacattttctcttttactactagcaactcactgtggtagatgtcataatctccactgcatggataaactgagctttaataatttcgaattcctctcttctgtctgtccctacagtcatatctcagttccttgaacacagcagatactcaacaaagactgagttgccctcttctatcttgttagagttttttgcttccagatggaaatgatgtgatttatcacattatagaaatcgatcaataatatttgtgtgctatcattttgctgcgggtagaatttaggtttctgtaggtttttaagaaagaaatgagaaacttgttaaaaggtttgctgtgggcctctttttaattccattattttagggcaccagctttctcccttttgagtcccatagctcatgggaccatgtttggctattcattgacaatcattgttttgttttctccacctccctagtcttccctccagtaagatgttttacatcccatgaatcataattcccagttcttggatgaaaattgctccacctgacattaaccaagtttactagcaagatcctgtattaggtagagcaaattcaaagccaggagccctatggagaaggcaatgaccctgatctcacacctttacttcttaaatctttaaagacaaaaataaatttcaaaggcaatgaaaaagttttttctgatttgaactcctctgggctctggatttccatggcttccttcatggcttgtgttttagtacagtggtatgaatatgaaaaccgttagtacgaggggattatcctctctccagtgctctctgcaatattttaaaggtgtcccaacattataggttgcactgaaataagacagcctacttggtattacattctgtattcatatttactataaaatgtcttgctagagcatattccttaacttcctgtagagaaggatgtaatgtacaacagagaagtgcattttttagaaacactgaaatgaaagttgttgattttaaaagacatcttgtcacagatgagtgagggagaaagagatcaaaccagcaagtctagccaatccaacgtttcattcatgcatctcttcggcttagtgctttccccttcggtatcattagcattttcatttcgaaaaatgacagtctgcagtggaagcagtaaaaatgttcaacctgtggtttaaattattgattttttagaatattgaagcagtatttcaaatggattttgttagagatacttctgggtggggggtttcaaaggtaatttgatacccaaaagcctgtatatttcaaagagtttccatttttttgaatttctttagactctggatgattggataaaaatgtttattatcttcaggattgtaagtagcagatcattgctgcttgaacttgaaacatatatttgcagactgtgctcttcatgatttattgtgcatgctcattctgtgatcaactggcaaaataaatcttcatttagaaacaaaagcattttaaaataatggaaaagatactatgatctgcatacgtggaacgtcaatagtccaattgatagctagtttactgtaataaagcatgcaagggtggttctataagaatggattttaatgaagttcctcaaattgtgttatgtgaatagggagtagagtgtgaccacagagattttccttaaagtcattttaagtctctcaccacagtcaatacttacatatgaacagaaaatattttgacaaggaccaggattactgactgctgtgtgtatgctgtgcaggtagtttgctattcgcagcatgtttctccttatggaaaaaaagctacttaaaaaattacattatatcaaaatgccttgatctgcaatcattccacaagtccaagccctattgaagtcaatgagggcttggagtacaaatttatgactatatcgagcttaatatgtggagatttgcactatattttgtaatgtcaaatatcacatagcaatgagatgacacaaatttgaaataaaacctgatatccccctttgacaagtggaaatgaattaaaaatacagtatcagaagagatctttttgaggcattgaaacataaaagggaaacctgccgcagaatacatgagatgtatccataataagccctgtaacatttaaaccaacttgtaaatgcctttccaaaggcagtgctaccccggaagttggttggagaattgctgaatttgctactattggggaaaaacatgtttaatatgatggtgcaaaaccgtaagatcaaatctttttgtatagcaacccccttttcatctaaaaactttatataatagacaatatgattaaaatagctttaacagcctttagagatagaagttttaaatattttcatattgtttatattgttatttgttgaaattttagttaataaaactgaggcccagagaattaagtgtactattcagcatcattcagctgttaaataaggaagccagcattcttccttggtttgtataattgcagagccagtgcttttctgctacacaactctgtttcattaaagatgtcactgaaaattggcctcaaaatcagcttaaaaaaggaaatgaagacacagaaaagcagtgagccctcatggttacgtagtatatacaaaaattagttatttttcagtttcaagggtgaagccactcctatctgcccccttcctcattccattaggtgcttccctcatttaaaactattcctgtgcacttatatcccaggcaccatgaaggaattaactcactgaacctctgcaacaaatctatgcaatatatattctattcatattattattatatcttatattattagtggtatataatatacaaatatataataatatactaattatattatatataatatactacgaataatgtatattttattatgtagtatctatattatgaaataatatatcattaggttaatatattatatattaacaaatttttacatatttatatattataaatatttttaagtcattagatcattttatgagagatggaaatacaattgcaaattttaatcttagaagtatatgcagaattttatatgcaatgtatatattcactatttagttacatcttttaaatactaagaaaaatagcaaatcagtagcttactgcagaagagcaaatgtagtaaaataagtatttagtgaaaggtgtagccatcttctaagcttgaaaatcagttttttggtttttttttttagcattacatttcagggcaatagtattacaaagtctgaatcttaatttattcagagaagaaattaagttgaggaattccacctgattgcagatattaaccagttgttggcagtagacttgtccactcatgttatgcttcttgaaactgtacacctaagttcaccttctggtgggggcccagatgtaccaatttgtgtttctattttttcttttctttctcttttattctagagattaaacatccaacattccctgagatgcatcctctttttgccttctctctgcagcctctaaatatgaataatacatattatattattaatataattattagtaattataacacaatatactattatagtatataattagtacgttatataatacttatacaattattagtgtgttatactaatatataattgtaatatatgtaatatatatgttaataatatatatgataatataatatactatgtaatatataatatattatcagtatattctatattatattagtagtagtataataataaaggatgaaggtatgagacagaatggttgttcttgataaaactgttagtaagcggtatagcagatgagatttctactataaggaattgtcaatatgcagtgagttgatgatgacaatgacagcttatggtgcatttattatgtggcaggcagtattttaagcatctttcatataccatttcgtgtaagttttcacaatagcactatggagtagaggtagtataattattaacactttacaggaaggaagctgagtcacaaaagggttagtgacttgcgcaaccaggaacacattgttgtttatttggtgtaatgatgaaagtactaaatacatttcttagcctctagtgagtcctcaaaaaatattataggtattaatgttaaaggctatttctagagcattaataaagtattaatacttgttgaatgaataactaatgaataatcccacctctgcaatttattagctatgggactttgtgccagttttatttaaaatgctaagtttgttttcttatttgtaaaattattataatgaaataggaatattgtaatttactgagttcatgcatgtgtcaagtactcttgtagcatgtaacagaagtaaaactttagcaagtactcagggcatagtaagtactcaacaaaggctatcattgttaatgtagtttttcatccttattttaataggacaggagtaaccaggacaataaccataggtcaaggctgtggtgtgtcctggtgtaagtgtaccatgtgtattgtctaccacaaatattgatgttgataaaatttgccaatcttatgaaaattttccagtattacttttattcctttgtatgtgtgtgtatttaggtctagacagttttatcacatgtagtaataataaggatggaaccctctgggagtattgtgtatagatgagcatggctggtcaacattttcctacctttattgtgctaaattcatccattctttagatttgagctttttgccttaacttcaaggtaggaacatgagctcaggtgttaaacctggtgcgcttgcttaatgtagcacataccaaaaattctgtggttccgtgaaaatatatttttcctcacaatgattactcctaaaaacaggattcctgatatcagtgagtgtaaatagtttaacaaagctatgggttgtctcttcaactacattttttgtactcaaatagtggtgatgatgcaggtcaggcaagcccccaaattggggctcagcccgggagggttcttggctttgcctaggaatgaattcaagggcaagccagaggtgttagcaacttttactgaagcggcagcatacacagcagcagaggtacagctcgttgtggagcagggctaccccatagagagtgtgcccagagcagcagctgagaggcagttctgcagtcatatttatacccacttttgattacatccaaattaagtggcagattatgccgaaatttccaagaaaagggtggtaactcctggattgttgggttgttgccatggaaaggggcggtaacctttggctgttactatggcaatggtaaactgacatggcacactggtggacatgtcttgtcttgtggaaagctgcttctgccctggccctgttttagctaggtctcaattgggtctggtgtctgaaccctgcctccagagttgagtcctgcctcctacctcagtgttacctagttataggcatgattcttctgacttagcacttgtaggttcacagtaatttgaggtaagcttatgaagtacagattaaacttacaagagcacaaatattggattaatataatttgccaatcttatgaagatttccctgttttacttttattcctttgtgtatgtgtgtgtatatataattatatgcagttttatcaagtgtaggttcatgtatttaccaccacagccaagataaagaacagttctatcatcacaagcaaccctcacataaccttttgtagtcacacttacttctgtcccctcactctctgcattcctaacgcctggaaaccataatctgtcctctatctctaaaattttctaatttcaaaaatattgtataaatagatttatacaagtgtaatcttttgaaattggcttttaaaaaaaataagcatcatacccttgagatgcatccaagattttgcctatgtcaatagctagttccttttttttttgctgacttgtattccatgctatgtatataaccacaatttgcttagccattcacctgttgaaggatatctgggttattttcagatttttgttactacaaataaagttgctatgaaaatttgtgtactccttttgtttggacataagttgtcatttctctatgataaatacaagggagtgcaattgatgggtcatatggtaactatatgtttaatttgattaaaaagtgccaaactgtttttcagaatggctgtaacattttatattcccacaagcaatgtataagtgatctagtttttccacattcttgccagtacttaatatggtcacttgtcactatttttaaaaattattttagcagttctcttatgcatgttatgatatctcattgttttttcttgtttgtttgttttgttttttgagacagagtcgcgctctgtcgcccaggctggagtgcagtggtgcaatctcagctcactgcaagctccgcctcccaggttcacgccattctcctgcctcagcctcccgagtagctgggactacaggtgcccgccaccacacccggctaattttttgtatttttagtagagatggggtttcaccgtgttagccaggatggtgtcgatctcctgacctcgtgatccgcccgccttggcctcccaaagtgctgggattacagatgtgagccaccgcgcctggcctcattgtcattttaatatgaatttctctaatgtgcaatgacattgaacgtcttttcacatgcttatttgccatttatatatcctccttagtaaaattcctctttctccatattttttttaatttaaataaatatcctggaggtcactcattaatagaatataaagatatttctttgtctttgtttccactggtgtataattctccattgtgtggatataccaaaatactataatcaattatgtatgaaattggtcatctttaatttcaaatgggtcaataaataaatatccatgtttaagaaaattaatcgttttagcattttatttcttaaaaagtatgtgaaatatgacctaagagtacagataaaatgattcaaagatgactaatctccaaaacatcttatttttaatatttgcatggctatttctgatttatctttttttactcattaattaatgcttgctattttaataatgctatttagtgactttgaaaaataaacaagttgataacttatggagagaaattctgtatttatgtttagaaatagcttatataaaaaagaaaactttactcaattctaggatttttcagtagcctagtgttttaaaaactgagttataaacccatataataaataagaacaaaactaaaggtattaatgaaaatatcccaatgcctttggagttttagaaattctgaattaatcataaatttgtataaaatttgatttggatagcactaacagtgatataccttcccattatttacagaatcattaaagttgaaggattctaaattaaagtgatctatctgagtaatggatatgaaatgagtaacagtctcttaaaacaccaacatcttatactgatttatgtgatataaattctatactctctacccataatctccatggcttaagttctgtattatttttccagtcattagaaccatgaaacttatgaacgatctgtcataaagttttggaggccccaactttcaacaacaacaaaaatgtgcatctgttatttcatacgtaatggagtatagtacaaatgaaaaattgagtgttctcttcagcccttaaaaactgcaaaatggaaggccaaaataatttattaatgtactcaaatagattctatccttacatattttacaagtaaatcacaactgaactgttatccatgaactttataaatttcaaaaacaagcatttaaaaagattatactttaattagtcactggatagacaataacaatgttatgatgtgcctctttaaaattatgaattgtcacataatctgggtatttggggttgtgcattagtagtaaaatcctttaactaatacattgtattaacttcctgttaaacatagtagttttatcatacttcatacttattctcccaatctctattccatgtcaatattgcaatatcattcatttaaatattgcaatatcaattttttaaaactacagtatatatgcaaactcacaatgacaaacatatcaggagattgaacatagtaaaggataccaacaaaatattagaagacagaaagtgagtgtactaattgtaagttacttagccaactgcagatatctgaaactatctgggggcagccttgtagttgcttcaagtcaatattagctgaagaattttgcagaggatcggcaattatattcctgaaaatgaaactgaaaaatgaccacatgtattttaaaatgaaccaaataaatctagaaatcaaaattaataaaaaaattcaatgaattgattaaatagctgaagagaaaaatagtgatctgaagaaaggagatagaaaatatgaataaaatattaaatgacatggaaaatacaatgagaagttctaaaaaagagtatgtcaggctgggcacagtggctcacacctgtaatcccagcactttgggaggctaaggtgggtggatcacctgagctcaggagttcgagaccagcctggccaacatggcaaaacctcatctctactaaacatagaaaaattaaccaggcatcgtggtgcactcctgtagtcccagctactctggaggctgaggcatgaaaattgcttgaacccgggaggtggaggttgcagtgagccaagattgattgttccactgcactccagcctgagagacagagcgagactctgtctaaataaataaaaacaaacgagagtatgtcagagttctagtaaataaacaaaatagggaagatccaatacaaagaagttagctgagactgtccagaaatgttgaaagacctaatgtatacattgaggaagctcaatgaatctcaaacagaataaatgaacagaaactcctcattacactcatcatagtgaaataacagaaaatcggagacaaagaaaagcccttaaaagtagtcagaaagaaaagagatggcttaaggaaattccttgacataaagacagagaccacaatagtctaacataagagatgaattcatagttacctgagtgaatacagtgagcggaaaaataatcagtgcagagaaacagtacaatatactaactccatgaataaaaatataatgctattacaattgacaaatcaaagaagaaatattggaagttaaaactgtgacagtacaaagtaaatatgtattttaagagttggaagggaaagttgtgaacatctttcagaaagaagaacaaaatgacagaactgaaaacaggaaagaaaagacaggaaaaatagagactgtgactaatagctccatacctttaaaacagttgtgctacatggagaagtcagagcgaataaagaggagggaatttccaacaatataaaatgagaagatgtccccagaaatgaagaacatggtggccacaaaggcacaatgaaataagaaagacccgcaccaatatttaccatcttcagatttctaaacatggatttaggaagatcctagaaaattctagagtgaaaataagcaagccatctataaagaaagcaaaaacccaaaaaagcaacactggaagttagaacacaatacttctgaaaacctaggggaatttttttgtttttgtttttgtttttgtttttgagatggagtcttgctctgtcacccagactggaatgcagtggtgctatctccgctcactgcaacctccacctcccggcttcaaacgattctcctacttagcctcctgagtagctgggattactggcacaagccgccacacccagctaatttttgtatttttagtagagacggggttttgccatgttggccaggctggtctcaaactcctgacctcaggtgatctgcccacctcgtcctcccaaagtgctgtgattacagacgtgagccatgggacccagttggaaattatttttagttttgaattctataccaaccaaaatatcagtcagatgtcatgtcttagttcattcactttgtgcttctacaacagaatatctgagactgggtaatgtataaagaagataattttttttttttcacagttctgttagctaggaattccaaaatcaaggaatcaccatccgctctggtgagggccttctttctgtgtccttatatggcagaagagagaagggcaggcaagctagctagcccaatgctgcttgaagcctctttcagccttttttataagagccttaatcccattcacgggtaaggagccctcctggcctaatcacctcttaaaagccacatctctttttttaaatttttttttaggtccagaatatatgtgcaggatgtccaggtttgttacataggtaaacgtgtgccatggtggtttgctgcacctaacaacccatcacttaggtattaagcccagcatgcgttaactatcttccctaatgttctccccaccagccccaacaggaccgagtcagtgtcgttcgcctccctgtgtccatgtgttctcattgttcagcttccacttataagtaatactatgacattggcaacacctgaattttggaaaggacccattcaaaccatagcaagggcagataaatacatttaccttccatgagccctttctcaggaagcaactggagagcgtgctcatctgaaacgagtaaataaatgaagaaagtgaacactggactgcaccaaaaagaaattctgataggactgcaaaggaaatttgaggctaagaggtatgcagtataccttcagggcagtctgggatcaggtaaccaagagctagaaggaatttctccggaaacagagcaaactgctcagttatctgatagctttgactttgtggaaagtcagattatgagccattttatgaagttaccatggtatgtgggaagacagcctgtgattcgggaaaagtcaagtaaatgaaagaacatttaagttggggtgagagtgaaatgagagagcggtacaagaaatgagattacagactgctatttggttctgttgtgaccaatatttatatagctacaaacataaaatataatgagtttagatttaactgaaaatgtgttaaatattttaggaagttggaggagaataaatttgcttgagaggttatataaaagagctgaaatcttagcttccatcataggaagttaggggcaaaggcagaggtggggtgaggtggggtgggagtgctttctctgtacaaaagtaactggcctattctcagtatccacaatcaacacagaaatgctaactgttctctttaatggctactcgtattacaaaaactaaatttgctgtctttgattcccaatataataataaaagtgcttccttattatcactaatgaaactggcctggatgtatcattttatccaaacaagttctttagccatgtgtacctgaatctgattcagcccttacttgaagaaaaaaggtagaatttaagtatacattttctgtgttagcactcacatggaaacggtatctttccttcaagttcttcattcttaataatctaatgatgtcagtcaatacttatagaattgtagcaatcttaaactctagtggaaaaagaaaaatacaggtgtttatgatgtgacattgattttagcagttcatccttagtggaaaatgtaattgaatatgtgttcagatggataacaccactttaaaggaggaataagacagtttaatgcaatgggaagaactggatacatccacatattaaataactgtatagttcactgattgacagtaagtctttatatctaggatttgttatatataccccttagactcctctttcaataccagcactacgcttgttcaattgttgtcaagttgacatataatatactttgttataacttttaatgtaatagacctttcttctccactcccataggagaagataatgcatctactttagtaaaagtaatctaaaaaaagatactttcaatgcaacgatggtttataatctactatcagtgcattatatccttctctagaaatgtttgtatgtgtgtgtctaaatatgtgtgtgtgtgaatgaacacacatatacagagagagagagagagtagagattataattttctgaagaactggtaatttaaaatatttatgttaggcaaaaatccatgccaatgcagctatcaattatgaaacattataaccaaaggaatcatgacttttaaggaatagcttgaattttgtcatttttagtattccaatttaaaagttgtattaatatatttggttttatttttctgtttattatctcataatagaatgtaaaacagataaaggaaaacgctttggtattattaactcactttttcaatagctgtgtaattctcagagtatggattatatacagtattatttgcttaaccattacttttttgatgaacacttgggttttacaatttttgtcactgtgaaatgttcatattttgtttcctatactataatttctctagaatagactcctataagtggaattactcatttaaaagtatatatattttcaatgttgatagaaactgaagataaatttccaaaagtatctcaacaacagttcacacactaaataatataagatagcatccctccctgcctctacctccgatctctagcactggatgttatcagtcttttaaaatttttgtcatattggccaaataatatgtgcaaaaaaaaatggcatctcatggttcgttcacatgtgcatttttctattagtaaggttgagcgtcctctcaaatcattacttacatttttctttcttcttctatgaaactgtgcacatcctttgactacatttctattgaattatttgcctttatcattttaaggagtacttttatacatagaagatagtaatctttaacaaatcagtttttcatattacattgtctttcagctttttataattttttttctttttgttttttgagatggagttttactcttgtcgccccagactggagtgcagtggcatgatctcggctcactgcaacctccgcctcctgggttcaagcaattctcctacctcagcttctcaagcagctgggattacaggtgcatgccaccatgctcggctaattttgtattattagtagagacggggtttcaccatgttggccaggctggtcttgaactcctgacctcaggtgatctgcatgcctcggcctcccaaagtgctgggattacaggcgtgagccaccgtgcccagcctttttataatattttaaaactaaaaacttcacttctagaaaagtaaaatgtacacaaggttaaacattaaataatgccaaaaatattttgatgaaattcagcaattccctgcctcgtcttttcacattcttcttccttgatcttgttaagctatacttgcaattactatgtttagatttgtaaattcatgcttccgaagagtatgactacactacacttttttccaatttaaacattttctattgacttcctgttatacataactatcattagttttttctatattttacctgatttgttatgagtgtatatgttttttacacataattccaaagattctgtcagtttccatcggtcatctggagacaagtctttcgtattccagaagtgtacttcatttctgagtactcaaattactttatgccactctccatgtggcatatttcttttttttctcagtttgatattttattttcctaaaaccagtcatccagagattgttcaaaagggatgtatagtaggtatatttttagtatccttatagatttaaaatttctagagtaaaaaaaaattatttttcttaaaaagtttcaacacattacaccttgctttctagcatttaatgctgctactgagaaatatatttttcaggcagaaagaaatagaagaaaagcaggaagatacaagttctatattagggaaaaaaagtttcccagaaattctcagattatttctcactagccagatgtaagtcaaatggtctctcccagctgcaagggaatttaaagcaagttttaaattggacacattgccccctaaataatatcaggatcccattagtaagaacaaatataggaatggatgttggataggcaatgaaaagtaactgttgaatttggtttcaccataatttatatgactaataccttattccaaacatacctcacaaacataccttgtttcattgtgctttgctttgttgcacttcacatgtattttttcttcttttacaaattgaaggtttgtggcaacctttcttcgagcaagtctgttgatgtcattctttttaatagcatgtgctcactttctgtctctgtgccacattttgataattcttgcaatgtttcaaacttttttagtactattatgtctgttagggtcatctgttacaccaatgatctttgatgttattgtaattgctttggagcaccacaaaccatgcccatataagacagcaaacttaaccaatacgtgttgtgtgtcttctggttgctctaccaaccggctgttcctctgtctgtctccctctccaagggcctccttattccctgagacataacaacatagaaattagaccaattaataatacaacagtgttctctaagtgttcaagtgagaggaagactaactcatctcactttaaatcaaaagctagaaatgattaagcttagtggaggtggcatttcgaaaaccgatatgggctgaaatctaggcctcttgcaccaaacagttagccaagttgttaatacaaaggaaatgttcttgaaggaaattaaaagtgccactcctctgaacacataaatgataagacatcaaaacagcctgattgctgctatagggaaagttttagttgtctggatagaccaaatcagcacaacactctcttaagtcaaaggctgatctggaacaaggccttgacgtgctccaattctgtaaaggctgagaggtaagggagctgcagaagagaagtttgaagccaacagaagttggcttatgaaatttaaggaaagaagagatctccataacataaaattacaaggcgaagcagcaagtgctgatgtagaagctgcagtgagctatcccgatccagctaagagaactgatgaaggtaactacattagataacagattttcgatgtagacaaaacagccttatattggaagaagatgccatctaggacttttacagctaaacaagaggagtgaatgaatgacttcaaaagacatgctaactctcgtgtaatgggcaaattgcagctgatgactctaagttgaagccaatgctcatgtaccatttggaaggtcctagggcccttaagaattatgctaaattggctgagcgtggtggctcatgcctgtaatctcattactttgggaggccaaggcaggtgcatcacgaggtcaagagatcgagaccatcctggccaacatggtgaaaacccgtctctactaaaaatacaaaaaatagctgggcatggtgatgcatggctatagtcccagctacttgggaggctgaggcaggagaattgcttgaacccaggaggtggaggttgcagtgagctaaggtcatgccactgcactccagcctggcaacagagtaagactccatctcaaagaaaaaaaagaaaaggaaagaaaagaattacgctaaatctactctacctgtactctttaactggaagaatgaagtttggatgacagcacatctatttacagcatggtttactgaacattttaagcctaaggttgagacctactgactccttcttgacaatcaacctggttattcaactctgaaggagatgtacaaggagattaatgtggtgatgtcttctaacacatatccattctgcacccaatggatcatggagtaattttgactttcaagtcttattatttaagaaatgcattaaggctataactgctatagtgatacctctaatgaatctgagcatagtcagttgaaaacatttagtggtgaatgggaagtatttaccattctaggtttcattaagaacagtcatgaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtcttaaaaaaaaaaaaaaaaaaaaaaaaaaagaagaacagtcatggaaggaggtcagaatcttcatattaacaggagtttcaaagaatttgattccaataatcattgatgactttgaaattaggccaattaataaccctacagtagcctctaagtattcaagggaaaggcagagttgcatatctctcactgagttcaagtgaagttcaaaactttggtggagggagtaactgaagatatgttagaaatagcaagataactagaattagaagtgaagcctaaagatgtgacttaattcctgcaatctcatgataaaacatggatggatgaggaattgcttcttatggatgagcaaagaaagtagtttattgagatagaatcagctcctagtgaagatgctgtgaacattgttgaaatgttgactccaatattgactgaagttctactgtgggtaaaatgctatccaaatagcattgcatgttacacagaaatcttttgtgaaataaagagccaagtgatacagcaaatttcattgttgtcttgtttacagaaattgccaggcaccctaaccttcagcaaccaccatcctgatcagtaagcagccagcaacatcaaagccagactttccaccagcagaaaggttttgactctcagaaggctcagatgatcattagcagtttttagcaataaagaatgtttaaattaaagaatgtacattttttagacctaatgctattacacacttaatacagcatagtgtatatattttatacactgggaaacaaaaaataattgtgtgattcactttattgcaatattcacttgattgtgatggtctggaactgaacctgcagcatctcctaggtgtgcctgtagttgacatataagctgttttttttttagtatttttgttgcgataatgctaaacatggtatctgtgtgcacatatctttatacgttctatgacttatttatgaaataaattcctagaactgggattgtagttcaaaaagtacattttgtggtacttcctattgcctaattactttcaagttttccagtgtaaattctactaacagttcacaaagattcttatttctttatgctgctaccagtgcatagttttatcattaaattctgacttgataagtataaaattggatcattttatctctgattactaacaaggtaaaaacatttttcattgctttgttttttcatataaatttatactttgtgaattgttcatattttttatcattttctactaaaggggtcatctttttctcattggttttgaacacattttataatcacacatatattttactcttcccagcagcagttatttttggattttgattgatagtccaacccagaaatgtagcatcaagtttatttgtctttaaaaaggatctgagatgaatctgttacagcaggtacagtattaataaagtgaaagtgatgtggctctggcaccactttcagtgtccccagatgattctgcaccatagacttccatggtcactaggaaagggactgattgatgtagtctgtcagtttagggaaaccatcggctctgggatctatttactctttgttaccttgctagcccatgactcccctcagggttaggaatctagctttaattttctgatgtaactgtatctccttagttatagattacttaataatcaaactcaacaatgtataggtatccagtgagtagagtgtaacctcagcaggactctgatttatcttggatcaggtattaactttttgagttattgttgcaaggaggattaggccaaggaggattaggccaaaagtcaagtctttcacatctctgaggctagagcaggggtcagcaaaccaaggtgcacaggccaaatttggccaccagcctagttttgaaaataaagccttactggaacatagccatacccattggtttatattgtctatggcagatttcatgttacagttgcagagtagatgtgacagacagatccacaaagagtaagtatttgctaaatggctctttacaaataaaatttggctaccccagggctagaggaaaggccacaactcagccgttaatccttttctcccaatatatcaagaacattaatccatgctagctctattttgaatttttatttagtctatttttcttttactcattaatttgttcctttacttatttattaagtcatttatttattcatttattgtcactgtttttatacttaaaagttttccaacatttaaagttgaggcatgtgttaacatatgttttcttctacttcttctgttttatctatatgtttttaatatatctagagtttattttggtatatagcaaatcatcatgatttaactttgtttttcactaaattatcaattatcctatgtcaattgatgaataactcatatttccccattaatttaatattatagcctaactatatatcagattcaaacatgaatgaatgcccacaaaaatgatgccgcaatcattgccctgctgttttgctccattggtcttacagtttcttcttgtaacataaccatactgtttaaattactgatttttattacgtgtgctaatacatattattaacctttattacattttctcatatattattgacctgtgttcttctttttacattttcttaacttttctagcaactttcatagatataagatataatttttatagataaaagttggaattattttttcataattccaaaagtcaatgataggagtttatgtctgaattgcattttattaattatagaattctatataaaagttagatcaaacatttgctataattataacatatatctcattcagattaaataaaattgggaagaatattcaaaatgccaaaattaaatatctacatgcattttctacattatatgccaccacaagtttgttcttaaatagaaataacacatagcttctgtgtttatcatttattttttgtttctttattaatcttaaactgtgacagaaaaactgaaccttaagttgttattaaatgaattattaataagtatattcagaacatctaatatataattactaggagtaatattaatctgtaagtctgtattaagttgatttaatacctaaactctcttttcaaaggattttaaatatttaaacattattaaagacattccccagaaattttaaatgtgaaatatgtctgacagaacacctgatctgtatctaattgtaaatatatctttggtatgttttcatatgtttagttagacactcagagtatgtataatgggctatattggcatttacatttcattgtgttaatatttatatttacatttagaatacaaattaattgcatttctggtaaacaacattgttcatcgttagaatattttattgtagactttgtgtcattttgattaccttgcataagtatttaacttcttttttaaattcagtaaatgatttcattctcttttgatatacacccagaaataaaattgctggatcatacggtaacctatttttaattttttgagaaacttttatactgtgttttctttttcattttctttccttttttttttttttttaaagacagtttctcactctgttgcccaggcaggagtgcagtgagtggcatgatcatggctcgctgaagcctcaacttcctgggctcaagtgatcctcccacctcagcctcccaagtagctgggactacaggcatattccaccatgcccagctaagtttttttctatgttttttgtagagatggggttttgccatgttgcccaggctggtctcaaactactgggctcaagcaatccgcccaccctggcctctcaaattgttgggattacaagtgtgagccactgtgcctggcacatactgttttcaataatagctataccagtttatattactgccaatagtgtatgaggattcccttttctccacaccttcaccaatacttgttgtcccttgactttttgatactagccatccaaattggtgtggggtgatagctcattgtgactttgattgcattcccctggtgattggaactattgagcacctcttcatatactttttggctctttgtgaatcttctttggaagaatctctattcgagtcatttgaccatttttaaagagatacctgcactcccatgttgactgcagtattattcacaatagccaatatagaaaaacaacctaagtgtccattgatgaatgaataaaaaaagaaaatgtggtatgtatgcctacacatggaatattattctgccataaaagaaggaaatcctgacatttggggcaacatggatgaacctagaagacattatgctaagtgaaataagccagacatagaaagacaagtactactgtattgtatgatctgacttctttgtggaatttaaaagaattgaacttgtagaagcagagagtaagatggtagttgccaggagattttgggaagcaggttggaaattggaagatgttgattaaagggtacacacttacaattttaagatgaatatgttctggggatctaatatacaggatggtgactataatggcatatattgtatttttgaaatttgtaaaaggagtagatcataaatattctcaccacaaaaaaacaaaggcaactatgtgaggtgatggctgtgtcagttaggttgattatagtaatcatttcacaatgtttgatatatgaagtcatcacattgcatatcttaaatatatacaagttttgccagttattcctcaataaagctggaaaatcaattaaaaattcagtaaataattaggggaacattttatcctatatttttctctcattatggctatttaggttaatataatttgagaaaaggttatggttttataatcaaattcccaaagcttgtccttaaagatagatgtttactaaaagtgagtagtcacacaaatacaaagtatcagttggaagtgaacttacaggcttactggccatcatctgcttactgtattccccaatttgctgtcaattagtgccctggctaatatgtatataagttttgttttggttgcacaactgaaatccaagtgaaaaatatacggaggtgtccctcacatccaaataacagtaaagcaacttgcctaaggaagaaagtgtactaaaaattggaaccatgtatggactctttctcaggttgttgcctctgaacctatcaaaagtgatgtgcataggggagatgaaggtgtgacagaggctgcaaccaggtgggtgaaggagagaacaggcaattctcagaaaaggagtgctgggtagttaatccagtaggtgtctactacactatcctcaaaccctttagttaagaggaactcttcagagactggcaattgcctctttaaatagctttggatgtttgaaagtacaattgaaatgctttcgagtagtttctaattattgtgcacattatcccatcttaaggtgattcagaaaaatttaaactccctctctatgactgttcttcagataagtaaaaatagattttttgtatgactcttttccttatccaagctaaatatgcttgtttcttttaactgtttctcatatgacctgtctttaagtctctaaacctgtctctttttttacattttccacttaaagttttctagtttgccaaaaactgaaggcactacttcaaacatctctgaaaaagagggggacgggatgggcgtggtggctcacgcctgtaatcccagcactttgggaggccgagatgtgcagatcacctgagcccaggagtttgagaccagggtggccaacatggtgaaacccagtccctactaaaaatacaaaaattagctgggcatggtggtgggcgcctgtaatcccagctacctcgggaggctgtggcaggagaatcgcttggacccggcaggctgaggttacagtgagccaagattgtgccactgctctccagcctgggcgacagagcaaaactgtctcaaaaaaaaaaaaaaggaaagtgggacgatcacatcccatactaatttactgtgaaaatactcatttctgtcttgactatattgaaatataagctccatggtgttttattaatgttttcagctgataaactctactgtctctatcttgtagttgtgtggttgcagttttagaccccaagttacatgttaatttgttaaagtaagtccattgctctggtccatcacaacatctttttggatcttgattctgtatccaagatatttggtctccttcccggactctttgtttttgtttttcgggttttttttattccctgtcctgggacccccatctttgtttttataatttccctattgacccctttaaaacatattgaagttaaagacaatgaaatatgaaacttagagggaaacttgtttgatctcattatacataatggcatcagtgaagtaggcatataaggctctgttcttacattacgttttcagaaaagatgtatggcctagacctgttctgcattgttgttctgcattctgcactcacaatctccagctcaaatcctttcccattaccagatcaagcagtgtggataactaattcagaaacctttttttttttgagatgaagtcttgctcttgttgcccaggctggagtgcagtgatgcgatctcagctcactacaatctccgcctcctgggttcaagctattctcctgcctcagccccctgagtagctgggattacaggttcccaccaccacgccctgctaatttttgtacttgatggggtttcgctatgttggccaagctggtctcgaactcctgacctcaggtgatctgcctgtcttggcctcccaaagtgttgggattataggcatgagccactgtgcctggccctagttcagaaatcttataattcttttgtaggtctaactgtatcactaacatgggcagcttcagcaagttagcatttggaagccctcctaaagatcaaagttctcccagtatcctcgtgcagttatactgcttacagctatatacaacctctgaaacacccagcatccattcaccaaagataaagtatacatcagtattatattgcacatattacttccatagagagggtaaaaatgttaattcatggaagaccacgaaatcataataatcatttgtattgtgccacacattattttaagcactttaaacatcctttattttaccttatccaaactaaatacacttttttattttaccttatttaatggctgtgtcaattaatttttgagatgttatctctgactatcttcattttactaatgaggaaagtgaaatagaaagaggctgtttacttgtctgggtggcacagatagtaaaataaaagaatcagtatgtgaaacagctaatttgacttcattctcttttaaacaatacaccatactgccccatcatatcaaaaaaatgattcgaaaaatgcagggggaatgtatgaagtttatgagaatcaatatatacctgtatctcttaatctggtccctcagtccattggagcacctcctaattcctctcaataacatcaacacatttagcaaatatgatctgcttatgtctatattcaagtctatttagctatccatttgttatttgcaagaacgatgaaaatgacctggctgagggcttttatatattaggaacacttttccatgtgaatacacaatcatttaagtatttttctctagcctgtatcctccatgttatctaagtaaacaatcagatactttgcttccagttgttcagatacctggaatctttcacatttctctgtatattagatttgtagcaatttaaaaaaataagattactttgaaattacttccattacaaaattgatccaagacatcgtaacccaattataagatcataatatggtgttatggttagtatctacattctaagttgtgaacctttagtatagtttaattttatcagagaagcagaaacttatcaatatgctaatgaatgaatttcaacatactcttctgtatagctaatatgaaacagtgatgcttatacctattgttctattttcactaccagaaaattcagtaatattagaactgttttttaaaaaatcaactacaaccaaaaaggtttctgaggaaatactggcattttatttatttgtctttttttttttttttttttttttttttttttgcaattttagcttcccttagagctattttagctaacaagttggaattctggaaggctgcagtgtatataaatcactcattctttagcctttggttatcagagccatgaggttttattgcacttagatttatcagataaaaggcttctggagacctatgatgtttgtgtaaccctcacctaaatttgaaaataattatatctagtgctatcaaacattacagatattaggactatatttgttcctaatgagctggatatattaaatggctgttcctttcataccatttttgcagaaataattcctgctgataaacattagtggtgactatctacagagggccattaggatcacagagccagctctgataattttggagtttcctaaaaacttgtcaaaagtgcaatcatgttttaaataatgttttgaactctttcaaggaaactaatttttttggaatccattattatgcattggctagctgctgatttcttactgctacttattataaataaattcaagacttatgccctcctaaccttaagaaactgaatcattcatccttcatccttaaaacttagcaggaaaatcaaaacggtgtttcagctcaccctctgtagtcatctttggtcttcctctttaatctactccttcattcttaggacaaggagtctgcaaatgatagccccgtgggtcaaatccagcctcccacctgtttctgtactgcctatgagttaagaatgatttttacatttgtaaattgccttagtccatttgggctgctataacaaaatgtcatagatgggttagattctaaacaacagatttgtttctcacagttctggaggttgagaagtctaagtttaacgcactggcaaatttggtgtctggtgaaggcacactttctgttaacatagatgatgccctctacctgtgtcctcacatgatggaaaggacaaggggtctctctaggggtctcttctataagggcactaatctgatccatgaggaccccaccctcatgacctaattacctctaaaatgcccaccttctaaaactatcacattgataattaaattttaaaatatgaattttgaagggacaaaaacattcagaccatagtataaatggctggaaataaattagaagatttgttacatttgaaaatagtatgaaattaatgtaagtagcagtaagaaagcaacaactgattaatacatatatacatatggaagtcaaattttagtgtccataaataattttttattggaacatagacacactcactcagtaatgttgtctatgactaccttcctgtgacaatagcagagctgaatagttgtgacagagattatagtgcctgtaaactctaaaatatttatcatctgactctttaccataggagtttgtcaacccctgctctggacagtcttctcttgtcagggcagatttttatgaggttgcaccaaactaaatagcttcttttctagatctgttcccttcttttgcactccagaaaaatcttgttcagtgcccattgtgggttcagatatccctaaagcattgggatatggcaagaaagtttgaaaatatttatattatttgtctcttttattctgatttctatttttctaaatgttctattggagatgcaggtcaaaagtttgctttgttgatggagtacatgatcaaataattttagagaccattgacctacgtaaatacatcagaagcctgctcacctggctcagcaaggacaaacactgacaacctgatagcagcgagagagagtgaagcatttattgcagggcaccaagcaaagaagatcaggcaactcacatttaaatcctgacctccctgatggcttacagatgaggattttttaaagcaggggtaaatttcaggaaagcagaagttacaggcaaaattgtaaatcaatacatggaggtttcacattggttttggcctaaaagggcaggatatcatgaagcagggggcttacagttcataggtagattcagatgttttctgatttgcaatcagttaaggaagagaagctttgttttgaaatttgtggtgagcaaaaagaatgttagctctggctcttgggtttgactttctctaggtacctcagaaagaaatgcagaacaaagaactttggtcaaagttcagcccttagttctcccttatctgaggcctgcttgcaggcagatccattcggtggaggtacagatttccgaaaaacaacttagagacatattttatcgttagtttctatgagagaacgaaacatcctgtgattatagcttccttggctattgttttaagctactgttaccttcttgcttatcaatttgcttatttacttctcaaggctagctaggtgcctggaatttttcttgtaggatctcaagtttttcctttatttccatgcttgggctcccaccctccaccccccactgcaggcccctaaagggggttctttctctatctcaataacctgttttctgtaaaatgttagagttctttggtatatttatgggtaatatatgaaaaacttttagaatccaaaaggtttgaaagataatggattatagaaaattaggcaggtaggtttagtactggatgcctggtggcctttaatatgcttagatgccttgtgaatcaccagaaggaggtctctttggtgtttccccaaaatagcgtggtcacataacttcccatttagccccaaatatttcaaagaacatttttgaaaaaggttctctcatttcataggatgtttcagaatgttaaattttattgcatgtttaaaagcacaaatgataattatagagcactataaaaatatcagctatcatttggagatgcttttatcaatcttgacaccgagacaggcatctaagtgactgactcgattgttacttaaaatgtatttgttgtcgttgttactgttgctacttaattaattttgaatatacacgtgaagtcagactgtgattacagccgaaaagaaaactgccaccatgatgatgttccttataaccatctaatgatttgcaaagctacttcagcaagctagtgatagggtctcaatcagtattttaaccaaagtgataggaagattttgattgtagaaccttctgcaggaatcaatttatttttaggtcaacaaataagaatattttgcgtatatatccagattttctatttgccaactttttttgttataattttgattacactgtaaaccagagtgtatgtgagacatgtctcaatcaatttatgtatttatttaaaaacagggtctctccatgtcatccaggctggagtgcagtggtgcaatcatagcttactgcggcctcttcctcccaggctcaagccatcctgccacctcagccgcccaagtagctgggactgcaggcatgtatcaccatgctcagctaatttttgtagagacaaggtttccccacattgtccaggctggtcttgaactcctgagctcaatgaatttagaagtttattttggtgaggttaagagcctgcccatgacacagcctcagtagggcttgacgacttgtgcccaagataatcgagctacagcttggttttacacatgtattagtccatttttatgctgctaataaagacatacccgggactaggccatttacaaaagaaagaagtttaatggacttacaattccatatatctggggaggcttcacaatcatagcagaaggcaaggaggagcaagtcacgtcttacttacgtggatgacagcaggcaaagaaagagagagcttgtgcagaaaaactccttttataaaaccatcagatctcatgagatttattcactgtcatgagaacaccacaggaaagacttacccccgtgattcatttacctcccacagggtccctcccacaacacatgggaattcaagatgagatttgggtggagacacagccaaaccatatcattccagcccttgcccctcccaaatttcatgtcctcacatttcaaaaccaatcataccttcccaacagtcccccagaatcttaactcatttcagcattaactcaaacttccacagtccaaagtctcatccaatacaaggcaagttacttccacctatgaggctgtaaaatcaaaagaaagttagttacttcctagataaaatgagggtagagacactgggtaaatacagccattccaaatggaagaaattgaccaaaacaaagggactacagactccaagcaagtctgaaatccagcagggcagtcaaatcttaaaaagttccaaaatgatctcctttgactgcatgtccgacatccaggtcatgctgatgcaagaggtgggctttcatggccttcaccagctccatcctgtggctttgcagggtatagccctcctcctggctgtgttcatggtctggtgttgagtgtctgcagcttttccaggtgcatggtgcaagctgtcggaggatctaccattctggggtctggaggatggtggccctcttctcacagctccactaggcagtgccctagtagggactctagggcactgatgtcacatttcccttctgcactgccctagtagaggttctccatgagggtcccgtccctgcagcaaacttttgctgccctgggcatccaagcatttccatacatcctctgaaatctaggcaaagtttcccaaacctcgatttttgatttctgtgcacctgcaggctcaacattatgtggaagctgccaaggcctgaggcttccacgctctgaagcaacagcctgagctgttccttggcccattttagtcatggctggggttgctggggcacaggacacgacaccaagtccctagactgcacacagcagagggaccctggacctggcccatgaaaccattttttcctcctaaacctctgagcctgtgataggagaggctgccacataggtctctgacatgccctggaggcattttttcagttgtctttgggattagcatttggctcctcgttacttatgcaaatttctgcagtcagcttgaatttctcctcagaaaacgggattttcttttttatctcattgccaggttgaaaattttcttttctttattttattttattttattttattttattttattttattttattttgagacagagtcttgctctgttgcccaggctggagtgcagtggtgcaatctcagctcactgcaacctccgcctcccaggttcaagtgattctcctgcctcagcctcctgagtagctgtgattacaggcacctaccactacatccagctattttttgtatttttagtagagacagggtgtcaccatgttgaccaggctggtcttgaactcctgacctcaagtgatctgcccaccacagcctcccaaagtgctggtgttacaggcatgagccaccatgcccagctaggttgaaaattttctaagcttttatgctctgtttttcttttaaaactgagtgcctttaacaccacccaagtcacctcttgaatgctttgctgcttagaactttcttctgccagataccctaaatcatctctctcaagttcagagttccacagatctctagggcaggggcaaaatgctgccagtctctttgctaaaacaacaaaagtcacctttcctgtagttcccaacaagttcctcatctccatctgagaccatctcagcctgaatttcattgcccttatcattatcagcatttttgtcaaagctattcaacaagtcactagggagttccaaactttcctacattttcctttttctgagctctccaaactgttccagcctctgcctgctatccagtttcatagtcacttccacatttttaggtgtcttttcagcagcaccccactctactggtaccaatttactgtattagtccattacatgctgctaataaatacacacccaagactgggcaatttacaaaataatgaggtttaatgtacttacagtttcacatggctagagaggcctcacaatcatggcagaaggcaaggaggacaaagtcacatcttacatggatggcagcaggcaaagagagagtgcagggaaactcctctttataaaaccatcagatctcttgagacttattcactatcatgagaacatcacaggaaagacttgccccatgattctgttatctcccaccgggtccctccctcaacattcgagaattcaagatgagatttgggtgaagacacagccaaattatatcaacacattttagggagacataagacatcaatcattacatgcaagatatacattggtttggtccagaaaggcaggacaacttgaagcaggggagggttccaagtcatagattcagagattttccaattggaagttggttgaaagagtttatctgaagacttggaatcaatagaagggagtttctgggttaagataagggattatggagaccaagattcttattatgcagatgaagcctccaggtagcaggctacagagagaatagattgtaaatgttccttgtcagacttaaaaatatgccagactcttagttaattctctcctagatcagggaaaagacctggaaaaggaaggggattctctacagaaagtagattttccccacaagagacaactttgcaggaccatttcaaaatatgttaaagaaatatagtttagggtaaaatacttcaattcctttcagagcctgttatgtgatgctgtactagagtgaggctggaatttggtgtcttattgcacaaaaagtttgtttcatcagtcttaagatctctgttttaatgttaatacctacagttatgcctgaatttcaaaaggaggagggtagaatgaggcatgtccagccccaccttcccatcatggtctgaactagtttttcaggttaactttgcaatgcccttgactgagaggagggggcctattcatatgattggggggcttagaattttatttttagtttacaacaccttttacagaaggagaagctactctgattaatttgttaagtaatttaaatgatgaaattctacatatcatattgtcttctgaaggatgaactgagaagtgtattatctcagaattctgggtttgaactaactaacaaatccatttgctttcaggtccctcctccgtgaatcaaatttattcatttttttctgtagtaatggctgaaaagtagtgctgataattagagtgctattatgaataacacattgtgaaatctagaattctcagggtttctttgtttacttggttaattatttttgtttggttttgattttaacttctgaaaccttaccctgtgagggccatatggatcacctttcaggtataacatgattgtctcctatgaaacaaacaaaaaaaaaattgagaggacacagacaggaagtttttcaaatgtccttcagtttacttgttttcagttcctcaaaacagactggtgcaaagcagtttggagtttagaatagctttgaaagcatttattgttccaaggctaattttaaccttgtgataaagattgctttttgtattcagttgaatgtgagatccagtaattgtttgttaaggctaagtgctgtaggacataatacattttttaatggtgttttgtaattataatacaagcatctttatggcctaatatatgaaagaatgctattgagtagaatgatgagaaaacagacttcaaattttattattttaattattatatcgcatagctgcttatcttatatttagggtagtttgactttgtatgtatgctcaaataaatgatttttcattagctgaatagtttcatagattcttggcagaaacaaactttttatcctcctcatttttttctttccattttagtcagtaggatattggtgaggaaggttccctaaggtagccaaaacagaggtgtgtgttgcccgaaatgactttaatatgagtttgaaattacctctatagggaagttttatgctttccctctgttttccaaagtttttatgattggaatctctagaataaagttgaaagtagacagatttaacaggagaaagggcatacaaatttatcaacttcatatatacggaagtcccacaaaatatgagactctaaggagtgccaaattgtggaagcataaataatattttgagctacagaatgaagtaggggattggggcttctgaggggaggtggcagcacaagcaatagaagggtgaaagaaggaactgaactgaaaacaaaggttgccttatatgcagataaagtgtcccaggtagtagccttaagaataggtgaaaagtgtaagtgtgatcgcttctttctttttttttttttttcagatggagtttcacttttgttgcccaggctagagtgcaatggcgcgatcttagctcactgcaacctccaccccccgggttcaagtgattctcctgcctcagcctcccgagtagctgggattacaggggcctgccaccatgcctggctgattttgtactttagtagagacagggtttctccctgttggtcaggctggtcttgaactcccgacctcgggtgatccgcccaccttggtctcccaaagtgctgggattacaggcatgagccaccgtgcctggccgtgtctcttcttttgcaaggagttaatcttgactggttaatgtagattccagggaaggagttcaggacaatgacatttcttcaggaagaatttcctttagtcagataaaagaaacttctgagaaggcctctccctgcacttcaggaaagaaagaacaagagatgggggctgggagaaggccagagagaccttggttctgaggctattcctttagttcaaagtactcagcatatcaacgcaccatacttcagggtgtcgtttttttgagccccaatgcctctaaatcataaatttgtgccaagggtttcagatagcagtatctccaatctgaaatgttcccatgttgtatgttttgtagttgtatagataaatgactgaaatcctcatcagtggtagattagggatccaccaagggatctgtaatcccaaaggatcatgtaatacaagctcaagctcatcattttgttagtggaatgactagaatcaatattctttctaaaacatcattcagaaccatatgacaacagaggcagtaatactgaggcaaaacatacaatcttagagttatcaaacactgttatcttcagatttgcacctgctttttttctgcttaataagtttgttttcattttttactataaaaattgcatactacaaaaattatatagtttaagatatagtaaaaatgaatacctttttctcatttcacagaagaagagaacataagatattcctgtacctttgattctgtttgtgcctcctcaattatattcctttctcctccctcgaaaggtgactattttagattttatgataatcattttcttgcttttgcgtatgtttttcacataatgtatttctaaacagtgtactatttagttttgtttatttttttgcctcatataaacataatcacacctttatatttttacacagcttgcttttttcttgttattgttcaatattttgttttttcacatcaatcctagttgcagaattagcattagttcattaattttctctaccatatactatttgctcacaattccttttgttggaaatgtcttcattttttctttatccttgagttataagtctacaaggtatgcaattctcagttaacatttcttattcatataaaatattctaatctcttctggctttcattggtactgccaagaagtgagctctcaatctgctttttatttttgtgagtagtctttttttcctctggttattttttaattcttccctttcttgtatactacaatgtatctagatatcaattctttaaaaaacgtattttcctcagtttgttgttgtctggaatctaagaattggtgtccttcatcaattctattaaacccctgacaatatctttggaaatggtgcctctcctagttctctccatttgcttcttgtgaactgcaatttgatttttcctttaccttgttaagctattctccatgtctcttaacctctagatcatgttttgcatcacatttgtttgctttcaggtaacttgcccagatatatcatcatatcatccccaaaccattaggttttaattttccatattattttttttatttctagaaattctatttgctcatatgttatatcttcatgataaactttgagtttctcattatttatacattcaagtctctcgtatttttaagcatattaatttttttatattttacatctgataatcccattatatacattttttggtagatctgattttgtagctttttctttgcactggctcccacctatgatatcttttttctcatgtcattagtgattttcttctcttgtgggctcacattccttgaaaatgtatttatgggaatttataaatatttgaggtaaagtaaattctttcagagagggtctgagattgcttttactagttatctaaggacaccatgactaggaaccacttttaaaccaaatttttaacctcgcagtttaaattttggggctcacacaggttaagattcttagaagagacttacctccttgattgctaaagctgaaactgacgcatgacccgccattgctctctagttattttctagtgagagcatcactctttcttggtcctatatttatgtggcgatttctactctacctaacaacgtgctcagtcccagactttgtctgctgtctcagatgtttgtaactcagtttataggccaccagggatgggcgaaaaccttgagggtaaacaccacccaatagttagtttgcccttgtgaatctctgcttcgtgcttatttctgatctctcagaaatttccttattttgataccagtacagctatgcatcttttagaaaaaatcatatcctgtccagtaggtttatatgtgttatattgcaagggattcctttcaatatcttgttaaccatgttgtagaaatggaaaactcctctcttgactcttttagatactcctttaaatagtagtcatttcatttgcagtcgactgtagagtagagccagagatttacacaagttttcttaaaagtaaagattttaaaaaatatttatcacttccaatgaaaattctgctctaatacttgaagataattaataattgttaaaactgactcatgcttacaccttcacagctgctattctgggccttaaaagatttcttcaaagcatatcacatgatcatcttataagcaggccagcagaaatttctaagttaattaccgtttggcagagtgtatccaaaacctcttatctgaacagtgaacccaataatttaatcagtctgtctgttgattaatcacgttctaatccatctgatatcagcactaaaaaagcccttcatctgtttcttgtaaaacttatctccgtgaatgcacagctgctgtgagctattggtattaataacttgaataggagacagaacacaatggattctcaaagcctgcagaaaaagtttgaactccttaaaacagtcattcaggactctgcaatctgacccaactctatttaatcctcccatcctcatttccggtttatttcccagctttagccgtgaactagttaaagccagtcacctgaactcccacaacttttgttttgactgtttctgaagcctagtgagttggtgaatgaataaacatttatttatcaaataccacatgccagtcatgtgctgtattgcttcatttactatcctacaacttctctgtgacagagtgatggttatccggatcggcagatgagaaggtcaaaaaacaaaacaaaccacttttagtgtctagtttacaaaatcataagctctttgaaaaagggcaagaggaaaaacaaaaggctacatgattatgtgagccagtatttttatcagtcagacataaataaaattcagaaaattaatctccatatttctgtggtataagacaccacatgctttatatatgtgacacactatccaagaggtgaggaacatttggtgttgggtgagcactggagaatatgtgagtaaaactccttccttggcatatagcagacattcagtctggtcagttttcatttattattcccgtcttttaagcctaatcaggtcgtacattttttcttattcattttagaacaatgtgctcttctttgttcttccttacctacttcttccactgtcttccctgcttacgtagagtatctatccattccatcagttcagcctaggccaagactgagattaagtacacaccgtgccatgttgtgttgacagtcttcaacacactaacacatgataatgagagagtcccagtgtagtctaaaacactggagaatgtcaaagcattcttagaattttgatcttgcaaggttttgggccacaggaataggaaatggaccatcatgtttgattcaagactatggagagtttttatttcactaaatgataattattttgcctgtcttaccccattttcctagataattatcctttatcatgcctgtatattttcttctaaagtttctaaggtgaatttaaatctactggtcctggtgtcacagattcctataatactagttgcccagctctcaattacgccatcattgtttacctgagcatctgtgtgaatcctaattaattttatcctgccagacatagttcattaaacaagggatgactaactaatgcagcttaagcccgttagggcctctgtcaccaggggttaaaatctggcctaagagattacaagtttggaggagtgtctttccctacaacttgtagacttgggacttgtcagagagctatattctatcatatgaactgagacagagaaagccctctgtggagagacagaaagaaaaatgaagagataagccaacagaagcagagaggagacacagaatgattcctagctgaggtatagttgcatatttgtgtgtgttatgtgaaatactccttttccttaaaataaatagacaacaccccattttttaaaaatttaacttattcaagttgatttgtttttcttgcaactgaaatgagttctaattattattacatatattaaatgttaagaggtcactaacaacattattattatccatatcacataagcacacctgagttctagtctcatctcgaatgcttactagatatgcaaccatggatataggtcatgataatttgaaaagactgatatatgtgacagatttgtgctatacatatctaaaatattattatttctacaatgtcagtgctacaacttctctgataatttatcttttatttctaggataatagtgctatttttgcttattgtgttttccatgtagataggtctgaagttcctgatgacaaaagggcaaattctgtcactaattcagatattgagtactgtcgttatataagctactacaagagaaaaatatgatttattgggaacaaatacttatcttgcccactttgcacctccaagaaaaccaagtagagagtattctgaccattataaagtttattttgtggaggaatcaaatattaatatacttagttcatgaagaaaataaaatgttagtgagttctttcatagtagcgcaattgttctagaaactgggccactcttgaattttatttcacttttagctattcacagggtatcagtatgttagatttataatgatggaatctgactctgtaacaagatatttgttgttagacttgtttgtagagtgattttcctcttttgtgaaataatgtatggttatgttgtacttatctcagtaggattttattaggaaagtgatatattttaggaaacagttggtcatgaagtacatttaatttttgaactcctagtttgtaaaaccaaataattaaaacatttttgacaaaatatttacagcagaatcttggaagttaagaaaacaaaacaaatgtttcttcgatttcagttacaggttttcaagtaaactgataaaaccttatcaacaactcatagcgatatacactatactactgcataactcattgaacagatttctcattctgccacatttctgcagttcaagagtaaagcttctttataattatatatcactagtactttcagaaagccctccttgctctaccatttccaatttctcctccagcatctacctactccaagaggtaacttctatcttgaattatttttagttgttaccttacttatatttatagttttatcctgtcagtatgtttcactaaataatatattgctttgtgttgtgtgtcatattctatatatttttctagaacttgcccttttcattcaacaagatgtttataaaattcatccactatggtatatgtagccatgattcactttgcaaattttatttcttgttttcatccaactttgtttgaccccattctttttctagcctcttactcagacatttctgcaaagttttctttttgtgttcattgtggccattgtgactgttttaattcagtagtaaccatagaaacatcataagtttttataataagagaggtcaagtaaatgaacctaaacaaatataatcagtccgcttaccatttaaatctcttttctgatagagaaaaaatcattatcatcacttcaaatgttaaaaggtcactaatacttgatgttataatggtagttataatattacataaagcaaagatattacctaacacttccttttctataaacatctgtttttaaaatatctgaatatcgttaatgcactgaagatgagagctatggcagtttgtcttttttattatagagaatgaactcttctctactctaactattcttgaatatgtttattttgttatattaactcctttaagcaatgctaataagacttagccattaaatattaaagcaaaatattctcttatgaaatcatgctcaaattctagtcttcccaggtcaaaagctttagtaagttattgtccaattatttaaactctaactctagttatataaccaaagataattggttatatatgtgttttcattcatctttcacttaatttaaaaattctaaaagtctcaattcagtggagaatgtttttggcaaaacaatagcaaacatgacaatttgggaaagaaaatctagaataaaatttttattaccgatttattactggatgaatacattggaattttgcactttagttgaatttggaaaatgttgaatttctatgatgctaacaaattcctttcagatagttaacccattctacaacagtaggcatctgtaatttgagaagttataaaggaccttttatctttggttgaattaaggaatgagaaaattgacctgtttaaataaacattctctattataaatcaacacaaaggaataagcattctctatcataaagcaaataaattttcctttgatttggtttgtacttcctgttcattatcttgattaaggagatcattcataactttcctatgctatatttacagtttaacaccacatcgtagaagagaaaaataaaccagctccaacattaacaagaaacttaactcataatacacaaagaaaaaattcttaaaggtagaattgtaggctttgaggtattactgatgagggaaatgcttaagaaagaagcattttcttgacagtcttccaattaaatattgtcagcttattgatccttttggctaatgtgagatgttggctttgtggttattagtaggttactgtaaatagcatatagcatatagcttagaattcctgaaccatgaagatttttttccttattagttataggtgaaatttccattctgtgtcttttatattctatgatattttaaaaattcctatgtatactgttaagatgtgttcttagcatacaggacaaacataaaagacaactgtagttggacaggctcattagctaggaaataccctaggtggtcatggatcaggttaagaatacacatccacatgaaccaaaaaagactggtagttgtattgtatctgaatgggggcattctatttaaatcctagagatcagcgatacccagcagttaagaactagcaaccaggaaggtcttagaagctgcagtgagatgaagttcaagcatgctttctgtcagggagtcatcacagtaggctgcgtgagaaggcctatagcagtgggtgctttgtatcacagcatttggttcagggatctatccaagggagggggtgtactgagttctagaaaaaggggtccctgaaggatcagaagaagcaagcaagaacccaattctagacaaatggactagcaggaaaagatctaagcatagtaataaatcctgaactttgaataaaggcccgtttttgctataaagacatacctgagcctgggaaatttatgaagaaaaataagtttaattggcttatggttctgcaggctctataggaagcatagcagcatctgctaatgtggaggcctcagaaagcttccaatcaaggcagaaggggaagggggagcagtcacatcatatgacaaatcaggagcaagagaaagaggggagagatgctacacacttttaaagggccacatcttacaagaactcactcattatcatgaggacagtaccaagaggatgatactaaaccatttatgagaaattctcccccatgatgcaatcaatcatttccaccaggccccacctccaacacagaggattacatttcaacatgagatttgggtggggtatacatccaaactatatcaaagcccaaaccactggtctgttcagcagcagaatgcagccagcaataaatgtctttggttctcatacctcaggacaagacttattctagtgcctatggttttagtctagactcattgaagatacagtactttattttagcaccactaaaggccaggctggaagctgggcatgtaatagtaaacaaaatatagtttctttctttacaagtcttatgctgtagtggaaggtacagtcaggaatatagacaaccacaataaatggtagtaagaatgccaattgaggaaggtatatattgttatggtggcatgagtcagagcatgttactaagactcaatggagttggagagaaaagaaaaacttctcaaaggaactgaagtctaagtgaagatatggagaatgggcgggagtagggatgctgctaacgtgaatcagttttgttgaataagcaggaagcacctgtttccagaccaatgaattaaaaaatggtcatcaaaaccagatgccccattatttgctcaccaacacagtaccagggcacttgacttggtgaactaaatacagacttcactcctccttggctaagaaatcctgtgtagagaacaacttgtggcctaggttggacttacttaggtgaagagcatttagagtagggagtaaagcagaggaaaggaggatctcaaggtttaaagggtatggctcttgaaaattggaacacagaagaaaaccagcctcatctgagtgaaatatttcaagaattgccttctcagaccatgaaaacaccggagtacccactggatgagcttcacagagccacctgtagggacgtagaacatacatttaagcgtttgccaagatggaaattgacccacaaggcttgagcttcgtggagtaactctatttgtcattttacccattaggattgtgaaacatggtttcacaatagcaaatcaaagcaaggctggtgatgttgcacacaattacaatagaaatggaatggcttaattagtaaaaaattaactggcatgattcctataagttaaaatgtacatatttaaggaggcttattgtaacatttataccatttattttataatatactaattcgcatgtaaaagtgaatgtaaattaccagaaattaacatgcaatgtgaagaaaagtccttttatcctctgcaactgtagcatttggcagattcaggaataaataatcttttgtggcaagggtatgccttatcaaacatatgcagatcagcactaattaatgctaattaaggtttcctgtctatctagttggaaaaacgtccaaatgttatgaaatccagttagtatgcctattacgctaattgttttatatggggtggttcttaattaaaatatgtaaattgaccttaattgctatatactaatgggggttcatgttatcttactaaaagtgacaagatggtgaggaggggtacttaaatgactaattctgataaatccttaactaaatgacctttcctcaaaattaattttaattggaagttggcaaaagaaacattttccttctttgtttctttttagttttaagtaatggaagaatgttattcttcttcgttaatacagctttagaagcagttgtggattgttaattacacttaacaagcaagttaattttactgtttactgtttataggtatcaggaagttattgatatactcatttcagtcttggagaaagtgactttcttctcatttaaagtgaatatatagttataatcctataagtaatttcacataaccagtttattagaatgtgtgttaatggttgatgagccagtaatactaatattattccttcactgatttacatcggagttacttttttcagaaaaaaaaaatataaactttttactaacattaattcttattggagttaaactatgattggagatacctagattaaatagacagaaatgataaacttttgcattttacctatcatatttttattatttaattgcaaacaaattaaaatgagtatgccctaaatgagtgttaatgaatataaatatttttatttttgcgctattctaaacctagaattacaagaagtaatttagctaaagctaacaaatactttattttacctttttatttgcaagtagtttatgttcaattctaatttaatgtatattaaaaattcctctgcaaaaatgtgagaagggacctcataaaatattgtcatatggaaatgagcagataataaagattatagcttttctttgtcaaaaggagactcaatatctttactctttcatcaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacgtaagtgtgatttaacatctaaaacaagagaattggcataagttggtgaatgtttatttaaacatccaattcataggcttataaatattaatgtgtatattttattaaagaatctgccagttgctttgctgatgcatagaaagataaaaaagaaagaaaagctcaagaactcataaaaacccacacaatgtgaagctttgttataaatgggtgccatgtaagatggaagaagtatctacataagcagaaggaagagaaatgaaatactcattttattgagttggttttcactgtatgtggctggtatttatgaaggtgatgaccttaggaagaaattgtaaactataaatcattttaaatataaacctgaggcagaagcagcatatcttcctatgaagtctatattttttcagtgggaaataatttattaaataattttaacactcctatactaaattagtcaactatcttttataaaatcttttttttctcttaaagaaccatgcctaaatattgcagtaaaatcaggcttgaatataatagataatattttctcttcaatagtctgattagggtgatccttaatgtcattcatttattgtccctatccctcccacctccctctcccacttcctatttttttcctactccttcttcctctttctctctctcatccttcctctcttttcccctccctcctcctcaattctctgtctctttcaaatatacacaacttatttctctttctttcattctttctttcaatgaattgttagtgaatggaggttgaggtttgaggcaatgtgtgggtttatgtcatcgaaaatatttttttacctacatatgtctttcaaagacaaaagacaacacttaaatatactaatgataaatatttttaaatctattgaaattggtggatgtttgtctacaaactgataaattgcaaattcttacaaaggaatatagaaatcacatgattgccttgcccatcaagttttttttctgttttagacagctctaattatttcaaaattatctcttgataattttgaaataaaatacatgcacatagaaataaaataaacttgaaataaaatacatgcacatagaacttgacataaaatacatgcatttgaaataaaatacgtgaaataaaataaaatactaacttgaaataaaatacatgcacataggacaaatataatttatcttcctcaagatagtcgtttggatgtgaagggaactatcgtgacccgtctaaaatctatagtttctgcttattagaaatttttctcttcctgagcttgatgtgaaaattatccctgttttcatattatataattaactctatatgagaattatgctgagctatttgtttattaaaggacccacatcttttgggaagcctttctcagaatgataaggactaaaaaaaaaaaaaagatcaactataaaaagaaataatatgtttgtaaacctgatctacagtattaaatactctgccaggtactgaacatgcaacataataataatggttataatatattatgagcactgatataacactcactctgtgctaggcacagttacaaaagttttatttattttaagctcatttgatctttttgaacaactttataagataggtagtattattttctctatttaactgatgaggaaactgaggcacacagcgattaaataccatatcaatcgttacacacctaatatatggtgaagctagaatttgaacttgaaatttgcttttaccatccatgcttctgttctgatccagtgcatttgcctatgttgtccttaaatattcagtattacatttttttttaactagagatgggtccccccgcccaggccagagtacattggcgccatcatggctcgctgcagcctccagcttctaggttcaagtgatcctcctgcctaagcctcctaaggcctacaggtgcatgccaccatgcccggctaattgtttaattttttgtagagatgatgtctcgctatgttgcccaggctggtcttgaactcctgaactcaagcagtcctcctacctcagcctcccaaagtgctgggattacaggtgtaagccactgttctagtattacattttaatgcaacatgagaatggtatgaaatataaattcccaaatactgattcaatagtatctagataagctaatgtgtctgaaaaaaaaaattttcctggaaaataactcctaccaatggattgtcttaacttcatgtgacactttttctcttttttgggtaggagtaagttgttgtaataatgaccaccaagaaatgacagtaagtggacaagaaagctgagatgaaacccttgccttgtgattctacagttgagtagaaagaagagacatagttaatattcttttcagtttccctggagataattttcttctcttagaatgctttttcttgagaaaaaaatgcatacttttcttgtttctgattctttccctatttagattatacacatcattctttttctgtattcctagaactaatttctaacatttttactcctcatatcgaagataacgttttaaataccattaaaatggcattcccatttgaacccatagaaataatgtgtgtgcacctcgatattgccatgctgagagtagacagtcccccgctgttttggaattattctgatgggtttgcccaatgagctgaatgaaagaaggtgacccttcattttccaagtttaattatcactcttgctggagttttttcacatcattctcgagtgcatggctgccacctttaatgacagggactggacaattcaacccactgtggcagcttctaagcaaaagctaacttttctgataaaaagaattgtgctgggtgtggacataggtcagctaatatcagtagctaatgtctctgtttccagagagggtgagcaccagttgaccatgaaccagaggagatggctgatgaacttcttgaatgtaaaggcagagagacctctgaaatatattgtgagggctcatctctgaattgtcacagttataccaaagcctacattcacactagacttctgcttggctttcaaggtttccttttatttatctgtgaattaaatttggcacattgatcattgtagtgacaatttattactgactaagagctttttgttcctaagctgagattttgtaatgcttattattaaatgtgcagaataactagggcttgcagaagtcagtttaaagtgaatccttttattctcaatgcaaacgccttatgaatcatgtattttgggccggggaaaattttttttaacaaaaaatacatgctgcactttgaatgcactgaattaggaagcaaagactgaaattttttatcatttgtggcagttaaagtaggaagcagaaggtagggcttcagcagtgaatcaggtagtgaagatagaaaaggaaatgatggctttgttagagaaattaataaggaagaacaattgatatgtaaatatacatctattacaatacacctcatttctgtaaaaaacacttcctcggttaattactgagagatcagcattgtacacattgggttcaaagtgattccaaagaagttgatctacatcagcactcctgaaggtgctttactgacaaatagcctctaaatattgagttcttaacattttatgtgtaccagggactccttaggcactctggcgaagcttgggagcctctttccagaatatttttgaaggcataaaacaaaattcatagggttacaaaggattctcactatctcacttaaaatatacgatatagtaatgtattttttttattaaggcactaagtaacaatctagtgatgggtctaataactactcaaattttgatgtcgtggtgagtataagtacttcagatttctgcagcaactctactgtgattttctgtgatttcttttggtccaaagtgacagatatcaatagtgccactatggtttattgcatttgtcatcttaaaaacatcagacaattggctgggtgtggtggctcatgcctgtaatcccagcactttgggaggccaaagcaggcagatcacttgaggtcaggagtttgtgaccagcctgaccaacatggtgaaaccccgtctctactaaaaatacaaaaaattagtcaggcatggtggcaggtgcctgtaatcccagctactcaagaggctgaggcaggagaactgcttgaacccaggaggcagaggttgcagtgagccgagattatgccactgcactccagcctgggccacaggagtgaaactcaatctccaaaaaaaaaaaaaaaatcagacaatttatacatttagaaaggagtaatacttagaaaatattactacctgtgggctaggaagcaggtttctggccaaaaccagagacagaaacttcaagggaagaaaggtgagacaggaatttatggtgaaggggttggctaagtatacatactaggttataggagaagctatgaatattcatgaagggaccttaacatctaagttacatattaggttatgggagaagctatgaatattcatgaaggggccttaacatttaagttacatattaggttataggagaagctatgaatatgcatgaaggggtcttaatgcatgtgtgctgaacaaacatgcatgttatatacatgcaatgttcactttgcagtggagacttaacatttgaatgtattacagttgggctgtgtacatcaaaaggtgaagcagagacatgaaggcactcagtgcacagcctctgtaaactgggcagaaccagtcgatggtttgtagtcccttattaggagaaagttgctaaaatccatctcttgtccaatcaaatctgtagttatgactgtggaagaggggaagtcggtcagcatctggtgatcagtgagctataattgtttttatattgcttatcttgaggccagtgcttgtttaactgccagagaaaaagaaaaaaggatccttgtggcactgagaacagtttattcaagtgcagaggtgcttgtttttacctttgcctggcatgccgttaggtctcctttataatttggtatcttattgaacacaaagagtccattctgtctcacctggggaccaagggcccttatttttaatttatacattcatgattgaaaaatgccaaagtttggaagattggtaaaaataaaagtctaaatgttttctcacccaagtttatggatttctgtattctataaagagtttctggaccgccggttaagaacctatgtccagtagctctctattctgtttggatattggaatctccttataagaagctttaaaaaagatacttatggttaggccctattctgttcaatcatttcagaaatctcctgtggatacaatgaatatatatgtatgtttgtgtgtgtatatatgtatatatatgtatatgtgtatatacatatgtgtgtgtattttttgtaaagttcatcaattgattctactacatacacagccagtgttatttatggctcttgacctatattattaaatatttttaaaactcctatatcagaacagtttattaagagcatttcatatgtttcaggcactgtgctaagggctttatgtatctgtgaagcagagattttttttcccattttaacatatgatgaaactgacatttagagatattgcattgactgtcttgggtaacacagctagtgagtgaaagcactaggccaggaaggctttccattacaccttgaagaaatatttcatttggccctaagtagcctgagaaattaagaatatgtgttattccaactctcttaagtgggcaatcttaaatataaattttcaaaaaagaaaacaaatgatctgacaaggaaagaagatatgttatcagccaagcattgttttgctgttaatcccagctaaggatattttatgcccagctcttaatgctttgcaaggatgtagctgtctattgaaaatagtgtcagtgggactccatttggacttggatttgagctgttacctggcctcatctgaaattctgtattccaaaatggcggaatcagggaactgagtcaaatttaggtgtcctgcaagcgaggaggatgcttattgcttacttgatgggcgtacgttagtccagagcccttgtacagtcttcttgccatctccacgaagactacctctgcaaaagtaggcttctatttctttgaagtttttataattaagtttcacttattagaaatagggggatttttgtcactcagacaactcgtttaaaaaaataaaattttgtaacaggtgaaactatatctgttgtcaggccagcaatggctagtgcaagataattacttttgttacttatcaaagaacgtcgagagcatgaacatcaccttagttcttttgccttgtaccccaaagaggatattcacaaagagaaatgtaagtctctgtactgaagggacttctcctttgttccctctgaaattttttgagcttgtcaagtccttgtttctgttgatttctacacagtcccatgctgatttattttaaataaattaggaaactgctgaagcaactattgaagggaagactagtgtatccccaggaaaccgttcagtttttttgtgctagagcttacgtagtgattttctgatattcatgaattctagagtcaatatatacttacatcccatcctcctttctttgccaaaattcgggacaaattttaactcagattatctagtgacattattttgtggacatttaaaaatattcttctaatttacaaaaaaagagaatatatcataatagtagtggaaatttaaaatatgagtggttaagagtaaaaacatccatgcccacttatcctaacaaaattctgtttttctagagttgtagtctaggagctaaaggcagagggcttagagtcagaacagatttgaatctcaacatctcctctgacttgctttttatgacactctcagcctcaattcctcatctgtgtgaccctcagagatagtttaaacattttgaaagattacatataacattttgacacacggtaattattcactaccataaattagattgcatagaatatttatgcatttggtttttatccctacttttaaaataatatttttgtatgttgtgaaagggagatttggcaagtcaaaggtaacagcatgtgtatagcttttaaagtatattgcccaattgattttcaaaacttggtgaactagtggttttatacaaaatacttcatttcagaaatagttaccaatttaaaaattaaacactaactcactaaatatgtttttcagtgattccttcaatttgagttcattatatgtcctatatcatgtaagtttttggactccttgtttaatgttttatttattatactcccctgctttaatatcattcattcattttacttcacagcttctcattaaaacacttaaatagtgagttcttttcttggtatcagcatagaagcaaagaaaaaaataaaatatatttaatttcacaaaacaagggtagcaaaaaatgaatcagaatatgtaatatggctcacagttctgtgattagtttacggctccatgtagccaagtattttcttgacataggacattcgtagttctttaaaataaaatgttagtgcatcctagatggaaatggagactggatttaacctcccaatggaaacaacaacaaaaatcttagaatatacatgaaacaacagcttttaagacctggaacatcaggcaataaaggagagtggtcactgagagatagaaaacaaaggacttgccccaggccctgagttgaggaggctagaattcacaagataaagtacagaaagcagagagctacataaagagaattccagagacctgcaggtgttctcttgagtatgcagcactgagtacagatcagctcatgcatgtgagtaaacaaagagactggaaaaaaggaggaatgacatggactactccttggttcttacatatatctgggaatagtgactgttcttgccagccaaactggaaaactctatgaccacaagcattgaatagaatataaataagactcttaattaagtattgggaaataattagccccaggctgagcactgctttggtcatgcccagcaaatgttaaaggtgagatctgaaaggatcaacgtgtttccatataacttaactgcaacccagatcaaagctgaagaatatttataggaatacaaaaatacctagcaccaaaaaaggtaggattcacaatatccagcattcaataaaaaattacctgttatgtaaataagtagaaaaacataagccattataggaggaaaatttatagattaaaaccatcctagaagtgacaagattagcattagcagacaagtacaataaagctgttataattatattccttatgttcaaaaagctaagacatggaagatagataaaagagctaaataaaacttccagaaattaaaactacaatgaataagatgaaaggtaactggaagctatgaacagcactttaggcattgcataagaaatgattagtaaccttaaaaatataacaataaaagctatccaaaatgaaacgcacacacacacgcaaacagagaaagagagagaagtaaacataccatcagggagctggtgacaataagtggcctaatatatgtgtaattagagtccctgaaggaagttgtggaaatacagaaaaaaatttcaagaaataatagtgcaaagcttccagttttgcctaaaactacaaacctcccaaaacacccctccccaaaaaaacccccaagaaacttcatcaactccaagcataagaaacattaagaaaactataccaggcagtaatgtaatcagattaatcaaaccagtgataaagagaaaaatcttaaaagcagccagagaataaagacatgttctgtacagaaaaacacatgtaacagttactagtgtgattaattgtcagaaacaatctaagctatgagacagaggggcaacatcttaaaagtactgaaagaaaaggacgaatattaacctagatttcaaaatccagccacataccttttaaaaatataagtgaaataaataatttttcaagcacaataaaaggaggtctacactgcgtaatgttaaactgttttaggcagatggaatatgatgccaggtcaaactgtggttctacacaatggaataaagaccaccagaattgtaactacatgggtaaatatatgatgttttcccattaattaactcattttagaagaaaataggttgtttaaacaaaaaataagataatatgggggttatagcatacataaagctaaatgtacaactatagtacgaaagttgggaggaaagagatggaagtatactgctctagggttctaacaccttttgtaaatttttctattacttggaggtaggcttttataattcaaagatgctctaagagtaccttaaagatactctaaaacaatcactaaaataaagcctcaaagagttatagccaaaaaaccaacaatcaatatataatggaataataaaaagtacttaatccaaaagaaagaagaagaaagaggagtaaaaaagagatgagacaaatagaatccatatagtatatagatgataagagttaaacctaaccattaaataatctcatgaaaaatgtaaatggtctaagcaccgcaattaaagggcagagattttcacattggatttttttttttttttttgagagggagttttgcttttgttgcccagactggagtgcaatggtgtgatattggctcaccacaacttttgcctcccggttcaaggcctcagcctcccgagtagttgggattacaggcatgcgtcaccatgcctggctaattttgtagttttagtatagacagggtttctccatgttggtcaggctggtctcgaactcccgacctcaggtgatccccccgcctcggcctcccaaagtgctgggattacaggcgtgagccaccgcgcccggccgaaaatagacttctaaataacccttggatcaaagaaaaaatcataaagaaattagaaagtaccttgaactgaatggaaatgaaaatacagaatgtcaatatttgtggtgtgccataaaacattattcatggggaaatttatagtaccaaatgcatgtatcaaaatgaaaaaaagtctcaagttaatgacctacatttttacctttaaaaactaaaaaaagagcagattgaacccaaagtaaataaaataaatgatataataaagatcagagtggaaaagaaatgaaattggaaaaagaaaaaaaatagagaacatcaatgaaggtaaagctggttccttgcggagacgaaaaaaattgaccaaactttagccagactgatcaggaaacaaaaagaagaaacacagattaccaatatagaaaaggagagagataacatcactgcagattctacagatattaaaaggaaaatgacatcatattatgaacaacattatgtaaatgaattaatcaacttaagtgaactggacaatttccttgaaggacacaaactataaaagcttattcaagagacaatagataacattagagaaaataaaacttcaggcccagattgcttcacaagtagattcgctaaactacttagaaaagaatagtgccagttctatacatacctttcagaaatgtaaaatagagggaatacttctcaacacattctatggggccaacaccctgataccacaattagagaaagagtacaaggaactccagataggaactccagatagggttaatatttgaaagtagcatagttcatatgttataaactaaatagtgataatcacacaaaatatattatctcaataaacccaatagaaaaaaaaatttgaagaaattaaaaatctatttctagttaaaatgggaaaaatctcagcaaattaatagtaggaaaattccttaacttgatgaagggtatgtacaacaaagcctacaactaatatcatactaaatagtgaaagactgtatgctttcctcctaagtgaaataaggatatctgctttcaccaacttccattccacattatgctagagattctgccctgtccaattagaagaaaaaaataaaagactgcaaaggaagaagtaaaactgtctttatatacaatttgattatctgtgtagaaaatccatggaatataccaaagaaacaaccaaccaaaaaaatcacttaatttacaggaacagtcagatagcccacaggctgttgtttttagattgtattttttttttaattacagtaaaacaccttctcttcattactgagacttttgccattcccttaatttttgcagctgagataaatacctaacttgcctatcctagatttggccctgtcagaatactttaggtaatcagtgagtttgacaaggttgaaggatataagattggcttgtaaaaattaattgtatttttatatgcaagcaataaacaactggaaattaaaataaatatatcatttacagtagcagcaaatcatgaaatacagataaatctgacaaaagatgtgaaagataagaacactgaaaacaacaatccatttctgagagaaattaaagacaacctaataaatggaagaatatactgtattcatagatcagaggagccactattgttaagatgccaagtcttcccatttttatctatggataaagtgcaatcccaatcaaaatattagcaaaccttttttgtggagtttgacaagctgatcttgaaattcatatggaagtgcaaaggacttacaaaacaattgataaagaacaaagttggaagtctaaaactttctgataccgagctatgttaaaattacagtaatgagatagtctggtgttggcataaagataggcaaatagattaatgtggcagaatagtaagtcctacaaacaacccacaaattatttatatgaacaactgatttttgacaaagatgcaaaaaggcaattcagtggacaaaatatagtctttcagcaaatatgctggaaaaattgggtgttcttatgcaacaagaaagtaagccttgattcagatctcacatgatatatagaagttaacttaaaatactcatagacctaaatgagaaacctaaaactataaaactttttgaagaaaacttttgacctttgttaggtaaatatttgtcagatacctaccaaaattactgcctttgaaagagagaaaaaggatatatgtgatttgatacaaattaaaaacatttcctcttcaaactcgtttataaagaaatatgaaaatacagatgacagactgaaagaaaatagttgcaaatcatatatctgatacagtactttggtgggtttattttagaaatttaaacatatacccatcatatgacccagatattttacttttagatatctacccaagagaaaacaaaacatatatctatacaaagacttgtacgggaatgttcatagaagttttatttgtaacaacaacaacaacaaaaaacctgggactaactcatattttcatcaacaactgaaaagataaacaaattgtggtatattcatactatgaaatatcacttagcaataaaaagaatgaactattatacacacaacaaaatggattaatctcaaaataattatttcaagtgaaggaatccagattcaaaaaaaaaaacacctcacaaaagtacatatattattatgtcatcctaaaactagaaaatgtgaactgatctgtagtgacacaaagtaaatcaatggttgtcttatggacagaggggttatgagtgggagagaggagttataaagagtcacatggaaactttttggcaaaatagatatgttcattatcttgattgtgataatggtcttaaagtattacatatgtcaaaatttataaaattgtatactttaagtatgtataatttattgtatactttaataaattattattttattctttatataacatatatagaagtatacttccataaatctgtttaaaaaattggtttaacttaaaattattatagcccttttcctggaatgcatcttgggaattacttttaggttgagttgaatcgctaacacccggctacctagctcttcagtccctacccaactcttcaagttaccagtcaattaacaccctctagcattttgatcattctcactttgatactgagtcatgggaattaacatgaagttaaaaatgaccttagatagtattaagaaatgaaagaaatattggttggattgttaagctttggctttgctgaagattaaaatgctggtggttcatgtcattcagtaaaagaagaatcttgagaaaatccatcaaaccttttaaaagagtcattttacaagcattactggctacaacatactctttctcaaataccccttcattttgtaatttgtcaggctgcctttggggtgagaatattgtctttccacattggaagtatagcatctaacacactgaaccatgtgaaagagaccctggggatggcaatgatgcagtgaatgtggagtctttcatggtataaactagctcatgagagaggcaatggaaacaatttataaattgcttatgtttgtcacatacccagttcatgtcaaaaaatgaaaataaaattcatattcaaagagctgaaaagctttgttcagtaggctcgcttacataatatcaatttagtaatatttcataacaattcgtgttgcgatctcaactccaatgtaatcttacttagtatcaatttggtactatttcataacaatcagtgttgagaactcaactctaatgcaatcttctcttaaagggctggggaaagaaggagaaagaaaggataatgtgaaaactgtaacaattgttttcctcctacttatcccctcaagcctttaaaatgtgcaaagggcccatttaatctgctaatttgtaagcaattttagaaaaatgcacaactgttttatgagaggcttaaatgtaggaggcaatataaagtttttatttagcagaatatgctacaagtatatgtgtttcattagctctgttacaaactattcatttcattttactcttttttgggcttattgataactatatattttttttctcccccagcttccttttttgccagtagctagtttattcttttacattgtaccctacagggaatactctttagatatttatttttcacaaagaactaatttcacattttccccctgaggtcttctaagatatttacttgaaagcatcctctttattgtttaaaatagcttataaaaaacaatacttaacacattattttttaagggtttatatactgtattttaatgactgcttttcttttttaattgttatttttgattagataattgattcagtttaaactatatctgtgatccacaaatatgatccaattaattgtaaatcaattaaaaagagactgttcatgagagacacaggactactagcttaatcaccaggcaaaccagacatccttaaaataagacaaatgaagtatactttgatataacagttaaatgtgtataatgaattctttaatttactgaaaattttactatgtgggatatgtcttcattttaataaccaaaatttataaaagtacaaattagaatgagggccattttggtaagaatatatactaatacaggtaactagtagttatccattttaataggaggcagggaagaatcagtcaatgaaatttgttggtaaagatgtaaccatatttctaccagtttcttcaacctttctaccagtgtatttcataaccatgttagagagaaaaggtacaattttttaaaaaggagcaaggaagaagaaaaaaagagatatactttggcaatgagccttttccccaaaacaaactgattcttaaggaaagtagaagaaacaagaattgacaaaggggttttacaaattgaaaacataacagtttcttagttttgtatagccatttataggatacagatgtgtatttctctgaatcgatttcacaataacctcacaaaaaagatatgaatatcatcctgattgcatgataagactgatatctggatgaaggtaaggactttcctatggatagtttttaaatagtaagtgatagaatttcaaattgaacacagaacatctgaccacacagtccccactgttctgctaagaaactgtattttcttaaataaaactatgcatatatacttacgcacaataaaaagattgttttttaaagccaaacatcagattatttagaattatctatgaatgatttacttttccttttcacctggattttcatttcctttggtggaggtgctaatgagcagagaaatgggaaaggtaatcagccagagggaagagaagaatcaaagacctagataattcacaaactggaaaatgagctcctaactaatcaagactggattgtaaataggatagaaagaatttatgcatccctggtattagcctgaatagcatttgtacccaatccaaggaaagtatttgtgaatttcacagttggctattttttctccctctgagattcttttcctgaactaattatccattgtgtacatgaagcaaagaaataacttatcattaaagtcatttttgaggtagatatttcactttgcatttgttaaaatgcctagagcattaataaggaatgagttaactttattaatacatcttctttggggagtttctgatctatatactgatcagccaaaaggaaattttctgtaatattttagtcatgcaaaatttagggaagtaaccagattgactaatctttccataataaataatttaatttaactttgtgctgctttttgcattttaattttttcataatgtgtcctttaaaaccttcaatattaaaatgatcagtgactgttttgtgcctgatttagtttaaattgtaaatttagttatggctcttgggttacaaagtatgggtggggagatgtcttaatataggaaatgaacacaattaaaggctggaatggctacgtgtacaataagtttttaaatgaattactggaaactgtgtagcaatcaatatgagaaatgacatataacaccatataacagtaattattattgttacctcgactataattattcctcaaatgctttacatttcatatattttcatacatactattcaactgcagagttgtatgaaatgttttatgactcacagttgttgcctaatctctgcttaaaaccttccaaggcctttccaattcaaactcagactgctaggataatagataccatatggttagcttatgactttgaaattcaggcaggacttctgcttctagtaaggatgtagaaagctataagagattattactcctaccctaataaccataacaaaagatataagccacaaaattagacttttaaaaaacttacctaaaatctgaaaatgcaaataaacttaaatgaactaaatttcagaaagtgacaaggagagcagaaactcatgactgctttgctccctggagaaatggtgaaaggaagatgtcactgtagagacaccagttaaaattgtaaagaacttttaatgaatgtttttagagttgtgtgatgtgtgagaaccccaagaagcccaggcacggaccatctctgcactcatcaaccaaccgtctcatgggacttcactgaattgtcaaccaaatgtaaagccaaggcagccaagctgagagatatcccccctaaggcaagcagggcctcctccagttaaaagaggtctgctgaaggctaaggcagggaaaaagccttgagagaaatccccccagtgcattctaggccttcactagttgtactgcagtggctctttggaagactagaggaagggaagatcagtagaaagatatcctgaagcacaaaaaaccatggtgaaactagagagcagagagaactcccgagcaacctaaaaacctaggagctggcctgtaaagcagcaagagatatcccttggttcagaaagttggttactggattaacaataagtaaagagattctagagtctttctgggactcaagtcccaagtcctgctgaagagaaggttctgctctcgacacatttgaaggcaatgaagaaccgaatctaactaaagcagcggcacaacccagactctgcttaactgtagacttaatccactcagtctcctaattagcagcctaataagagaagtggtgtgcccttttctggggatgactattatttctgtaaatttctactgctcttttacagaaaccatctggcactcaataaaaaattataagacatgagggaaaaaaagtgtggcccaagatcaacagaatattcttgagagtggtccatagaagcagacccacacatagaattggaattatcagatagagacgtaaaataaccatgataaatgtggaaaaaaaaaatctagtgggagaggtggaaaaacagtcatgaaaagatgtggaattttattagagagttgtaaaataaatattttaacagatccaaagagaaataaaagaagtgaagaatacattatgagaaatgaagaattcattgaccaggcttaagggagactagacaagatggaggaaggaatcagtgaagttgaagacatagtaaattagcataggcactatggaaagcagtatgggtgtgggagagggctctaaaaaagctaaaaatagaactaccgtatgacccagcagtcctgctgctgggaatatatccaaaagaaatcactatatcaaagagatatctgcaccctcatgttttttgcagcactattcacaatagccaatatatggattcaacctaagtgtccatcaatggatgaatggactaaaaaaagtggtatagatacacaatggaatatttttcagccgtagaaagaatgaaattctatcatttgcaacaacatagatggaaccggagaacattgtgtcaagtgaaataagctaggcacagaaagacaaacatttcatgttctcacttacatatgagagataaaaaactgatctcatggagatagagtgtagaatggcgattaccagaggctgggaagtgtagtgggaggggaaggggaagggtaaagagagattggttaatggttacaaaaatatagttagatagaaggaataagaactagtgttcagtaatataatagggctaatatagttaacaataattaattgcatatttcaaaataactgaggagtggaattggaatgtttctaatacaaagaaatgataaatgtttgaggtgatggatatcctaattaccctgatttgatcattacacattgtatgcttgtatcaaaatatcataggtactccataaaaatgtacaattattatataaccataaaaattattgaaagaaattccccaaactgacaaatcaaagagaaaaaatatgccacagtgtccaatacctgtggaacaatatcagaagttctaacattcatataattgaatgttataaagagataagatagagattggagcagaaatcatcaactcgcttggtaccatctcccagtggccttccttggccatcattttaaaagcaggcccctatgccagactccagtcattctcaatcacattgctaggttttagtgcctcaataatattcatttctgtataaattgttcattttttttctttttattctaccaatatttattgaatgtatgctaaatgccagacattattttagaacctagtattgaacaagacagatggagtctgttttctcacaaaacattttttctctatgtgtaagaatcttttttctttgttttctcatttacccctgaatctgtacctccttgaagaatggctggtgcataaggggagcgcaataaatatttcttaagaaaaaataaattaattaattgtcctgcaggtcaattctaaaaccctattttttaatttcctcctccaggattgtctggaaaaaactgctaagcctgttctgctatctgttattttttttttccttctgaactcaggctccacttctactaaattctcagtaggattggttcacatataggcaatgtttacaaattgatatagatagatataaaaagtatatagatgtaaaattgtatttcagtaagaggaatcagatgttggggaaggataatcatacttctattaatgcatgaatccatgcatcttgtaattatgtgcatataagactctgcttactaaccagacagcagtctcgcagtgttcctagggccaagccccatgcttagcacagttcaactgcttctcttttatgtgcatcatagtattttattaaaattcacgtgaaagaggacatttttttttttcccaagactgagtttcactctgctgcccaggctggagtgcagtgacgcgatttcagctcactgccacctccacctcctgggttcaagcatgctaaataatctataaaaatcagtcttataaataaaggacatatgccataaaatgtttctgtttttttaaaggcaactgtcaaaatactttttagaaattattcttctcatttagaatccatgtcccgtaggccttgttaggcggaatctgagaaaccaatgagcaaatctgtcagtctttcagtgactggattactaagtatatttcaagtcacacactagaattctccaagggtacgacttcattctcatagttgtaactaaggaactactacacatctcctgcgattttctgatttatgttcagatttactcccagccatcactggaacaggacagtcttaatgatagtaggaaaaatgtgagttgccattatttagcattctcaataaacgtaactgaattattaatcatagagacactgaatgccagagaaactttgaataattaattatcaagcattatatgacttagtctgtttgtttaccaagggaaaaactaagggttaaagagattggttccaaacttgtgcaaactagtgttcagtttgtccacatttattaagcatatcatacttcttttcttaaatatgattttgattattgattacccccccttctccacaaccctcttctccacatccctattcctcttaaatccagagaaaacacaagagtatagcattaaatttcagatgcacatcttttagaattatgtgttgccaatattgattagtcagggtatcataattaatgatgactaaattcgttagtagaagctacttgtttttgtgccagttactagactgagtagtagacatactttatcactaattctcagcacaattttagacaggaggtatcattatccttactttacaaatgtggaaactaatcataaaaaataagaagtatcttactcaagataaaaagactagaaagtggcaaacccaggaattgaacctcagagttttcaatctctcctatatacacaacggttaaatgtaccatatacctaatcatatttcctgacctccaaaaaaagaataaagagaaaataagatacttctttctgtttatgattaaggcagatgaatgtatgctgaagttatttcttaagtaaaaatttatttacagatacactattgatttaaatttaagaagcataccacttttttaggtaaaatagaaaatcaaattttgcaaaataaaacaacttagaaagcataccaatatttctactcctacatatggtacaattatattatcctatttagtaaaacaaatgataattcttcattaactcagatttaccaagatgtatatcaggttaccctggttaatagtttgagatgaatgtttaacattatctctgtatgattattaagactacataataatttgtgttgtaatttataatactccccaaatacaaattcatgtctaatgttcatttctaaaaatgcccacactattttactacttaagctcttaaattttcctgaactgatattttgattttatttgaatccttataaaactttttaaatgatttaaaaaatttaataccctatttacctaataatctattaacaaaaagcccactttctcaggctaaattaacactacagtttaatcataatcatattcacattttgaaatctttcttactgtcactcacatgagcaaacataaaaacacctacacatgctcaaaaaaaaaagaaaacttaaggacttgctgaattttggacaacatgttcattttcaatttatctgaatcacttgtgtctgtaagagatgttatgaagtttaatttttaaaaatctgaagtagattttgttgttgttattttgcttttagtggttgttgtttcttggctggctgattgaatttcttagtcttagctgcctactagcataggatctcccggttacttctaaataatgagctcaaactctgaaacttccaggaacaaaacctactgctttcctgcctctattgcttccatcttactaatttgtcctatagtatctgattcattgtattcatttacataagtactcactgggcactaaatttttaaaaaattctttttcatgttcagaatttgaagaactgcctttctttccaaaaatagatttaaaaaactgacttatgtattaggaaatctgtaatttgtgggattgttgatgttatgggggaaaatcatggagcacattaaaataaatggttaaatactgtaccatgatcttgaagaactagagcctttcatggctgtgtcaccaactatatgaacttgggcaagtcatagctcatctataaacaaagaggttgggcaaggtcactctcctagagatactacacttctgacaatgatttgattaaatggacctctcactgaggctcagaaatcactttcgtaatgtataacttttattgtattgttacagtgtgtattgaatagtagaagaaaaagcttttatattttaactgaaccataaatacttagccattttttaggcatctttgaattgcacataagagaaaccagtgggatctcatgcttggaaaatatatgagatcattccagaggtgaatacatactattttctattccctactccattttagtcatatgtaatgaaatggtttgatgggagcaacatagaaaattactgagaatttttatattctgaggttctttgactgttggctgagtgggcaaaggggcaggattaatatctatttctggaaaaaatgtttgagacggaggtgcattttcagggagagatttttttttttttcttgcttcattgggcaagaaagctttatcttgttctgtgaggttaactatgggaacagaccactgctgggagctggggaacacaagaccgaaagaggaagggagagaatgctctgttagtttcctggctagacaggtcacattgcacttggggcatgaagattagggtaagagttttaaatcacctgtgaaattattttggtacctagtatagagtgaaggattggggttatgttttcttagtaatttcctacaacagacacacaggagttttatattatcgcctgtatgtgctgaaggtatagatctttaggtaaacacaaatgtcagtcatttggccaggcagaaataagagtaggtttatgttggctcttgagataacaatcagaaaaaaaaaagtgaaggtcatttttgtctgatctttaagacttccaatatcagaaaacttaccttttgatggatagtaccaacaaatatttaacttcataaacagataattaatctcaaaaacaaacaataaaagataaatctttggatatatagccctccttttgggtcatagtatcccgaggtagtagttgtagatatgaattttcttaaaggacttatttgaagattaactaagaaatactataggttcataacaacttaattcacatattatatactgcataaaaataaagtccttcttctaccaactctgaatcttaaatctcttatgccatagaaatttgcagagacatcagataaaatgaaattctagtttggcctaaaaagttaaagacattataaaaatcatgcatcattgcttaaggttaatattctctaatcagttaccacccaacaagaattaactctcctcttttctagagcacctcccttttgactctgctctttgaaacatatcctcttaacatctcttgataacctaaatttttttctagatcctagtatctacctctttgcctttactaaaatatctattaaccctgaaaaagaggagtattccttaaaaatctctcaaatagaagtcactagtttccattgtctctgcctacccttcatcccaccccactatagagccactcctctatttttaagccaatagttgcatccagtactcttcctgcttcgcagtgccatttggagagaggttgagtcagcattctatgtcaccaaaccatattctattagactaagccacactctttctatccttcagcctcatgggtccttgctctgcatttctttctcttcttcctccttacccccaaatattcatgagacctttggtatattacttttaatctttgtctgctgtcagcatttatggtctttgctaccacgtatcatcctctagttacttttgccatcatgtcactgactttcttccatagacagctcctgcccttcttttcccaaagaattttgccacctctgcagttttgaaagctgtgttcctgtcatctgaaccgaagtccttatctctatatctcccaccacgtgtacttttaacaatttcatgacctcttgcctcgtacctcctttctgctctaattctaagccaatttctgattctgctaccctccttttccagcctatatttaatgaacactaatgtcaactaatgcctttcttttaattttgaaaaaatgaaaaataatgaaattattttcatagaataataatgtaataacacctttgcatagaaccactcagaactgacaaatgttgttttttttttttaatgtttgctttactttcttctttgattatagttttaaagagttaagatgcagactttttttttggtaaactgaagctgaaatgtataatatgtatgaaattgtacagctaaaatgcaaacaagtgaaatttctgaaaaaggcattaatgaaaagaatgctgtcagggttcaaatgtgaacttgtttacaatcctatgcaggggaattgaccagagttgggggatttaggtgaagccatagcatgattggacaaagtctgtttgcaaaatgtcagatgtacttttctggctattgaagttcaactatagatgtaggatcccaaccatatatgaatcattatagatgccttcgtagacatctgtttctataaaagaccttttctaaatttccctctggagtaatgaagtgctgggtcagtaaaggagactaacattttgaaaagttatagtcataacaggaaagccgaaatctctaagtttcccttctttcttcatttttacagttttagtaacaatattcttggttaatatttaataggataataattgtttggtctactttgatggtttttgcctttataatgttatgctgaaatatctcgatttgcttaattgttttctaccgaaagattctaaataggcaaatcattggagatcactttcataatctgttatattatattgttgtaagagggagacctatggcagatattttttatttgtttttctttagttgaaatgtggtaacatctatttatactgctgattttcttataggcttaaaaaatagtattgatgcagaagcacacatatttatcatctggagatttcaaattaattaatcctttctaaaaaaagtttatcagtattttataatgcgataccctaagcatagtcatcatataccctaggttttctagggcagagtctgtgaaatttatatgaaattgatgtgatattattgttataacttcatatatttttaacacaaaaaaattttcagatctgaaaaactgaattgattaagtctgtgcttaactaattcagaacatactaaaataaaggtaatgtgagaagctgacaatggtcagtttaagaacttttaattgcttgggtttatatgttgtggaaaactctgagaaaaaattaaccttcaataagacagcattcagaaaaggatttttttcagttcactgtgggcagaagaatccaaaatataatatttaaagggttcatactagctcagatgctagtatcggtttctggagaaacatcgatcttacgaaggtgacaaaaggtatcctataagaattagtgagcccaaactatataatgagtgttatagagaaattcactatgaatatttgcataagaaatgataaagacacatagcaactataatcagtgttcattttctccttactgtgattctggtgacattctttaacctatgggagtaaaggatgcttctttcatattctagcaggtcttgttttcacactgtgcttctgtgtcttgcctgaacagtgtgtctatgtttcctttcccagtagtattctgaccaccactctcagttgtcttttctattcaggaggtgaaagagaaatttctaccctgtttccatcctgcagcattatggttatttctgcataaactatcctatcaaaagttctagagcctcaccatgtaaccacgaaacacccattactataggtgtaatgggttttcacatatcctttccacatatcctttgatctgaagaatattaagagctttcaagataatcatttttattaaacttatgaacagcttttaatgtagtttgtttaattgtctggctttagatgttattggaattgtctcttgttatcattagtagataaaaataaataccattatatactaagaaagttctacataaaaagacaaacagatgtgtcatagtgtcggtgtgttaaagaggtgcaaatctgagaatcaggaggactaggtctatttttggctgcatatttggttttatagtgggtttattggaaagattttgcactcacaggctagtggaaagatgaatgacaatattaatttcttattttgtaatcagtgtcagagaagcttttcagtgcaaaatgtccaaagagagaagaggactagaaagtaaagggtacattaagctggaacctgaagtgacagtgctgtgttacattgcagagattctgcagtatgtcagggggttggtgattcaattgtctgaatgcatgatttggtgggccagtttagacgagagcaaactggtcctgtcactgaaatcacaatgggtaaaaatggacctattcaatctgcctctcaatgccccaaattcttcctggttgtaaattagagctttaggacaatgcattaactcattcgggtcaccagggtactatgtcagctcagtgctcacaattgcccatgaccaattctgcactctccccagcaggagggaagcaatgtcattttgtactctcttctttaggataatatcaggtctgaaagggaaggaacaaaggaagttgctgctttccttccacctaccccacttagccataatcacacccctctttccacttggccagactatgaaccagacagaaaatgagcttagaggttgtgtggttactcaaagacttgaataaaatcaagaattcagtgctgttcagctccatcttcaagtcaaagaaaatgggcatatgggcagcataggagagctggagcattttctacctcatccctagtaaaatcattacaatatgatttctcttgctaggaccaacatttttatgtggctactgtctgcttccatgacagcatttcactccattccctgctcagtcattaacatccagcaatactggctttttctgtgtgtttaaacatgcctagttctcggtgcatgtggaccttgatgtatgatattccccttacttgaattgagtcattgttcacccaaaacagattccagctcatctgtgaaatttccattttcatgtcacttctacatggagacattgcctgaaagggtgaactgtattacaggccacttatttatttactcattcatttattttggatagcatcttgtttgtagcacttaccacattttgtaatgtataccattgtgttaatgttccttgaatgtttctcttctccactggatcacaagcttgaagtatgcaagtgtcatatatgttttcttgaatactgtattctcagaatctagtccaattcctggtccatagtaggtgctcagggaatgaactcccagaatccaccaccctgtcatgtgctcagggtccttgttgtgacctgtacaatgtgaagtaatactagtgacccagtagcccgtggaggtaggaaatgagacatctgaaatccagaccagaaaaatacattctaaaaaaggttactctactttacctctcctttgtttggtacattcttggtcttctcctaggtcagtctactacaatctctagttagcagcaaacatgttatcagagtaagtctgtaaatgtgaccttagctttctaattcaaagtcatttgtcctctgaaggcttctccagtcatttccatggtcccttgttaaagactaaacaattaaattgtgcaagctgtcttccctttaattgtaaaactctcgctaataagtgcattattttatttgaaatgcacattttctaaaacgtaaataattccatattcaaatattgctacctatattaatattttaatataataatgttaaaaatacttcccaaaaccaatgctgataactaaaagattgttaggtctttgcttttttaaaaaagttaattcctaatatcactttcaactattggtgagaacaattccatatctcttgctttcctgaggtaaaacacaaggtgtaggaataaacaacaatttcaggggtattgtaatacagaactccaatccccactgcccctattctgtatttctgtgctcccatcctcaggggctagcgctttatatgcctgactatttcactcgtaccatttcagaaactcacctctgccagaaaatccccccatatcagtttttggaaacattcttcctaatgctcttgccatggagtctttgaagctgagaattttccaccagagataatagtctttaagatgctcagagtgttgctttactctttgaatggtgtgtttccacctccctgaggagttgcagtaatatccccctgacatggagacagggtgcctgtgtctcaccttgggccacagtactgatccatattgataagcagctgtgtcccaaactaaagcacatacaatacattcttccaacaaatatttattgtcacctgttatgggataggcactcttgtattctctggattaggcaataaataaaaactgaccaaaaacccatccttacgtttctcaaacacccaaagtttctaggcaatcacttttgttgttgttgttgttgttttgttttgttttttgctcagaaattttaagcttgataacctcacgagtcttagtgtgaggccccaaaacttttcacgtttctcttgggaaatctaatggtttttcatgcaaatagttaatctctggaagtaagatccttggtgatttgatacaatacatgaagatttaacatttcttgaccacttgtgtgccagacatactgccaagagcttaactaaaattaactcttaaggttgttgtgagagttaaaagagttaatatttgccagacccttagcactaatattgcatccattttatagctaggaaacttggagaaattaaggggctttaccaagtacacatggcaagttagtgaagatactaagataatatataggccgtaagacatcagagtctgtgctaaatactgaagagagaaatgaataaagtgaacaaggaacaaacccctgctgtcacagtgctcacaatctcaagggggaaggcagcaactaaatagtttcagaaaactatgtgcagatgagaaacacacaatgtcacatagtagttcagagtattaattacctaactctaccacaagagcaagttgattaggaccttccagagaaagtgactcttgattggcatcttgaagaatgactagaagttcagcgtgtgggcagagaaggcactggcattaccagcagagtgatgcagtacctttgaagtttgagaaaatatttcacaaccgggaactacaaatggctctgtactgcctgagtgctgaatacagatgggagaatagcagacatgatggttggaaagagatccctagaccgcaggagcccagttacgaaaggccgtttatgcttgcctaggagtttcagctttaccctggagaggtggagaactagtgagagattttatgcagagaaattatatgatcctgcttgcattttggaaagatccttgagtggctctgcagaaacttgatggaagggaaagcaaggatagagacaacaaaaccagttagccaaggaaaaaataagagttcagaaatgaacatggcaaggtaaaaaaatctacaagttttcacattaaacacagactctttcatcttcaaccccagaaaattacgaagtgttctccatgtcttcaatttgctgctcagatccactcgcctcccttcgacgcagtatctgcatctggaagacggacctacttcagttggccaccttgccctctaggttccagctggactcagtcaggacagatcagagagactgaggagggggaggcctcctgcagggtcactgtgaagtacctgtggatgccactgaaatctcagctcatgtctggtggccctttttgccaggctctggtcttaagatggtcctgggtccttactgccactcccagtgtcctctactgtcccttgtggttttcctgcacaaggctatatctttgtaagtggttacataacatttattcattttatccacaattgactgtcctttctatttcctgctaggattctgaagactatgcgagaataaaggaaaataggcattgtcagaatctgttagtaggattataaatttgtacattctttctacagaacaatttgaacatagcaataaaatttttgaatacatgcactctttgacctagaaatttctcaattaaaatttcactcagtggataaaattgccaacataggtataaacccatgtttactgtggtattttttaatgtagtccaagttgcagaactgtatgcttaatattatctttttggtataaaaaatatatttttataaagatacacaacattaatagtgttcacatatgtggaaaaggcctggaggcagagggtggggttataggtagattttgtctcatcgtattcaattcttctaaactgtttcaattaacttttaacaaaaattgtttttaattttcaaagatgtcattaaaattggaatatcggtgcctattttacagcgttgttgtgaataacaaaaatcataatgtattataatagtgattacgtaccaggtctagaggacctggtaataagtggggataaccggaactacagcagactaatggaagtggaagaggtgatgagtttttgagtggtataggagttggaattaccagagatggtgattattcaagtagcaagagtagggcatatattgcatatgaagaagaaagtattatacagtgattttcagttatcacttaagcaactgtatgttggatggctccattcactaaaggtaaaatgcaccaggaggtagagatttgggaagggagatgaagaatttggttttgcataatggagtttctggtgcctgtgggatatccattgggttgtctaggaagcacttagataagaaaaagtcaaatgatctcatggcaagtaggccctctctaccctgaaacatcattgtctgggagtaagaattcaaaatcagttagaggttataagagccttttcttagaatccctgctgccaccttggatttcttttccttttttcagtatacttatttttcctttttcagtctttagggtaagtgtcattgcttctaggctttggctgaaacctgtgtccattaatgcaatttagtctactctggcaaactaagatataccaacacattttggtaactaacaatgcaattcaacttgtttcttggttcttgcttgttctgtaatacagtgtatttttgcactgagaaggttttcattatgttctactgttgtatatttcattgatatatttatgttgataatttttactttttcttgtcatattttctcatgggaaaacgtgtgatacttttaatataagaaatcatcttaggctgggtgcagtgactcacgcctttaatcccagcagtttgggagtctgaggagggtggatcacctgaggtcaggagttcgaaaccagtctgactaacatggtgaaaccccgtctctactaaaatacaaaaattagctgggtgtggtggcaggcacctgtaatcctagttactcgggaggctgacgcaggagaatcacttgaacctgagaggtagaggttgcagtgagccaaggtcgcaccattgcactccagcctgggtgacagagactccatctcaaaaaaaaaaaaaaaatcatcttatatctatctcaattagaactagaggcaattttaatgcaaaacaacaaaagtaagctgtgttttgaagaaagcttgccaaagcaagtagtggaaataaatacattatatgtatttcccacatctctatgtagttattaatactttattaatttaaaacctcaggaacatgtttacatgtaagttatgctaaagcacaaaaaggaagtagatgaaaatttgttaacttatttactaaatccttccacaaaatacttttttaaaataaagggattatagatcagtaatgtcaagatattctgcatagcttgtctttatcaaaataagggatctttttattaaggcaacccagaaagggtggatttatggattgaagggagtatgtttaatatgtctgtatccatctagattgacagttctcacagacatgaatttccccagagagacagtgttactggtgtcagtggatggcatcatttacttcaatgttccattattaaactgataacaagataattcctctgcttcccagagacatgacagggtttacaatggttaacactcttattgtatgggactcaatgttctaggtagtttttaataagaagctcatttgtatttcaatattgaaaaaaattaaagtgaaaacaacatcgtaaaataaattcaaaatcaaatatatcaggcaacacaatatggctatttaaagaatttttgcttactatgtgtagctttgttgaaaagaaatgaacatttccttcaatctttcagctcaattttactaaacagtaaaaagcatatattagagtatgttatttgttgaaattgaaatttacatatttggttgattatttgaatgcaagacatatataataattttagataattacaggggcagaggaagtagctaatattggttgagtgcttttaagttttcactttaaaatacagatataaaagaagcaatggagatagagatagcaatagagacagagatataaatagacaaataaacaaatagaaatgctttaaaaaccaactcaacaattcactaagacaactcttattaacctcatgttacagctgaagagactgagggtcacagaggttacttaacttatccaagacattatgaagcttacccaagatccacagctagtaaatgtgaaagcccatgctcttttactagattatatggcctctcttgtagggtttagggaaatatgttcatttttaaataattaataatgtgccttaattagtaataattttaaaaaggaacatatttctccagctagcaagcaggggaaatagtagtcagacttcactatatctggctccagatctttccagacactcttttgaaaattgaaattgtttaattaatatttgtgtggctatattttatttgagggtaaatgctgacaactaatccttaaggctgcacatgaagcgaaggtctacctaaaagggggttcgatgagcacctctgggttaaggatatctcaggaggatattaattaatcctgccattccagtgatgagtggagcaagacttttgcatttgtttaaaattgtgttgtgtttgcaaagagctttataggtcatggatccctaatgatttccagacagaattcttttctgtttcaccaagaataatgtgaagctttctaccacaggcaatgccaactgctgactaccacagaaatacttcaagagaagtgatatatcagtggcttcaaagtattctaggatccatttctgatggaagcatgtcactgtataccttggaactaaaacagaatagcattttcaaagttaaaaatgagagaagtccaaacatttgatatctaatggataaagaaaatcagagagtaaaacattttctcagtcattgattctggaaggatatagcaccatacacagtcactggatacatttcctttacctatcccaaattatagctccacatgaactattgacaagactataaatttctgtactacattacatgaatgagagattaatttatgtgaatttattccttgttggcaaatggaatgacacagtttgaagtcctttccgagctataaggaattagattgccctttttataaaggattctatattatgacatgttttttccagattcttgacaaaaagcaatttaatatcaaattctgacaaatgagaactgaaacatcaatggttcttaagcattaatattattggatttctcttgctagatatgtcatctccttcatcttttttattgtaagacaggtattattgaatagttaccttatctactaatcaggagtacgactcataaatgtataagacattatatacgagaaaataaaacttataagaaagagaccccaccatcaaaggagtataaacttcttgggaagacaggacaaacacatagaaattaacaattaattttaaaatgatattacttcctaaaagccataccctgtacaagctgcacatgctataggagtaaacatacctgttagtgtaccacaatctttatcacagagaatggatgatgcagcagaaatgtccaaaaaatttatcagtaataaagcatggaaaatgccacattcctcataagtatctcattcaaatatggacaactcaggaagcatagtattttttaataattgtaaatgaaggccaggcatggtggctcacgcctgtagtcccagcactttgggagaccaaggtgagcagatcacttggggtcaggagtttgagaccaacctggccaacatgtgaaaccccacctctacccaaaaatacaaaaactagctgggcacggtggcctgtaatcccagctactcgggaggcagaggcaggaaaatcgcttgagccctggtggcggaggctgcagtgagccgagactgcaccactgcactccagcctgggtgacagtgtgagtctctaataataataatataattgtagatgaagtgttatttcattgaggctggagattgtgaaaaagatcctgattcatttagataggatcaatgactgtgctacaacagttgcttaaattaagaaagtctgaaaactatgtgtgttgatagtaattttcccagcttttcattctaccaatgtcctagagttttgtttgcctttattctggttttgtagagttttgtttgcttttgttctggttttgtttgtttgtttttcccgtaatgaaagttttctccttcttcttttatagctttaggaagggtagcttcataggaagtaaaaacagccatgctacttacacagaaactcatttgataaagaaaatattagctaaaagtgaaataagttaatgagttttttaaaaaaagaatgagatagtctaatgaagattatttgcagttgcctaaaaaaaagatttgctgacaatgttatttaggatgaatagatggaagaagctggccctgccagccaaactaaaagccaaacacaatgccaggcaatattattgcttcagtactgcttactgctaggacgcctagtaagatataggctgtgaccctatttcgcacctagaaagacttaactaagacattttctagctacagcatattcagtgaagaatacaatctcttctacaaataaataagagtccagtaagaaatgaagtgggacagagtaattctatataagaataaacactgttaaggcaagagtgtatttagaaggtgagcttcctacatttatagttaaaaacccaaatgaattttctattctgagccccctctgatgcacatcagaaaaatggcaccatgaaaccactgcttgaccgaaactgtacaagtcctataatacatgaaatgtagccactaattaattttgaattatttttatgagatttcttcaagaccataagatagggataatatcccatattactgagcttcacagcatctactgtatatttgccttaaatagtattttgatacagtgagtccttgaatggaaattgtctactcaaccaaggctgataaccaactgatagactaattgtaataaattataatttgaaaagaaggcattttcctagactagacaaaaatttgccatcaaatgtgtatattggtatgtctccttccaagttgtagaatttttaatatgtgtgtgtgtgttttttgtttttttactgttcttttagtttttttgttttgttttatttctttttgttgagtagttttgtctcataggtggctatttctgagtgaagtcactggggcagttggttgaaggaaaagtgcatatgtacttgtatatattataatctacatataacttctatgtatacatatgtatgtattatttatatataatttggtgtgagtatgttgtgcacttaagaaatgcataaatctctctggcttggctgatagttacctaatgagaaataatactccaagtcatgaaaatatgttgaaaaaaaaagaggataggaaattgcttagcctgatctaggggtataattacgagtagcttgagggagaaattgaaagacaaaaactagcttgtaatcccagcactttgggaggctgaggtgggaggattgtttgagctcgagttcaagaccagcctgggcaacgtggtgaaaccctgtctctacaaaaacaacacaaaaaattaggcaggtgtggtggcatgggcctgtagtgtccgtagtcccagctacttgggaggctgaagtgggaggatcccttgagccagggaggcagaagttgcagtgagccgagatcaagccactgcactccagcctgggtgacagagccagaaccagtccacaaacaaacaaacaaaaaaacaacgaaaaactcttgacagtagctacctctactatattgtgaattcctcctaaatagatagcaaaaatccgcattactcttaaagcatactgatggaaacatttaatgctataatgtagtgaatagttctttagtagggagaagatggattgggtgacacatgaggttgactacatttgtatctccatttttttctatctgtccctcactgagcagagaaaacgcagcatggtctcaagaaagaacatcatggtgccaaaagaagtttccactcagcctttacagtctgcattcattcttttatttagtaaaaatgtaagaggtttttgttttgctttcatactttttgttccaaatatggggccagggaccatttactctttgttcttggtagttgaaaagtgtagcatatgataaaccctttcattgaataggcattcatgatcatggatgtgaaaatgcattagaagaatttatgagacatgtggggacataggctgcatctgagactaaaatcctcatcacaggcttttatggcattctactatgatgactcgtttagggtggtgtgggggaaggacacctttctgttctttcattaaatgatagaccaagtggagttggttgtaaataattcagaaggttctgaaccagaatttgtcttttaaatcaagtgattctagaggctgttcttgctttattctaattaatgaaaacaatcagtgctatagattttataatgctctttgaaaatacatagcaactctcaaaacaggatgcatttaatgacccaaaactgtagtcgtacacttttttcctaaaacttaattgtccatactttcatataataatttctaagacaaaggtatgcttatacatttatattttaaacagacttccaaattgacaaatttttatggtataaaaaatgcataatctgctcttagaggactataaccccataaagttacttcattttgaaaggatacgtttctcctattcgttttgtaagtttcaaagatcatgtgattatgtgtgggagaagggagaaaaaagattgcaaaacaaaccccttattgtagtttcttagaaacagcattgatatcaacatttgggcatttgtgagcaagctggaaagtatgaacaatgagaaaaaggcacatttaagggagtaaatagtttgttttcaagccttcagtgtattatcttcaaaatgcgtcaagttttagactatgagaacgtccttcagagtttgctttggactacaactgcaaatgcattgattatagttaaatgtgactttagttcagcacttgaaatagctaacattcacattagaaaaaaattatgaaatgactagttgaattgaagaaattggggaattttcctcccggtatgcttaatgaggtgtataccctttgcatgcattgtaaatattagtgcatgtgtattatcatagaagtatataaatatggcttgaataccatttcttgattttaattagatcacattgccttttgaatatccttatttaaacaggtaatatgaatttaacaggaacttgttgtacactctgttttatttttatagtatgcaaataagaaacaaatgccaacacattcattatgctgtttaacgtctataccagaaaggttccaatcactttgaaaaaggtcctttcactacttctactctaaatcactttgtcatgcttctgagaagaaacattttgaactgaaatttgtaatgaagattaaaccctatgatgttttaaaaatgtgggaaacatttttggttgatccctaagcatcaactgcatattaaggcaaaggaatgatttatgagtattcaatgataaatgaatattttattattttagtatcattaatcattatcctaagtagtgagacatgttagaggttgtttttacttttttttttctattgttgtttactggggtgctcattgttagcaggattgacagctcaaaatggaggtggaagctcgtgaattcaaacgtggaaataccttcttgtacagaaagatcttatagagatgagggaaattgtagtgaggatggaatatgataaagtgggaggaaggagagcagaaaaaaagtgaagttgacttgatttgtgcaggaatagtacacaggatcattagcttattcattcactatttacactgagcttcattattgtgccagctcagagatgggcattgaagatgcagtactgaaggagatgatctcacggggaaaaagaggatgagtattattgaagtgcataggagacagataagtgcaatgaaaatctttatgtctcatgtagagcctggattggaaaagaatcatccagctgcgtgatcagaatgcatgccctttagaccattcaggtaaagaacatgattcctagttttgaccccaccgtccattctttcctcacccaacattgtagccattcccagctcactattctatctttgacgtagtatctgtttgcaatagtggccctctatgggtccttcaaatcagagaggcacacatgtctggggctcacagttctaggaactttttctgtgtaagtaggacaaaaatttttaatatcaattctgctcaagcaatgtaaactaggaaacataatttgctaaaaagtgatgttacatattggtgaattttctagcattttggttaaatctaaaaataattttaaaatatttataaaatataaatctatctataaactttggttctatagctctacttcttttttaaactgcattaattcacaaatataatatgctcacaatgtgacactacagaaagatcaaaggagcatataaagatgatgctttttaccctttccgatggcatattttttaaagtcttatctccggatgtttaaaaccaaagtattctgctatttcaaaatgtcattgtttgcactctagctaaattgtagaaaaaaggcaaatctgaatatgacattattctttcagttatcaaaataatcgttgaatttattgaaaactatttaatgtcaaatatacaatataattctaagaacagtcctatgaaataagtatggcaaccaaattattttcattttatatatcgggtagctgatgcaaaaagactttcaaatgatatgttagtgtctaattattcattccacaagtatttacagggcatctactctatgtcagcagtattctgtatccaaaacaaagattctcactttattggagcttacatttcagctgcagagagaaagacaataaatatattaaataagaaaatgatataatagaaagttctatggaaaataaaatagagctgggaggaggtcgtttgtagtttttttttttcttcttcttcttctttctttttcttttttgagacagattgttgctctaccacccaggctggagtgcagtggagccatctcagctcactgcaaccttcacctccccggttcaagcaattcttctgccttagctgggattacaggtgagcaccaccatacccagctaatttttgtatttttagtagagatagggtttcaccattttggccaggctggtctcaaactcctgacttcaggtgatccgcttgcctcagcaaaaaggtgtgagccattgtgcctggccctgtagttttaaagagtgccactgagacagtgacatttgagcagaggcttaaagaagatgtggaagaacaccatgtgtatgtctggggaagaatatataaggttgagcaggcagccaaggtagagtctctcaagtgggagggtatgcaacatgtttcacagtgaatgaatctaagctttcacttagaatttctgtgaggtaataggatagacatagttggaaaagagtaagttgtgtgtttttacaagtccttgactttttaaagcattgcatttaacaagcattaattacatctcaatgattctttcatttgttcttgattcaacaaatattatctcagttcctactatgtatcaggtaccttgataaaaaggaccagcaaattaccacccacagggacatgatgagatagaagacatagcccatgttctctaggagcttaccatacattgcctaagacacagtaccactcttgtacccaccaggattatctaattgaacatgcattaaactttcaatcatagttaatgagagcaaagagctacgtctcataaaataattataataatattatttacataaaatcatatttggggaatttaaaatctttacggaaaatgtttaataatctttacaaaacccatgtgcttatatgtattgtattagtcagcgttctctagaggacagaactaataggatagatgtatatctgatgtaaatatgaaggggaatttataaaggattattgactcacatgatcataaggtgaagtcccatgataggccgtctgcaagctgagaagcaagggaaccagtccaagtcccaaaacctcaaaagtagggaagctgacagtgcagccttcagtctgtggatgaaggcccaagagcccctgacaaatgaatagtgtaagtccaagagtccaaaagctgaagaatttggagtctgatgttggagggcaggaagtgtccagcatgagactgaaggccggaagactcagcaagtctgctctttccaccttcttctgcctgctttattctagtcatgctggaagctgatcagatggtgcctacccagattgagggtggctctgcctctaccagtccactgaatcaaatgttaatctcctttggcaacatcctcacagacacaattaggaacaatacgttgcaatccaatccagttgacactcaattttaactatcacaagtccaccccttgtcaacatgaacccatacacatctcctgaaatcatacataatctccaaataaagacaataataaggtcataattacacagctattctttgcacaaccagaagtgcattaatccttaccctaattgctattacataaagttaacacttaaattcttatatgaagtcaataaatcttacatcacatgataaaggaaaaaaggaaataaaatgaagatattttcctagtaaaagtgtatacatgcacaaacatgttcttaacaaaataagaaggaaatactcatgacaattacagtcctcatttctgtagctggtcacgtggtcgtaggtggtattgatgactgccttcttctactacccattctttattccctttgccttcagcaagcacctcagcaggtcatggttttttgcctggttgagtgacccaaatcttcattcctaaagagtctgggccatttatagtccagcctggattgggttgttgtagtttcccattgacgttaatcatagggcatggtaatagtaagagatgccctaagggatctcctgtattccatgcataatcttccttatctccgttgtggagtagtagactgatttcatcttgataggctgggtcaatcaccccagccaacactataactcctttcttagactgttgactgagaggtagcccaaaatggccaggtggcaatcttaacttgcagtttaatggaatcgttgttgtgtctcctggttgcagcattatttcctctggaagtaaggcctctagaccagctgaacataatgttgtgggaacaggaaggaaaacttttgctagtgggtcactaagggtgatggtgagtggtgtcacttctacttacaccccttgattcctggacccatgtatcttgactatgggaggaagagtaccgtgtattggatgctgattcagagcatacacagccttctggagaactttgccccagccctgtaaagctttgtcacctagttggcattataattgtgacttcaaaaggccattccaccattctattaatccagctgcttcaggctgatgagtttctggccacagggacatgatgagctagaagacatagcccatgtcctctaggagtttgccatccgttgcctaagacacagtaccactaatgtacacgccaggattatctaattgaacatgcattaaacatgcaatcatagttaatgagagcaaagagctaaatctcataaaattattaaaataagtattgacatagaattttattttgggaatgtaaaatctttaaagaaaatgttttaataatctttacaacacccatgtgcttaaatgtatggttttggaaaatgtacccagactatttgatgttgtgcatcattccatgtaattattttaagagttttcattattttattattaacctcttttttattcctatgttacattttaatactacattaattattaacctttttaatttagaaaggtagtttattaaatgaatatttgttaaagcctctgaaaggaagtttataattggaatataaatgcataataacacattttaaatcaagctctttatgtgccattgaaaagctctattcctaaatgaaccataaccttgcaggtactatatcatgaccttttaaataaaagcaaagaaaatatcatgcacagattttatgtggaaaacacacctttttgtttgtgtatagtgcattcaaatcttatgactttagttgacttactacagcctcaatgagagctcaaaagtgatagaacaactcaaatggatattgtagattaatatcaataccagacatgctatgaaaacagtgaatgacttataggcataaaaatatatgatagcttgtttccggttacacatgtaaggtacttggaagttgccactccatcttaacaagtaaaacgctaaagagctaatttacaccccaccaacagtgtaaaagcgttcctattgagaactcatggacacagggaggggaacatcacacactggggcctgtcggggggtggggggctaggggagggatagcattaggagaaatacctaatgtagatgaaggattgatgggtgcagtaaaccaccatggcatgtgtatacctatgtaacaaacctgcacattctgcacatataccccagaacttaaagtataataaaaataaataaataaataaataaaaattcctgatgtctgaagaaaaagaatattttaaaataggttttattctataataaaataaataagatatacttaaaaataaaaaataaattaataattttaaaaaaaaaaaaagctaaagagactaaaaaccaacagctcttcttagattgtaagagatgggaggacttagggcaaaactgctacgccaaggttagagagatagacaggcaaatatagggaactatggcttactgaagcagagactcactagcggaaaccacatcaggatccaggaccagcgtaggaaaacctgaactataattgatgaatttctggaggatcagtgcagacaagtctgagagttaaaaactccaggagggcccaggcataggggacaccaaggatattgtgagatttatctagagaagcttgacaaacttctcaaagtgagtattagagaaaattcccccgctgcttctggcagggggaagagaagaagaaccatttcataatatggcagagcattctgtttttcttaacaagacctaaagagcaagaatagactggagttaaatatttgaagtattaagagggccaggcacagtggctcacgcctgtaatcccaaagctttgggaggccaagatgggtggatcacttgaggtcaagagtttaagagaccagcctggccaaatggtgaaaccctgtctctactaaaaatacaaaaattagctgggcatggtggtgcatgcctgtaatcccagctacttgggaggctgaggcaggagaattgtttgaacctgggaggcagaggttgccatgagccaagatcacagaactgcactccagcctaggtaacagagtgagactctgtctcaaaaaaacaaacaaaagaataaataaataaataaataaagtattcagagaaaaaaactcaccaatgtagaattatatactctgcaaaattattcttcaaaagtgaaggagaaataaacactttctcagacaaacaaacattgaaagaatgtattcagaataaacctccttgcaagaaatgttaatggaagtttttcaagagaaggaaaactatataggccagaaacttggacctacataaagaaaggaagaacatcaaagaaggaataatttaaggtaaaataaaaatgtttatttttcttactcctaattgatctaataacaatttgttcaaaataatcatagtaacaatatatttgattgtgtatacttacgtataatatatgtgcttatgtatacctatatataagtccaatgaatgacagcagtgacacaatggacaggagggaggatatgatttttttattataagatgctcatatcatctgtgaagtggtacggggttatctgatggacttggattagctatagatgtatattgtaaactctagggcaaccactacaaaaagtaaaaaaaaaaaaaaagtacaagtgatatgctaaaaagaagtagaaaaaaattgaatcacataaaataatgaaatacaaccacaaaagacggaaacagtatagaagacaaaataggaacagagaaaaaaatagaaaacattaatcaatatagtagatattaatccaggtatatcaatacttattttgaatatcaatgatctaaatacgccaattaaaagacaaagattgtttaagtggatttaaaaacccacctatgtattgcgtataagaaagtcactttcaatacaaaaacacatagattataagtaaatggatgaagaaaatgtatcatgctaacactaatctaaagatagcaggagtagccatattaatttcaggcaaagcagacttcaaagcaaggaaagttatcagggacaaaagaagggtattacataatgataaaatgatcaattatccaggaagacataagaatctttaacgtgtatccatctaataacagagcatcaaactatgccaaggaaaaaccaatagaacagcaaagacaagtagtgcatctattagcatagttggagactacaacacttctctgtcagaaatggacagatccagcaggtagaaaatcagtaagcacatagttaaactcaacaacactattagtcaactggatataatttgacatctatagacaacaacattcaataacagaatacacatttttctcaagtttacatggagcattcaccaagatagaccacattctggaccataaaacataccttaaattttaaaaggacagaaatcataaagtctctgatctgagaacacaatggaattaaattagacaccgctaacaaaatatatctggaaaatcccaaaatatacagagattaaacaacacacctctaaataacacatgggccaaaaacgaaatgtcaaaaagcattaaaaatattttgaactaaatgaaaattaaaagaaaacttatcaaaatttgtgaggtgctacaaaagtagtacttaaagggcaatttatatcattgagtgcatatattaaaaaagaagaaagatttaaaattaatgacctaagtttctaccttaggaaacagaaaatgaaaagcaaatttagtctaaaataagcagaacaaaatgaataataagaattagcaaaaatcaatgaaataaaaaaaatcaatatagaaaatcaacaaaatctgattatttgaaaaaagtcaacaaaattgataagcctctagccaggctaatgaataaaaagagaggacataagttaataatatcagaaatgaaagggtggacatcactacgggtcccagggacactaaaaggaaaataaagagtgctatgaacaactccatgcccacagatttgatgacctggattaaatgaaccaattccttgaaactgccaaaactcacacaggaaaaatagacaatcttaatcagcttatatctattaaagaaatcaaatcaataattaacaaccttccaaaacaaagcaaaagacccagatgggttcactatttaattctactgagcatttaagaaaaattcctaccaattctctcaatatctttcaggaacagagggaataccgatagtctcaaacttagaatttttcaacttcaagatgatgcaaaagcaacatacattcactacactcctcgacttacaatgggatatgtctagataactccactcattgtaagttgaaaatctcagaagttgaagcacacacttttgacttaacaatattttcagtttattacagccttatcaggacttaaccccatcgtaagtcaaggagcctctgtactttttaactgattatatgaggccctaatacctaataattgcactgacagcaaaccagacaaagacatgctagaaactatagaccagtatctcttaagatgcaaaaatgctcaacaaaatattagcaaattcaacgcaacaatgtataaaaagaattatacaccacagtgaagtgggatttatctcagacattcaaggctggttcaacattcaaaaaatcaggtaatgtaattcatcacatcaacagactaaaaaagaaaaatcacatgattttatcaacagatgcagataaagcatttgacaaaattcaacacccattcatgatcaaatctctcagtaaactaacaatacagagaaacttcctgagtttgataaagaatatctataaaataccttcagctaatatcacatttaatggtgagaaattagaagttttcacactaagatcaagaacaaggcaaggatttcccctttcaccatttcttttcataattatactggaacttctagctaataagacaaaataaaggtgggaacagggtatacaagttatcaaggaaaaactaaactgtttttgcagatgacattattgtgtacatagaaaatcagaaagaattgaccaaaaaatatcctgtaactaacaagtgattatagcaatgtggcaagattaaaggttaatatacaaaagtcatttgatttcttctgtaccaacaatgaaaaagtagaagttaaaagaaacataatattatttacattagaatcaaaacaaatgaaatacttaggtgtaagtctatcaaaatatgacaagatctgtgtgaggagagctacaaaactctgatggacaaaatcaaacaagaactaaataaatggagagatattccatgttcatgtataggaagacagtactgtcaagatgtgagttcttcccagcttgatctatagatgcaatgtaatcacagtagaaatccccgcaagttgtgttgtgggcattaacaaactgattctaaagtttaaaggcatgctagaagacccagaatagctaacacaatattgaaggagaagaacaaagttagaggactgacactacctaacctcaagacttactataaagctacagtaatctgacagtgtaatattggttaaagaatagacaaatagatcaattgaacaaaaaagacatcccagaaatagacccacataattaaatcaactgatttttgacaaagcagtaagacacttcagtggagaatacatagtaatttaccaaatggtgctggaacaactgcatgttcacatgcaacaaaaaattaatctagacacacccttcaccaaaattaactctaaatggatcatacatctaaatgtaaagcacaaaaatataaaattcctacaagataacacagaagaaaacctagatgatcttgaatatgttgatgacacatgtgtttttaaatacaactccaaaggcaatattcatgaaagaaattattgatacgctgggtttcattaaaataaaaaactctggctgggcgcagtggctcacacctgtaatcccagcaatttgggaggccaaggcagatagatcacctgaggtcaggagtttgaaaccagcctggccaacatggcaaaaccccatctctactaaaaatacaaaaattagctggacatgatggtagcctcctggaatcccagctactcaggaggctgagacaggagaatcgcttgaatctgggaggcggaggttgcagtgagcagagattgtgccactgcactccatcctgggagacagagcaagactccgtctcaaacaaacaaacaaacaaaaaaaaacttccgctcagtgaaagataatgtcaagagaatgagaagacaagccaccgactgggagaaaatatttgtaaaagatgcattggagaaagtacggttatccaaaatacacaaagaacacttaaaactcaacaataagaaaacaacgaaccagattttaaaaaatgagctaaagactttaacggacacctcatcaaagaagataaacagatagcagataagcatatgaaaaggtactctacatcatgtcaggagggaaatgcaaattaaaacaacaatgaggtaccactacacatctattagaatagccaaaattcataacactgacaacaccaaattctgatgaggatctggagcaaaggagctctcattcgttgctggtgggaatgcaaaatgatttgatcacgttagaagacagcatgtgatctcaacaaaattgatagagcactagcaagactaataaagaagaaaagagagaagaatcaaatagacacaatacaaaatgataaaggggtatcaccacccatcccacagaaatacaaactaccatcagagaatactataaacacctctacacaaataaactagaaaatctagaagaaatggataaattcctcatcacatacaccctcccaagactaaaccaggaagaagttgaatctctgaatagaccattaacaggctctgaaattgaggcaataattaatagcttaccaaccaaaaaaagtccaggaccagacggattcgcagctgaattctaccagaggtgcaagaaggagctggtactattccttctgaaactattccaatcaacagaaaaaaagggaatcctccctaactcatttaatgaggccagcatcatcctgataccaaagtctggcagagacacaacagaaaaagataattttagaccaatatccgtgatgaacatcgatgcaaaaatcctcaataaaatactggcaaactgaatccagcaacacatcaaaaagcttatccaccatgatcaagtgagcttcatccctgggatgcaaggctggttcaacatacgcaaatgaataaacgtaatccagcatataaacagaaccaatgacaaaaaccacatgattatctcaatagatgcagaaaaggcctttgacaaaattcaacagcccttcatgctaaaaactctcaataaattaggtattgatgggatatatctcaaaataataagagctacttatgaaaaacccacagccaatatcatactgaatgggcaaaaactggaagcattccctttgaaaactggcacaagacagggatgccctctctcaccactcctattcaacatagtgctggaagttctggccagggcaattaggcaggagaaggaaataaagggtattcaattaggaaaagagtaagtcaaattgtccttgtttgcagatgacatgatcgtgtatctagaaaatgccatcatctcagcccaaaatctccttaagctgataagcaacttcaacaaagtctcaggatacaaaatcaatgtacaaaaatcacaagcattcttaaacaccaataacagacaaacagagagccaaatcatgagtgaactcccattcacaattgcttcaaagagaataaaatacctaggaatccaacttacaagggatgtgaaggacctcttcaaggagaactacaaaccactgctcaacataataaaagaggatacaaacaaatggaagaacattccatgctcatggacaggaagaataaatatcgtgaaaatggccatactgcccaaggtaatttatagattcaatgccatccccatcaagctaccaatgactttcttcacagaattggaaaaaaactactttaaagttcatatggaaccaaaaaagagcccacattgccaagtcaatcctaagccaaaagaacgaagctggaggcatcatgctacctgacttcaaactatactactaggctacagtaaccaaaacaacatggtactggtaccacaaaagagatatagaccaatggaacagaacagagccctcagaaataatgccacacatctacaactatctgatctttgacaaacctgacaaaaacaagcaatggggaaaggattccctatttaatacatggtgctgggaaaactggctagccatatgtagaaagctgaaactggaccccttccttacaccttatacaaaaattaattcaagaccgattaaagacttacatgttagacctaaaaccataaaaaccctagacaaaaacctaggcaataccattcaggacataggcatggacaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaagttttgcaatctactcatctgacaaagggctaatatccagaatctacaaagaactcaaacaaattcacaagaaaaatacaaacaaccccatcaaaaagagggcacagcaaatgaatagacacttctcaaaagaagacatttatgcagccatcagacaaatgaaaaaatgctcatcatcactggccatcagagaaatgcaaatcaaaaccacaatgagataccatctcacaccagttagaatggccatcattaaaaagtcaggaaacaacaggtgctggagaggatgtggagaaacaggaacactattacactgttggtgggactgtaaactagttcaaccattgtgaagtcagtgtggtgattcctcagggatctagaactagaaataccatttgacctagtgatcccattactgagtatatacccaaaggactataaatcatgctgctataaagacacatgcacacatatgtttaatgtggcactattcacaatagcaaagacttggaaccaacccaaatgtccaacaatgatagactggattaagaaaatatggaacatatacaccatgcaatactatgcagccataaaaaataatgagttcctgtcatttttagggacatggatgaagctggaaaccatcattctcagcacactatcgcaaggacagaaatccaaacaccgcatgttctcactcataggtgggaattgaacaatgagaacacttggacacagggtgtggaacatcacacaccggggcctgttgtggggttgggggagtggggaggaatagcattaggagatatacctaatgtaaatgatgatttaatgggtgcaacacaccaacatggacacatgtatacatatgtaacaaacctgcacattgtgcacatgtatcctaaaacttaaagtataatttaaaaaaaaaaagacagcatgtggcagtttcttgtaaaactacaaatactcttaccataggatccaacaactctactccttggtattaacccaaaggagttgaaaacttatatttccacaaaaacctgcacatggatgtttacagcagctttattcataattgcccaaactgggaagtaaccaaaatatccttcagtaggtgaattataaactttggtacatacagacagtgatatattatttagtgctaaaatggtataaatatcaagccatgaaaacatggaggaagcttgaatgcatgttactaactgaaagaagccataatgaaaaagctatatactgtgtgattccaattatatgacattctggaaaagacaaaactatggtgacagtaaagaaatcagtgataggcaggagggttgggtggggtgaggaagaatgaataggtggagcacagaaaatttttaggaaagtgaaaatactctgtatgatactaaaacaatggatacgtgtcattatacattgtccaaacccatagaatgtgtaacagcaagagtgaactctgatgtaaactgtggatttgtatgatgatgctgtgtcaatataggttcatatacatataagacataccatatatatatctgtcatacatatgtgacagctgctactactactacatgactacataactactacagtctacacagtagtagtcatgatcttttatacatgcgtatatattagtcatggtagtttcctgcatgcacttttgcttgtagcaagtattacaatcttcatagggatgaaacggaaggtttaaaaaatttattaataataagccatctttctttccaccaacatttactaaattacattaggtgctaggcaatcctgcaccaaatgataagaaactaaaggtggataataattagcatgttctcacattgagtgaggtaagagaagtgggacaagagaagagaagtatataaataaacatctatctgacacagtccaacaggaactgagtagtggttggtgtagcacacttgaatattaagagaaagcagtgattctgtctctgagatcattgaggatgatacagttgaggttagctctgagttagaccttgagaagtaggtaggagctgtacagtcagacgtctaggatggcactacaagaaggaccaatatgaggaaaagaatggacatctaaaagtacatgtggcatgcggtaggcagtatatataagaggttcagtttgatatgtcaagataaggagcagcaaggtgatttggagccagattataaagggccaatactaccctatcatcagcccttaacatgcagtaatggtcaggaagctgtgaatcatcccattggttcctgctcactcattctttcctctaattttattatttcttaggcagttccatctgctggtctagcttagatggtatgcagagctgtagtgaaataactcactggcgaagatcatataaataaggttagcctctgagaatgaatataataaaaaactgacacacattgaataaaattaaccatctataaaagtaaaccaacacattttctataaaggttgtataaggagcacaaaaaaatcattcaaagtataaatattatagtcaaacagatcaagctttgtatctactcttattagccatgcaactgtgagtagttatttaacttcttgaagttttttttttcctgtctgtaaagtggggctaataacttctatgctatgatgttctaaggattagagataagtcatgtgaaattctaaacatagtactcagcatatgcaagtacacagcatgtaatagttcttattgtggtacttagtaaaagtggcatcagttagcttttcctatataacaaaatacctcaaatttgggattgaaacaattattaatttagttcttgattcaggatgttagcaatttgcttaactgggctatgctgcatggttcttctggcctcacttggtcttatgccatctgtggtcaagttccaggtgggctagggactggctaatctaggtcagcctcagctggatggcttgtctgtgtgtcatgtggtctgtcatccttcaggaacctatgctggcttgtcgtcttggtaggatttcaagagagtaagcagaaaagcaccaggccccttcaagccttggtttaactctggtacatcatcacctctaccatgttctactgattaaaacaagtcacaaaatcagcgcacacccaaaggttgggtagataaatgcccccacttgatgggagtccttccgaagtggcatggaaaccaggagggaacaattttttcaaacaatctaccacgagagggttgaagacataaaatcaactagaatctctaatgtaaattgaaaggataggaaatcaatatggtatagtcttgatgtagtagagaggaacttggaatcaaaagacctgagcttaatccctgcctttgctattgattaacttgaccctggtaaagtaatttaaattatccatgcctcattattatcagtataagattctccaaattcaagattgttgtgggggataaatgagataatgtatgtgaaaatctgtactaaactgtaaatacagaaacaaatataatgaaaaattatttttgatataaaatgtactttataaattataaaaggatctagaaccccttacctttaccatctatgtgtccttattctgtctctagaatgtagaaaggcacaatatatattaaaatatataatttaaaaatatataaaatatataaacaaatacatgtcatagcagaaaaatgcaaaggatactgaggaatctcagaagaggggtgccaaaggaagtcagaggagcaatagggcacaggagaggcatcccagaaggcaatgtctacatgagaagcacgaatttactagagaaaatgatcgaaaattcaaatccaaatgcttagctgattagaaaccattgttttgtcccttacctgcataaaccagattcctacttagatatcttgcttcattttttatgaaacgtaaccatttgtttcaaagtcagccaaattgaactacctgagatttcttaaacacagcatattccttaaatacaccatcctttgcttttgatcttgctgctcactctacctggagtactctacctccttggattttgaaatcaatttccaatacagacatacctcattttattgcaatattgctttttttacaaattgaaggtttgtggcaatcctgcttctaacaagtctattggtgccacttttcaaacagcatacactcacttcatgtttctgtgttcatattttggtaattcttgcaatatttcaaacttcttcattattgctacacctgttatggtgatctgtgattagtgatctttgatattattgttaagtgctttcaggtgccacgaacacccgttgaatatggaaaacttaattgataaatactgtgtgtgttctgactgctacactcatgggcaaatccctcattccgtcagtctcttcaggcctccctgttccctgagatgcgacaatattgaaattaggctatttaaagtacttcatgactaaaacacgaaaagcaatggcaacaaaaaccaaaattgacaaacgggatctaattaaactaaagagcttctgcacagcaaaagaaactaccgtcagagtgaacaggcaacctacagaatgggagaaaatttttacaatctgctcatctgacaaagggctaatatccagaatctacaaagaacttaaacaaatttacaagaaaaaatcaaacaaccccatcaaaaagtgggtgaaggatatgaacagacacttctcaaaagaagacatttatgcagccaaaagacacatgaaaagatgctcatcgtcaccagccatcagagaaatgcaaatcaaaaccacaatgagataccatctcacaccagttagaatggccatcattaaaaagtcaggaaacaacaggtgctggagaggatatggagaaataggaacacttttacactgttggtgggactgtaaactaattcaaccattgtggaagacagtgtggcagttcctcaaggatctagaactagaaataccatttgacccagtgatcccattactgagtatatacccaaaggattataaatcatgctgctataaagacacatacacacatatgtttattgtggcactattcacaatagcagacttggaaccaacccaaatgtccatcaatgatagactggattaagaaaatgtggaacatatacaccatggaatactatgcagccataaaaaaggatgagtccatgtcctttgtagggacatggatgaagctggaaaccatcattctgagcaaactatcccaaggacagaaaaccaaacaccgcatgttctcactcataggtgggaactgaacaatgagaacacttggacacaaggtagggaacatcacacaccggggcctgttgtggggtggggggagtggggagggatagcattaggagatatacctaatgtaaatgacgagttaatgggtgcagcacaccaacatggcacatgtatacatatgtaacaaacctgaacgttgtgaacatgtaccctagaacttaaagtataataatttaaaaaaaaaagaaaataggctatttaacaactcaacaatggcctctaagtgttcaagtgaaaggaagagttgcatgtctctcactttaatccaaagctagaaatgattaagattagtgagaaagacatgttgaaagctgagatagggcaaaaactagacctcttgttccaaatagttagctaaagtgtgaatgcaaaggaagagtttttgaaggaaattagaaatgttactccagtgaacacacaaatgataagaaagaaaacagccttattgctggtatggagaacattttagtggtctggataacattttagtggtctggatagaatatcaaaccattctagatgcccttaagaacatttgtgaatcatgagaggaagtcagatgtctgcattaacaggagtttggaagaaattgattgcaagccttgtgagggattcaagacttcagtggaggaagtcactacagattagagaaatagcaagagaacaataatgagaagtggagcctaaggatgtgactgaattcctgcaatctcatgataaaacttgaagagatgaggagttacttcttatgaatgagcaaagaaagtggttgcttgagatgaaatctactcctggtgaagatgctgtgaacgttgttgaaataaaaacaaaagatttagaatattccataaacctatttgataaagcagtaactgagttttagagatttaagaggattgaaagaagttctactgtggataaaatgctatgaaacagcatcacatgctacagagaaatctcttgtgaaaggaggagtcaatcaatctagcaaactttattgtcttattttaagaaattgctacagcacccaggaattcgatgccacggtaagctataatcccaccactgccctccagcataggtgacggagcaagaccctatctagaaaaaaaaaagaaggaaaaaaaagagtgagaaagaaaatgctacagctttcagtaataaccagcctgatcaatcagcagctatcaccatcaagacaagacattcctttagcaaaaagattatgattcaccaaaggctcagttgattgtagtgaaaacataacttttatgcactgggaaaccaaaatatttgtgtgacttgctttattgtgatattagttttagtgctgtcatctggaatcaaacctgcaatatcttcgaggtatacctctaaatgtccatgggtgatttcataattggccaagtgttcctgttgtatggtgccttccctgattcacacagttacaaatgattaccctttcttttgctctcattttatcttagttagtattattttttttgtatcaattttcatgtttcctttattatgccatgtgctttgaccattccttatacatttagacaaaagaaacagacatatgatcaagagaattcagcatgcaaattacactcagaaagcaaagcaattcagtgtggtcaaagcaaaagttgcactatggtcttgtatagcctattattttatcctgaaattggatttgaagccaaagtgtgatatgaggaggtttgtctctttagaatactttggcagatagtattggctgaaatcagatatggggcaactaataaggaatcttctgcagtaatccagggaagaaatggtgaggatcttaatgtagtcacaatgaggaacctggagatatttggaaaataaactagagcagtacttctcaaacttccctgtactttaggaccacctagagagacttgaaaaactctgatgcctgcacctcactccatacaaggtaacacagaatccttggaattattattattttttaactctctaggtaatttcaatgctcagccaagtacttggttaatcactggatgtgggcgacaaagataggtattcctagttttctgatctgggacaaaagagtgaaacaaaagcatatatagtgtggataaataagcaaatttagagtggagaaatttaagtttggttttggacaaatggaaattaagtgctaacgggtagtcgtatatgcaattcttgcacttaggaaaaagatgcagtttagaggtatacactttcgagattttctgcatgtattaatagatattatttacagtcattgcgaatatgatgtctagtgaatgcatgtgaaatgagactaaaagaggactgtgagtggactctgggagcatcaacatgtgagaaattgacagaggtagaaaaagaacaccaaaaaaaaaaaaaaaaagaggaaaagtaagtggtatctccaaagctcagttagaagaggggttcaagaaactggaggtggttagtagtcttaaatgctgaagagagtttagtacagatctgggctgaaaagtatataatatatttggtgaggtcactgttaaccttggggagatcagttcctaagcatattggggacagaaactaaataaaaatatattatggagtgatcaaaaggggaggaaaaagcaagttactgtagctcctagagtggtacagtggttgtttcctgttgtgttggaaaacatctctgattttttatagaaactcttgtatattgtttaaatgttacttttctatatttgaaatagttgtgtaaataagacatttgtcagccccaaaataaaccaaaaaatgatgaatttttaaataattttaaaagacaacttgtaagcatactagtctcatttatgaccattaagtaagcaatgaacaaataaaattagaaaagcttattatttcaccttaaatgtcttatagtcaatgtatatatttcaggaatattgcaccaatctcactttcactaaatttgaactaaggcataaaggacatctaaaatttgaatgttgtatggttaattaacatttaataaacttattttctttgtttaaatgtctttgaaaatcaaatgtctcatgctgtttttcctcatcaatgtaatcccagtagtcttaggaatgattttgttgaattgtttgacaaaacctaacttggctgcttgtaatttatagttgttcacccccgtcactttgcagtttttccctactaaaaaatttagattgtcttgaagctgaattgttgactggatttcctatgtagttcacagtatggttacagaataccaaaatagcattgtcaatgtgttttaaaaagcatagacctgaagtcaatgggaatttgacaagacagcctgcatgttattgtaagccattgcaagttttatgttgttcttcaccttaatttttaatgtgtaaactttaatgaaattcagtttttaaaagctacttaataaaataattttatttattccctaaggaaatggaattgtcaaaacaaaaaaagttgaccattaaatttgattcttttatttaaaatttcaaaggatgacaatggaagccatatagcactactttttttttttttgccaaataagcatctgcacattgtttttcacctttgagataccttttagagagaaagaaatatgcaaaatttgattagtaaattatcatactttgcattttatatgcttcaaaatgttaatgtctcatagaaattagatgtttacaaaaagtgtatacattttcttaagttgtattaattagtcaaaatgaaagtcaaaactattaaatactccaatttaaaagtattttctacgaagcagaattcactaaaagaatggcttttcaggagcatatcaaattttaatgacttaagcactaaaaagcatcttgataagatgggtctcaactctaagacaatctataaaacccaatttcatgttttcagtaatataaaggggactgtaatctgtgttccaactttgtaaatcaacttgtcctttgatttttactaatcatatttttcataaatattatcaacactgattaaatatctgcctttttgacctcataatcataccatgttctagtaaatttgctttccctttcttttctttcttcgttttttttttttttcaaagacaaaatctcattctgtcgcccaggctgtagtgcagaggtacaatcatggctcactgaagcctcaaaactcctgggctcaagccattctcctgcctcagcctcctgagtagctgggattacaggcatatgagccaccatgcttggcccatttttagagactatttcacattttatctcttcctcatagtcacaaacccataactagttctctttactctcagtaagagaccttacaccctagttcataaagaaaatgtagacaccaagaagaatgattttactttttccacatcgaatttagaaacctaaatgcatccatacttatttgtttctctctctactcgtcttctatcctgttagatacaaacaatgcctctgcctctcttaaagcccactttctccacttgtactctcgattcatcatcccctcttcccttctcaagagcttctttctctttcccaaatcattttcactagtgtaaaaacatactcaaatatagtccattaagaaaacatcattagtcctcccgtgatcttgtacaggctgccttcatttgtcttttagctagcccaagaaaacctttagagagattcatgtattgcctctacttcttcatattctattcactcaattcattctagcctgacttttgtcctgtcacttccctgaaacccctgttttaaaggttacgaatggtttttgtctcttcaaatccagtggacacgtttctactctttgacacagactttcagaagcattcatcacggttgattgttccttactttttggaacacttccttctcttggcacgacatcacactctcttgtgcccccaggtcagtcctagggcctttctttttctctatattattttcttccttttgtgaagtcatctagcctggtgacttcaaataccattttattttgaagtctctaaaacttgcacctttatccttgacctctttagtgaattctccactcatatatccagtggcacaattgatgtcttcactaatgctatgcttactagacatactaaatataaaatattaaaattggacctcttcaatactttcttcattaggctttattctatctcagtaaattgtctacattccacagttcagtagttcaagccaaatatctaggatcattcttaatttctacttttctctatgtctctctgaatctaagcattcaccaactagaacctcagaactatccacttctctgtatctccgtggatattatgaaagccacattatttcaacataatcagactccttgctttcacccttaacccacttatcctattccctatagtcacaagcatcttttgaaaatgtacatcagattattttatcaccctcctttaaacctttctgcggcctcccattacaccaacaataaaacccaatctcccacagggttcagagctcccagagatctggctattgcctgcttctctcattttctttcatactattcctgtcctctcatgaatctacaaccacaaaagccttcttttttccccttgaacataccatgctcattcccacctcagtctttgcacctgcagttacttctacatacctggctgcttttactcacttccacattttatttaatgtgaggtgccatctcatctctcagttttcaactcagggagctttttactgaccatgtgtctgacatgcatttatgtattctggtgattctctgtcatgctctcctcctctattactaccttcctaaaaataatattataaataggtctaacaattggaactggaaatggtccaattaaagtatctttttttaactcattatgacattttcctccctaaaatgtaagcttcaggagggcagggactttttctgtcttgttcatcacttctgagttagaacagctgttggcatatagtggagctcaagaaatattggttagaagttgaatacacgaaaatgctaagtcaatgtctcaagctcctttttgtgtgccatttaattcctcttatattagatgctcaatttgcttattaatcaattaggtgacattgaatctcccaccagactgtgtaacataaactgtaggatgggggaagacaaagttcaaatactgtgtagcatctgggtttcactatctcttcattcaataatgttttaaaatatgagccataaaaattgagcactagaaatggcataaattaagtgaaatattgatatagaaaaatgttgcttttatttaaaaatatatttcattgggtatttatttctaataacattgcatgatgtttcacgatataaaatatccatcattctggttttttttcttaggaaaaaaaatctgttccctcctgcttgattaaaaacggagtacagcaaaatactgaagggcttcctaattatcaaataaatattaaattatgtccagtgtccttttactgttaatgtcttttagcctgactcttttaaaaattgctttctcttttaataaaaagtaaaattattttttggtcatctttatttctcagaaatagaatgctaccacatattttcacaaaccatcctctggctttagataaggatatttagaatccttagaccatttcacatttttaaaataaatataaagtcatttttcctgaaatttaattgatttaaaaaattgctttgaaaatttcttcaaaacatgacaactttagttttgcatgtagtaattgtcaagactgttaaatcatagaaacaagaatgtaaaaatagaatttccttaagccaaagtgtggtatttattagtttaaatatgcagatatgttagtgaggcacccagccttaaaagtggctgcaaaggggatctctctccatcctgtgtgtttgtctactttctcctgtctctgttttattttttcccagtgtagtaagctttgggattggaaagtggttaaatgaggaatcagtgatcaacagcagctctgaataaacttcattccagtttagtgaccaaggagaaaaaaaaaaaagttttaactttcccagttccactgagggattttgatagaagcagagtacctaattcctatgatcagtgcaggtggggatactttctcatctttctgggcaagaagatagagtctgctttcaatggatagggaaaggagaacagggtagtgcttggctgctcagagcatacaatggaaaccactgcttaccataatgtatctctcccatctgtggtcacccctccccagtcagaggctgccccaccagcattcagtggcatgattctcgcaatgtcctgaacaactctctgtatgatatttatttcccttcatcaagtccaattgtagtgcctcatgcttctcagcaacctacagggtgaacaattaaccaacctggcacagtcaatataaatttgaagcaaaaatagctctgttaaaattaaaattgccatgtaaaagagagaaacagtgttagtccctacttgagaggatatatcttatcctactgtcaaggctgctaaaccttgcttccctgctgtggatttctgtggtcaacccatctgcctggctagattcagcccacgagaaaggtttttcttgtcctctgtggaaccctgagaggggagctggagagggaggtgcacatgctgtgactgtgctgattgagcagccacttcatagttgcatgagaatgtgaattgggggattattttgttatgttaggaggtgggggttttgtggttgttgttgttattgttttattttgtttttttttttttaagaaaaaaattttctaaaaatctatgcatattgcttatcagtttcgccacagggtaactagtatctaatagctaattttttcttcttcttcagtctgtatctctgtatctgtctctgcccttgaagttctagcaataagcctcagggctctgcccattccccagttgatttttcctttcaaataaggtccttaatctctctctctcttttttttttttttttttttttttttttttttttttttgcaaggaatgcctacaccaagaggtattaggtctagtcctggaagatctggtgccctctttgatagttctccctgatcttttttctaactggagaatagggcatagcatccctgagctcttagatcacttggaaagggcggaaagcatctctaactgaagctgtgtaattacatggtgccccttttatacttgcaaatgaagcttggagtatgacttctcacttttttagcccctagggaaaaggccatggaacaagcattcttacatttttctccccaattctgaaaagctgtagtttcactagacgaaaaaaattgaatcctaaactcaatgaacaataatttggcatgcttaattttccttctctatccatcatctacttttactttcttctctttgttcctctctctaaggaatctattcaaaattgctgtttcttctggcttccatatttcggaacgttgttcaacctttttgtgactaatggtctgcgaatttctcagtggctttgattcagagtctcagatcttttgcttccttctttttaattgcttctctagttgactagtcctgtgtattttaatatctgattattttttcatcaccaagacagataccttcatcagccctaatcactcttcactcttactcatataatcgccagcagttttcaattgtttatttttcacttctctaacttatggtatccatttctacttaatcttcttaaaagggttagctgataatgcaaccccttgctcctaaacctctggtgacctcattcatttattctttcagtctttgatacgtgccaaataccatgctagttactgtagatagatgatgactaatgcagagcagctccagctttcatggtgtttatagtctatccagaaagaaaaagaaaaaaaaaactttaaagacatgcttctttccctggtttttagaactctctccaatatggtcacaactttctattctcctgatgaaaacgtttatctgacttttacagcatatctttttttttttttttctcaaagtaaataaaaaagctctatgtagtgagagcacagtggcttttagaggactcttaccactagactctgcaactttaagcttggcacaaactctttgtgtctcaatctcttagtctttatttttttattttatggagatagaatctcgctctgttgcccaggccggagtgcagtaatgcaatcatacctccctgtaaccttgaacacctggattcaagtgatcctcccatctcagcttcctgagtggctgggactacaggggcagggcaccacacccagctaatttttctatttttttgtggaggcaaggtattgctctgtttcccaggttggtcatgaatttctgggctcaagcgatcttcctgctttggcctcccaaagtgctgggattacaggcgtgagctactgcacccagcctcaatctcatagtctttaaatgataatggtaggaaataattacttacgtgtatcaagtatgtgctttgggctagcaaaacctagtcgttaaaagcacagactcttgctcagtcacactgcctggctctgggtcctggcgctgttccttatcagctatatgactgtcaggtgtcattgccttggcgtcttcatctataaagtggggagaataacattgggaatgattaaataagttaataaagtaaaaaccattgaaacagtgccaagcacactgtaagagctatgtaagtcttagcaatttcttttattacttttcttttctttttttctttttttctttttttttttttgagacagagtctcgctctgttgcccaggctggagtgcagtggtgcaatcttggctcactgcaacttccacctcctggttcaagcaattctcctgtctctgcctcccgagtagctggaattacaggcacacgccaccacacctggctaatttttgtatttttagtagagatggggttttacaatgttggccaggttggtctcgaactcctgacctcaagtgatccacccgcctctgcctcccaaagtattgggattacaagcgtgagccaccacgcctggccaatttctgttattacttttcttaataagtggcacgattattcatattttaccaatcaggaaactaaatactttgctcagggccacaagtaagtgacagagtcagggttctaacctggacatcctagtttcagaggaggcattggtaattactactctatacagtctccattatgggatttctgtaataatgtagttaaataatcaatacataataaaatttaaaactataatgcactatgaatatttaagatattattatgtgtactatagtgagttatgtttgaaagagacactattttttttcttttccatcacttaaaaccttttcactgtaccagtaattacaaacagcattttaatggcattgtataattagacaatcccttcacgtacatgcatgtatttacattgctactttcagaggatggcaaagccagtaaaatcctctctattttgaaaaagagaatgctgaggatcagaaaagttaagtaacttgcccaagtgttcacagatagtaaatgagaaaatctcctaatgtaattccaaagccccaaatgtcatccagtgttttgctatcttaccctgctattttctaatgatttattttttcacagtttgaaaactaattttataatatagtttaccattataaatttatgtaaatattaatatatctttgtgtacaactggataactacttgaacttatattcttttgtttttctttttaaagattgtgattgctagcattatgtgcagttacaataaaaatgactggacggaacttgccaagaagtctgaggtaatggttactttagtatatatttattttatttcttctctcctatttttattagttttaaataaagagctgccatgagaaataatacagtagaagtaaaactgaattgaaaatgtaacttaaaacatttctattataatttgtttaccctgtgttttcattaaaatgatggaaatgtaaatttaaaaggaatttattctataaaagcggtcccttggatttcacacactacctaaaaatcctttattctctgaatccatacactctttatttgcatgttaagcaaactgtatattatgatggatgccatgataaaatttaattctacctttgagagtctaacttgatcttaccttgcctttaggcaaactagtttgacagtaagagaagaaattttgaatataaaactcttgaatatttaaagtataaaaggttcatttaatactattctagtttgaatacagacatgcataaaagagcgggacagaatgctcctgaatggaacactagtcagcaggttttccataatataaattgaatcctgcacaaatgcaaacaagtaaccatgtgccttaaatttgtatttcaaatagaaaaatacatacttaaaattatacacttatgtccatcatgctgtcatggaaaatagtctggagagtcttagctggggttccttgaaaacctctcagtaatgtagaagactaaatctaactataccaatgaactaattgacgctacattataaaatattgcaaagctgtctgtagtgttcaaaaatgttgattatacattttatttggatattttaaaactgagaagggaaaaattactactgggacttagaggggtgaaattaaacatgatcagtaattggcctcgtgatcttccatgctgggttcatttgatacatgtatttacctaattgaccatgaaatcttccacagagcccatgcttggcatgagctttgccaattttaagctgactatgatgaatggctttatcatgccgcttgcttctctgcctttctgtaagaacaaaatacttttcaaaattatttttttcaatattagacattaatttttaaatagacaacattactttttataagtcaaaagcctttaattataagcaaactagctaacctaaagatatttttcacatttcatatttttctttaatttcagttttatttaatatcaccttctaattactctgtagcaaaaacataaataaaaagaaaggaagaaagaaaaaaaagaaagaagggaggaaaaggtatgccttttgttcaatcaaaacagtctgcaaaatctctccataggagagcagtctacataacaagaggttatgataatgtcaattaaaaaataaaaatattcactataatcttaagtctggactagcccaggagatatcatatgaaggaagtatcccgcaggccttcacagcttctaggagggtagcattaagcagcatgatttcatcacagctcatatggtaggcacccaataacgttttgtagaatcagtatttggttttggttttatgaatatgcttcaaaaccggttaaaacagatttccttacaatggaaaaacccacgttaaaacaaaccaacaaaaacatattcaagtcaaaattactgtactacctaacatatacatttcttttggggtggtgatatagggatgtaagaaatcagagacaccacaccaacactctagcatgccaactgtttcaagtttagctaatgctgtgatgtgatgatgatgtatactaaaccttaagtttataaaactgtctttatggcagattaattcttgaattacacaatggagagctgaggaaacctgctatcagctttttactacttcatctgaaacagaaatgacacatatggagcagtagagccttagaatgcacatgcatttcatgttctatattcttcaacctggtttgaatttgtcatgtttttgagcaccacaaagaagtttctactgcttgtgtcaaattagtagcattgttagaatctagttagttttcttgatccaggtacctgatcacaggctctcttgcttttctggaaccttggtagtctactccaattctatgcaaaagaagatttatgaaacacctactatgtataaagtccctggctagccaaaacaaagatgagtaatagggagcaatcagatatatgccaaactgagccatttctgaaggttcacaatattcacttgtaaatggatctttaatccagtgtagtcgatcttgaatcaatttcttttgtaatttgtaatcagccttgaaaatagagcccgagtaaaagttaatgtgaaaaagctttattgaagtatacaatctcagagcagaaagactgaggagaaaagaaaaatgagatgggaagaagggaaaacaagtgcaatatggtgcattccagagctggccacaacttcacaaggaaatggagccaattgctcagtcatatgggacagggaatagcacatcatttcacaagatgatagaatcacccattctctcatcactttctaggaaaggaagtggaaggaatgagtctactggctccttcagtctcctgtctctcactggccccatttcactccgtagggctctcctttcctctgaacttttgagttgcatgtcctgccccttcagggcagctgctagggaagctagatttgctagcatggggtgtgatgcttcttctaaacccagaattgtaggggaaggccagagcctcctgatggggcctgggcactggtgctcctggagctctcactttgacaggctcagtggaggttgtgacacaacccactctcatctggagggagtctgtgagagcggacagttactataggagatgtgaagatagcaaaagggactggggctcccctttaactagtggcaaaattcctgggtgacaagtagggccatcaaatttgaggaagcgtataattggctgtggtccaaaatgcatcattaccaagtttaactacaatagctccactaatcttcttgctctcaaccaatccaaattctttccatctttcctaatttcagaacccttaacttgaccattaagtgctacttggcccctgccctgcctgcctctccccattgtcactgtgggtctgttttctgcattccagatcccgctgccttcttttcctcctccaacacgttcccaactcagagcttttcctgttcccttggcctgcaatgttctctcttcctcagtcctgagcctctggctacgtagtttaaacctccctgtcctattctgtaagaccctgtcttcagaggccagttgaccagatagttaatgaagcttaagcttcagggcatttacttgcatgggccacttgcaagtccctgtacctaactctgtgtttacaatgtttgattattgttttttccttaaagagggttttccaaattatttaagcattaggctccccaaaatctggatctacctctgtctgtgtttttcctctgtagcatataataaagtggtgattaacagttgtgtcattggccactactaatagttcctctgtcctgcttgttagaaagcaagttccgtgggggtcgagacccttgcatggttcactgcttaatcctcaattccaagcacaaggctttctttaccagcagatatttgttgaatgaagtaaaaaagaagtatacagttcgagtattgccatgtgacaaacaaaaaggaagccattacagaataaatgggaagaatggtattttatttggcacccatgaacttgaagtgtttaaaatccagtgatgatgattttaagtcaggtacctgatgagagattgccaaggttctgaccacctttggtaggaagagacaaggaaggtccagcagaaaggcataggcattaaaaccaagtgaccacactattcctggcggggccaaaataaaacactaaaacactaacaagccagtttcctatcagtttctttacctgaatctggacagcaatatgtcatgaattaaatagctgtgagagttagaaatcccaaatagtttgaggtaaaaatcaaacagaggcacattacagagatatgtaggaccagttggatgttaagtctctgaacagggacagtaacaggacagaatggaatcacaggagatagacacgcagctggagatgagagatagtaactgactttacatccagtggggcccaagccaagagtgttttacctgtcccaggtctatctcagagaggtttaagatcccagagaactttaactccagttttgaatagttgagactagaggatagcattgctacttggaaagtcaacatctgaccccatgtattcatttaacagaagaagttaagagggaatccaataactgtgcctttcatgccccagtacagtacactgttctcaccctacttgagctctgatgtcctttgccagaccttatcacccacggacgtcttcccttcccacttggaccgtgatataccacaccatgccactggccatgtagacatccttctggctctgctccgcttaggctgtgacatcccacactgggccctcatggctcctcaaatgctcgtgctcacctgtcttgccctgcctgaccagtgactttagagctgtattgatcaggaaggtaagggaaagaaaggaagaggtaaggaaagaaggagaagagaggagaaatgctttgtgcatgatttcattgtatatgttgcacaagagtttgtggttttgccaccttagtttctctgggtgtttttataaagtggttcagagaattttaaaaactataccactgtcatattccaagaatttctcaggatagttttcctttccctcctgaggtatagacaatgtaggaccaggtgagttatcttaaatcattttcatatcaaggcagaggaaggacaagtcagaggtctatttggatggatagataagtatttagatagatagatgattgataggtagatagataaagtatttagatagatagtatacacctttatagtatttactacattccagaagtcatttacttttattttttatcactcctctttaaactcttatatatgttaaagctcttatttttcttttctgtttacttaaaactgtaaaaaataaactttcttttttggcacctttcatttcctgtgttagccttggaaacatttaaaaatacatctccctagaactcttctgtgcaaatatcaaatttatttatgccttacaacaacaactctgtgacttagttccactttttaaatatatttttatttttaatttttaatattttttggagttctagcttctctgacttgatgttttccttttttttttctttttttgaggaaactaaggccaaaagtagtgaaagagtgtgttcaagttcacacagctaggatggagtaaaagtgggattcaaacctatagtttggctcagagtccacaccatatatatatatatacacacacacacacacacacacaaactctctctttctactgtgtatagatggatgataaatagataatgtaggaaattagtaacagtgtatttcctatgtcactgccatcactaggatatttcattttataaccatttaggtgaggtggaataaactctgggtaagtgactaaactaaaaagcttgtgactaacaagaatcagaatgcatgcccaatttcagttaatttaacatttcatgctaattcagcaattaaggctttttgaatggttagagttgcttggaaatggaattaactgccttttaaggtggtgtgcatcctgagacaggaattttcaagcagaggccacatgaatgttcctgttctcatggtgtcaccttgaacagcattgtctgtttttgaggcttggatacacatttcaaaggccttgccaggtgtgtttggtgagtgggcatttgtatatgtgtataatgttggggaaattataataattagtcagtgaaaaaattttatattgaacaggtgattttaaaatattttaatttttacttcaagcttggaagctgtaaggatattgagctgttatgtttttcgtaacacactatgacaactccagccataaaataagtgatttgtagtaaattataatagtgggtataaatgcaggtcctggactcaaaatgcttgagttcaagaccctactatcagctataagctgtgggatgttggataaatcacttgaactctttatgtctcagttttatcaattgtaaagtagaaatgatgatatatcctacctcttagagttgctgtgaagataaagtaagataaaacatacaaaggacatagtaaagtatctggcatattgtaaatgctcaattaatgtaagctattattgtgtaatatggtagctaggtgtaagtttgaaatgaaatatgcataatgtaaatatgtataaaattattatgcaaagccttatttaatccaaaatgatgttgaattgatttgctgttaattgctgcatttcagttaaatagagaagtctacaggaaatatttgaagtaaccaggaaataataagaaacatgttataagtgtatacttgcactatacaatcttttcactaagctggtaattaccgcatgacatggttttgagacaggtcatattatccacagttgacacttgagcagctggagacaaagaagattgactgacttgtccaaatcatccccaattccttagctacaggcgtaagattagaactcagggttcagcaggctgtgctcatccatgctcactaccaaaccatcaaggaaagagcagcatggttttcagcaactctcaaataacatgaagacctttaaaatcggattaggaaagcaaaaccataaggaaaccatgttaaaaacaggctcaatgatcaaatggactttaacaaatgtgcagaagaaaaagcagactcactaatgaataaagataggcaagactatcaaccgattaatgactagctggagttcttaaatttgttgaggtcctacttaaaattcacaaagcaggaaaaaataggctaaaatcttaaacaattaggaaggaaagagaaagaagaaacaactgttgccctaaagaaaggtctggtgtacttagaaagtagtgaactattttttaagcctttgcatgtgataaacctgttaaaatactcttataaccaattcaagcttctagttggccttaccgaaaaataaaccgcggcactggaaaaattatagaagttaggtaaaagaatataaaatttgaatcagctagtttattcctccatctctaaaattactgtaataactttttttttttttttttttggaactggagtctcgctgtgtcacccaggctggagtgcagtggcatggtctcagctcactgccacctccgcctcccaggttcaagcgattctcctgcctcagcttcccaagtagctgggattacaggcacaggccgccacacccagctaatcttttgtattttggtagagatggggtttcactgtgttgcctggctggtcttgaaatcctaagctcaggcaatcctcccaccgtgctaggattacagttgtgagccactgcacccggccactataataactttttttttttttttttttttttttttttttctgagacggagtcttgctctttcccaggctggagtgcagtggtgcgatctcagcttactgcaagctgcgcctcctgggttcacgccattctcctgcctcagcctcctgagtagctgggactacaggcgcccaccaccatgcccggctaatttttgtatttttagtagagacggagtttcactgtgttagccaggatgatctcgatctcctgacctcatgatctgcctgccttggcctcccaaagtgctgggattacaggcgtgagccactgtgcccggcctataataacttttaaaagtgttttgtttattcttcatgttctttacagaagacttcccacgaattctaagattctcaaagtattccaagaatacttagaatgaattatgttgttcatttatacaagatctatttgtatatcaaggaattaatgatttaaataagaaggattcctattaagtaattaagacaaaactatcaatacttcctatttcttagacaaactgtttttaagtatgataatgttgattttctgttaaaaacattttacattttgcttattcattctagctagcctactacatttttgtttgtatgcctaatcccagcatcagttatccataattagtaagatttgtgtccataaaaatagaagctatttaggaaggaataaatgtgatgtcaaacagatctgagttacaatctctactgtgtcacctaataactaagcttgtcatttaacctccctatgcttcagttcacatgcctgtaaacttggtagcataataatacaaagattatgagaattagaggtaacaaatataaaacatatagagcagtgagtggccccttatgagcactgagtaaatatttggtgtgtgattgttgttgtggtggtggttgttatatagaccttaatttgagagagagagactatacctcacaagatagctgtgatgcagaaaacagaatagttaacacttgacaaatgtgacttgtgttatcaacggtgaaagcctattggtatataaataaagctttgccttttctttcattttcctttcttgtttaaaggattctggagcagatgccctggagttaaatttatcatgtccacatggcatgggagaaagaggaatgggcctggcctgtgggcaggtaaggaccttgacagctgccactaagtatgtcagtgtgacataacaggcccccgtatggatagttactataccttaggcaaggagatgcatggatcagatgactggctagagacttccaggtctgcattgtttaaatatttagtgtttaaaaagtggaaaatgagggaagctgaaattatagcaactgtttagttttattgaggaaaatatcacattatgtgcttgacaggaagtaatatcataacaaatagtttttaaaagcgctgaagcagaattagctgatttcaaatgcagtgttctttattcattcctgatgccgatccagtttccctggagcaatatactgtacaaaatgcattgttcgtagtgattttgtagtaaatggggcacggcacaaattgcattttacattttttagcatacgatcattattcactaactgtgtttggggagttgcaaaaagactttgatgctatttttatttttggatacaataaatggaaccttcatactaaaatactttcaaaagcctaatgaacaaaatgtgaaataatatgttaatatatagaaaacactgcatctttatgtaactagttaaatgttggatgttaaggagcactgtaaaaacttaatgctaaaaaggtgagtattttgcatcttataatttaccttttaagcccagaaggaaatggtgtgaattaaataatgtgaaatgtagtaatttctgacggattgtctagtcctggaaagtttattttatctccatgtctggcacaggatcttgtacttagtaggtccccacctttttttttttctctcaagtcatcaaattgatttgaattaaactcagaggcccttaatttgggagggcaaacatttctgcttatttaaatgaacatagattgctatctttgtattagcattcaggaagaattttaaagtactttgtaaatatttaacatgcagaatagatttgtgacttaaggagaaaccatttttatgtaacaacaagaaaggagggtctagtcaaatattcttcaaatatattctctgttccactcacaacaggttgcccagaagatcagtaactatgatatatgataacagaaccaagactcagaactatctagtatagggaaaacatgacattgaatcgtgacttttatgagtcacatgattagatagtagcatttaagtaatgtgattaaaatgagaaggattccttaaaggatacctggaatgggggctgagttagtattcttttcccatctcaagtcaagattgtccctccacttgtttcacagtctgtgaatctcagaaccgaagtattttttagctacatggatagaaacaactacggaggttttaaatctattgattgctttgttaggggagaatgcaattcaatatttctctcttaccacaaatacgacaattattttgaaaatgttgccctagtcccacctgagtttattttttggagtaggcttttgctatatgagcacatctgaatttactcagccattaagtgtcttaggtgcatcctttctggagagttatttagccacataaagttttgcacagcctttggctgaatgagaatgccaaatgctaaaactttgcaatcagagatatcattaagctttctaaaaactcttggaaaacacatgttccaaaaaccatgatatcttggctgaaaaaaatttaggaacatttccatttcacttattagttataatctctacaactgaaaccaattcttcatatcagccaagtttagaaattttcttttgaatgatattctcttgtaaattatatgattgaagaataaagctaatttaatcatttttgttccaacatattttaaatgatttctctgcctgaggacacatgaatgttccatattttaaataaagggaaggcagaatattagtgcattttaaaaaatgcttttctgtgactctgactttctgaagtgagcacaaacacacttgggcttatttgccttttcctctagttccttttaccccttctctgcctcctattcccattgcttctccctttacctctctaagttccaaagtcttgaacacttgccaattggtggggtgcagaatttatactcagtggtgggggactgaagagtcattctagtccctcttccccattgctatgtgatcttgcatttcatctgttgaaaacttactatgtgctaagcacagagctgcatgcatggtcagagcctgattaatatttgcttcacgaattagacatgctgtcggttccatggctaaaatatttatctgccagagacactttcttgttcagtacacattcctctctaaatacttgatttttttctcctttatctcaaatattttctcacaaatatttaatgagtgaaaaatgctgcctttgtacctaagtaatttgcctgtgtgtaatcaacattatatagatgtaacactgatatatatacatatatataagcttatatatacacatctatataaaataagtgattaaaaatcatgaaatttatgaagagggaaggccgtaatccatactctgcaacattatgggttccatatttatttatgaaatttatggaaacagaatctcaagctgaccttgggaaattgcattgtgtattcctgcaaaacaaagcttcatatcaaatcttaaaacacctcagcattgctaagtgtttaaaagtagtctcatgtattcattccatcagccatctgtgtcacctttatcaagccacttgctctcctgaaggataagtgtccatctctaaaatatgggatttgaactaaatgatctttaaatctcctttaagctttaattttctgttaatgttaacattaaaaatagcaggctactgttatttttaaactaactttaaagagcattgttaaaacaaaaacaaagaaataaacaagtgcatattgtgttgctctttttaaaaaaaaatttgctttaagttctgggatacatgagctgaacgtgcaggtttgttacataggtatatatgtcccatggtggtttgctgcacctatcaacccatcatctaggttttaagccctgcatgcattagatatttgtcctaatgctctcagccctctgaccccccaacccccaacaggccccggtgtgtgatgatgtttccctccctgtgtccatgtgttcttgttgttcaactcccatttatgagtgagaatgtggtgttttgttttctgttcctgtgttagtttgctgagaatgatggcttccagcttcatccatgtccctgaaaagcacataaactcgattttttatggctgcatagtattccatggtgtatattgtggaagacagtgtggtgattcctcaaggatctagaaccagaaataccatttgacccagcaatcctattactgggtatatacccaaaggattataaatcattttactataaagacacatgcacacgtatgtttattgcagcactatttacatagcgaagacttggaaccaacccaaatgcccatcaatgatacagtggataaagaaaatatgttgctgtttttaaaaacactaacatttctttagcctgcattaaggcagtattttacttagtgattcttgtttttactaatgcttaccctaactaatgctgctcgctttttggtatattttactttgatgaatgagaatctaggcagcagttgctcaaaaaggctatgattggttaagtggacatcttgtacttaaagtggctagaatagaacccttggtcttttatactggaggctgcgcttccattttagttaacggtgtcaataaccctgatgcttaagcaaaggtgaaaatatcattcggctttggttgcattcattccaaagaatcaaagttgtattacagcatgaaaaataaaatatgactcttcttccattccctcccaacaaccctctgaagccggttgagtttttgttccatttttcacaaggcagaggccctcgagtttcccaggtcaaagatttggtcagtggcttctagacctgcactttgatttgatattagcctgaataaagggaagttgtctagaacagttcctaataagtaggtattgcaatatcaatgttaagtatcagtattgttaactgaaaattaagtgcaggattacataggctctaaagttgtctttataattctatttcatttctctaaatatatgaaactacaagcaaacctgaatccactacttaggttctgtctcctgcgactcaaggtgcttctctggtgtattagcatccaaatttaaagttgtctacatgcaatttatataattccattttctgtaacagcatattacttaatagatttaattgttttataaccaattctgtaaaattcagccaaaatgacacctttttgaggttttccccttttcctacatgctacatgttcttaccacattgagtactaaccctcttttagcctactaaaattatattacatattttacttccatcctgcagaaccttcttacccagttcaggctagtactgaatagacctcgagtaggcctttgtattgttgtggttgttgtgtttttaaaattattgccaacaataggtggcaaaaaaatcctattatttctgttaaaataatgacaagatatggccttccctggcctgcattgtcatgcaacaataacaaggtagaccttaactaggctcctctgacactgtttctggtgcatgtgaatagtagcaaacatttgactaagaatatgtgctcattctcaaacatgaatttgaccagtatatatctttctgattcaccttttaatatcaagaccaaccttccccaggagttctactgaacctctgagttcctgacattgttgtctttgggctgccttctttggccagcagtacctttaattcttagaccttccatcagctatcaaaagaaaaatagttgcccaggagctataaatggagtgagatatgtggtaagaggccttgccttccatatggcaataaagaagagcaagatgcagcatgctccacaggacttctcaatgctagtcatataaccctcttgggatgattttctttttcctgccatcagaaaacctaaagctgcttacttcttttccttgagttgatgacggggcatagtaaagcacagaattttgtgactgagaagaaccttaaagattttccaattcatctcccttatatacaggataggaattaaggaccagaaaagtgcttaatctgccttagcctaaggtaaccaagtagcaagtcccacagctttagtgcctttgttactgacccctgtctagtgttctgtctagtattcccaactgtgttattttggcgtatcaaagtttctggtcaagcaggaaaagtcaacgcattgccctggctactccctactatacctttttgcatacaattattattccttctgcttggaatttataccttctcagctggaattatccaaatggaaatcacctctctaattctatttcaaatgacattctaattcatgagctgggtgtatattatcagtcaatcaaactttccatgaggaaggaagaagaatatatgtgaaagggtttaaagatagaaacccagtgcatactcacatttgaatctgtagtgacctagagcttgaatcactgtcaaagaatttgatttctttacctaacagttccaagaggctacaaagatgttatttccctagccctcgatggattccaattgttcagtggtttgagtgccttcattgtaggtatgattgctaaagagtgaacaactatttagtatacactcatttagtaatgatttctttggatagaaagttcaaaaatgatagtataatcagagagaagactgccgtagctttacaggcaaataaggacctgaacaaagatggcagtacaaccgctatcatctgttatatcttgccacctcacagtccccttcctgcgtttaatcatattgttcaattctatgcatagaatttttaaatattagaatgttcaactcaaacagtccaaacattagttttgtcatcagggagatgtatgaagtcctgctttcatgacgatttagctaagcaagaataaaaggtttaaaagtggtaaaccttaaaattgatttttaaagattattactccaaataccacccagagcaatactttgataattctttcacgatctgttctatgttcaaacttaatttgcataaaactgtatgtttttttttttaaaaaaaagagagaggctttgtttctgtttcaacatgccagcattttttcattagacattaaccacagattattactcttacccttgccagaaagcagacgtccgtcatcaggaagagaatccaaaccaagtgtgaggaccacagtgccccagatgtgctagaatttcccctgggaaataaagtcttccttcagcagctggcttagcagaccctctatctcatatgcaatgcagtgtccagggagcaatgaccacagccctgcttggatcagacccccatagatgtctgtggaggagacaatatgaagacacttttttaaaaccaaaacagctgaaaagtcatagtattttccatatttcccagagttgaaactcaggagtttgggaatataagaaatcccaaaggttagagaaaagaatgtgggagccccagcacttgtaaaatacaacaaacttaagccacagtagcctccctggcatctcatggagaatctaaggtgaggatcactgctgagttctgttcgctttttgatactgattaggtatgtgctcctgagacatcttctgcaggttcttgattcttctcattccttgtgacttaagcctctatgagctatgtatgtggagaattatcctgaatgtgatgtttagttatgccggaatcagcatggacacatgtaggtttgggctagagagttggaactccaggtctatgatttgacttgataagtatgggatagactaggttggcctcagtgggatgatcccctgaggcatcacttttatgggtttgaaaatcattgcactatgaaataacatagttccatgaagaaacatgagaaatgactgtgtggtataagcttctgcaaaagtgactaaaatctgatgttagccatattcattggattcatcctattttattttcctcatagcattataatttttgaagttctttaaaataaattatccacttgtttatgagaaaaactatctctaatcaaaaaaaatctgctttatactatattatgttgcccaactttttatttgattttaattctcagccatttgatagacatgggtgcttacataagtagataaactacaggaaatctgtaagagacatttatgtaactgccaatattttgcctacagctggttctctatgagtttttcaattatagttattaatgttggtaatgatgtaaaaatttttgctgcttttaaaagttgtaatttttttagttgaaagcaacaccgtttaaatctaactgaattatcagttctaggtcaggaaatattgttgtttttgtgtagcccaaccattatgtggcagtaaaaaacattatatataggccaggcatggtggctcatgactgtatgccagcactttgggaggctgaggcaggaagattgcttgagctaaggagtttgagaccagcctgggcaacatggcgaaaccccgtgtctgctaaaaacacacacacaaaaattagctggatatggtggtgtgcacctgtgtttccagctacttggggtactgaggtgggaggatcacttgagcctgagagacggaggttgcggtgaactgagatcacacaactgcactccagcctggtgaatgttacaggaaaaacagctaactatggatttttttaacttacttggtttttattgttctcatttgttttattccagaaataagcaacaaaagtattttttaagttttttaaaaatcaccctcaaatatttgttcacatcacagtgagtttgagaaatatagcagaattctctatgtatttgttgactatagcataaggatgaaataaaaatgtcataaagagagacagagacagaggtgagatggaggagaggctatggtcttagttcatgatttcatgaagagttcaggtaatgtaatgtcacagaagaataatagagattgtcagggcagagtagagacaaggtgggacaccaagattgctaagaaatgaatattggcaggaaaagggagggtctagttacgtgatctgactggcctagaatattggaagaactggtggacaagactgagtcatgtattagaagccacaaatgactcgagagtaaaggagactgcatttcaggctaaaaagcaatattggaccagaaaactagtaagtactcagcggctgagagtagagccaacagagttcaagataaggcaagagagaagataaggaataagacaaattaaacgaaggtatcagaggcaccaccttcacaaagaccttaaaattaaggtacttctaccgcaaagagaaatttgtacacgcttcctgctgaggtagtcagtcttttatggtgcagtcagtttaaggtttccaactgcgataggtgagctgtcaggaaggaggcgtatggatttgcctgactagagaaggagataaggtaagtcaagaaaaataaagttattaaaattacggcattttacaacttaggagtattggctgaagactgaaggctcttttgtcatgatcattggggaagccatattctctgagaactattacaaccccccagacaaacacgaggtggtgcttattgataatcacagattttataccaacatgaagtctctcttgacattgtttatattgcagagatcttattgaaaattttgttttatacctaactttgtttttgttctctcaccaaaagcactttaagtatcagtatgcttaatgaatatatgtactctccaaaaaaaagttttgtttaaggaaaaatcaatttaaagcatgaattacaattttactgtctttgagatgtcttaaacatctttgactctttcctcatgttatttatttatttttttctaggattgattgcttgagtttttgcccctttctccctatttgttgctactgggtctattcagttttgaaagtcctcatagataggttgcaaattccattaaccttagtatgtgttcatgattcatcagaaaagaacatgcagctttcttctcttatttgtaaaatgtctaaccttctattaagtgaatggaaaactttgttgcaattttcctttgccaacattttttctttccttgaccacaccaaaactgtaaacaacatggcaggcttggcactcctgtttttcctgtaattgtgttttgggtaacatggaagaaattgatatatgaagggataacagtatcttttctcttctaatatctgtatagatatagatatagatatagatatcatggaatactactcagccataaaaagaatgaaataatgtcttttgtagcaacatggatggaactagaggtcattatcattttttatacgtataatttaagttctagggtacatgtgcacaacgtgcaggtttgttacgtaggtatacatgtgccatgttggtttgctgcacccatcatctcatcatttatattaggtatttctctaatgctgtccctccccctgctccccaccccatgacaggccctggggtgtgatgttccccatcctgtgtccaagtgttctcattgttaaattcccacctatgagtgagaacacacagtgtttggttttttgtccttgtgctagtttgctcagaatgatggtttccagctgtatccatgatcctgcaaaggacatgaactcatcctttttttatggctacataatatccatggtgtatatgtgccacattttcttaatccagcctatcattgatggacctttgggctgcttccaagtttttgctattgtgaatagtgctacaataaacatatgtgtgcatgtgtctttatagtagcatgatttataatcctttttgtatatacccagtaatgggatcactgggtcaaatgatatttctagttctagatccttgacaaatcgccacactgtcttccacaatgattgaactagtttacagtctcaccaacagtataaaggcattcctattcctccacatcctctccagcatctgttgtttcctgactttttaatgatgggcattctaactggcatgagatggtatgttattgtggttttgatttgcatttctctgatgaccagtgatgatgagcattttttcatgtgtctgtggctgcataagtgtcttcttttgagaaatgtctgttcatatcctttgcccaccttttgatggggttgtatgtttttttcttgtaaatttgtttaagttcttgtagattctggttattagccctttgtcagatgggtagattgcagaaattttctcctattctgtaggttgtccgttcactctgatggtaatttattttgctgtgcagaagctctttagtttaattagatcccatttgtcaattttgccttctgttgccattgcttttggtgttttagacatgaagtcctttcccatgcctgtgtcctgattggtattgcctaggttttcttctagggtttttatggttttaggtctaacatgtgagtctttaatccatcttgaattaatttttgtgtaaggtgtaaggaagggatccagtttcagcttcctacatatggctagccagttttcccagaaccatttattaaataaggaatcctttccccatttcttgttttcgtcaggtttgtcaaagatcagatggttgtagatgtgtgatgttatttctgaggcctctgttctgttccgttggtctatatagctcttttggtaccagtatcatgctgtcttggttactgtagccttgtaatagagtttgaagtcaggtagtgtgatgcctccagctttgttctttttgcttaggattgtcttacctatgtgggctattttttgattccatatgaactttaaagtagttttttccaattctgtgaagaaagtcattgatagcttgatggggatggcattgattctatgaattaccttgggcagtatggccattttcacgatattgattcttcctatccctgagcatggaatgttcttccatttgtttgtgtcctcttttatttcattgagcagtggtttgtagttctccttgaagaggtccttcacatcccttgtaagttgcattcctaggtattttattctctgtagcaatcgtgaatgggagttcgctcatgatttggctctctgtttgtccgttattggtgtattggaatgcttgtgatttttgcacattgattttgtatcctgagactttgctgaagttgcttatcagcttaaagagattttgggctgagactatggggttttctaaatatacaatcatgtcatctgcaaacaaggacaatttgacttcctcttttcctaattgaatgccctttatttctttctcttgcctgatggccctggccagaacttccaacactatgtgtaataggagtggtgagagagggcatccctgtcttgtgccagttttcaaagggaatgcttccagtttttgcccattcagtatgatattggctgtgggtttgtcataaatagctcttattattttgagatatgttccatcaatacctaatttattgagagtttttagcatgaaggctgttcaattttattgaaggccttttatgcatctattgagataatcatatggtttttgtcattgattctctttatgtgatggattacatttattgatttgcgtatgttgaaccaggctggcatgccagggatgaagttgacttgatcgtggtggataagctttttgatgtgctgctggattcgctttgccagtattttactgaggatttttgcatcgatattcatcagggtttttggtctaaaattctctttttttgttgtgtctctgccaggctttggtatcaggataatgctggcctcataagatgagttacggaggattccctcattttctattgattggaatagtttcagaaggaatggtatcaactcctctttgtacctctggtagaattcggctgtgaatctgtctggtcctggactttttttggttggtaggctattaattattgcctcaatttcagagcctgttattggtctattcagagattcatcttcttcctggtttagtcttgagagggtgtatgtgtccaggaatttatccatttcttctagattttctagtttacttggtagagacgtttatagtattctctgatggtggtttgtatttctgtgggatccgtggtgatatcccctttatcatttattattgtgtctatttgattcttctctctcttcttctttattagtcttgctagcgttctatcaattttgttgatcttttcaaaaagccagatcctggattcattgatttttttaaggatattttgtgtctctatctccttcagttctgctctgatcttagttatttcttgccttctgatagcttttgaatttgtttgctcttgcttctctagttcttttaattgtgatattagggtgtcagttttggatctttcctgctttctcttgtgggcatttagtgctataaatttctctctacacactgctttaaatgtgtcccagagattctggtatgttgtgtctttgttctcattggtttcaaagaacatctttatttctgccttaatttcgttatttacccagtagtcgttcaggagcatgttgttcagtttccatgtagttgtgcaattttgaatgagtttcttaatcctgagttctaatttgattgcactgtggtctgagagacagtttgttgtgatttctgttcttttccatttgctgaggagtgctttacttccaactatgtggtcaattttggaattagtgtgatgtggtgctgagaagaatgtatattctgttgatttggggtggagagttctgtagatgtctattaggtctgcttggtgcagagctgagttcaagtcctggatatccttgttaaccttctgtctcactgatctgtctaatattgacagtggacagtggggtgttaaaatctcccattattattgtgtgggagtctaagtttctttgtaggtctctaaggacttgctttatgaatctgggtgctcctgtattgggtgcatatttatttaggttagttagctcttcttgttaaattgatccctttaccatcacataatggtctcttttgatctttgttggtttaaagtctattttatcaggtactattattgcaacctctgctttttttttgctttccatttgcttggtagatcttcctccatccctttattttgagcctatgtgtgtctttgcatgtgagatggttctcctgaatacagcacactgatgggtcttgaatatccagtttgccagtccatgtcttttaattggaacatttagcccatttacatttaaggttaatattgttatgtgtgaatttgatcctgtcattatgatgttagctggttattttgcctgttacttgatgcagtttcttcctagcattgatggtctttacaatttggcatatttttgcagtggctggtactggttgttcctttccatgtttagtgcttccttcaggagctcttgtaaggcaggcctgctggtgacaaaatctctcagcatttgcttgtctgtaaaggattttatttctccttcacttatgaagcttagtttggctggatatgaaatttgggttgaaaattcttttctttaagaatgttgtatattggcccccactctcttctggcttgtagagtttctgctgagagatccactgttagtctgatagacttctctttgttggtaacccgacctttctctctgactgcccttaacattttttccttcacttcaaccttggtgaatctgacaattatgtgtcttggagttgctcttctcaaggagtatctttgtagtgttctctctatttcctgaatttgaatgttggcctgccttgctaggttggggaaattctcctggaaaatatcctgaagagtgttttccaacttggttccattctccccatcactttcaggtacaccaatcaaatgtagatttgatattttcacagagtcccatatttcttggaggctttgttcgtttattttcacttttttttcctctaaacttcttgctttatttcattaatttgatcttcaatcactgataccctttcttccacttgatcaaattggctattgaagcttgtgcatgtgtcacgtagttctcgtgtcatggttttcaactccatcaggtcatttaagtttttctccacactgtttattctaggtggccattcatctcatcttttttcaaggttttaagcttccttgcgatgggttcgaacatcctcctttagctcagagaagtttgttattaccaaccttctgaagcctacttctgtcaacttgtcaaaatcattctccatccagcttttttctgttgctgccgaggagctgtgatcctttgtaggagaagaggcactctgatttttagaattttcagcttttctcttctggtttctccccatctttgtggttttatctacctttggtctttaatgttggtgacctacagatagggttttggtgtagatgtcctttttgttgatgttgatgctattcctttctgtttgttagttttccttctaatagtcaggtccctcagctacaggtctgttgaagtttgctggagctccactccagaccctgtttgcctgggtgtcaccagcggaggctgcagaacagcaaatattgcgacctgatccttcctctggaagcttcgtcccagaggggcagctgcctatatgtggtgtctgtcggcccctactgagaggtgtctcccagttaggctacacgggcatcaggggcccacttgaggatgcagcctgtcctttctctgagctcagacaccatgctgggagaaccactgctctcttcagagctgtcagacagggatgtttaagtctgcagaagtttctgctgccttttgttcagctatgccctgcccccagaggtggagaccacagaggcagccagccttgctgagctgcggtgggctccaccgagttctagcttccccagctgctatgtttacctattcaagcctcagcaatggcagatgcccctccacctgccaggctgctgcctcataggttgatctcagactgctgcgctagccataagcaaggctccttgggcttggaatccactgagccaggcgcaggatataatctcctggtgtgccatttgctaagaccattggaaaagcacagtatttgggtgggagtgtcctggttttccaggtgccatctctcacggcatcccttggctaggaaagggaaatcccccaaccacttgtgcttcccaggtgaggtgacacccccactgcttcagctcatcctcagtgggctgcacccactgtccaaccagtcccaatgagatgaaccaggtacctcagctggaaatgcagaaatcacccatcttctgcattgatcatgctggaagctgcagatcggagctgttcctattcggccatctcagaatggaatcctagaggtcattatcttaattgaaataactcagaaacggaaacatattctcactcataagcaggagctaaataatttgtacacatggacaaagacaatggaataatagtcactggagactcagaagggtggaagggtggaaaagggttaaggtatgataaactacttaatgggtacaatatgcagtatttgggtgaaggctatacagaaaactcagatttcaccagtatgcaatatatccatgtaacaaaactgcatttgtatcccgtaagtctgttttaaaaagatagtactggaagtccttaccagaccaatcaagcaagagccttaccaaaccaatcaagcaagagaaagaaattaaatgcatgcaaataggaaaagcagaagtcaaattgttgctgtttactaacatgatcttatatgtagaaaatactaaggattccaccaaaaaaaaaaaacactgttagaactaataaattaacacagcacagttgcagcatacaaaatcaataaacaaaaatcaatgatgtttctgtacattaacaatgaactatatgaaaaagaaatcaaaaggaatccatttaaccaaggaggtgagaaacttacccatatactaaaaactgtaaaacatgatgaaagcaattgaaaaagatacaaaaacaaatatatcttgtgttcatggattagaagaattggtttgttaaaatgttcatattatctcccaaagcaatctacacaatcagtgtaatacctatgaaaatttaatatagtttttcatagacatagaaaatataattctaaaatgtgtatggaactgcaaaaaaaccctgaatagccaagtcagtccgagcaaaaagaacaaagctgtggacatcatactaactgattctgaactctaccaccaagtgatgttagttaaacagcatgatgttggcataaaaatagactaattgaccagtggagcagaatggaaaactcagcagtgaacctattcatatatagtcaattgatgttaagcaagggtgccaagtataaccattggaaaaaggacatcttttcattaaagggtgttgtgaaaaatgtatatccatgtgcagaagaatgaaattagatcattatctcacagcattaacagaaatattatcaagtggattaaagaggtaaatgtaagaccttaaactgtaaaactactagaagaaaatataggagaaaaagtgcacaatattggtctagataatgattttttaattttttaattgctggagctccactccagaccctgtttgcctgggtgtcaccagcggaggctgcagaacagcaaatattgcagaacagcaaatattgctacctgatcacaggcaacaagtgcaaaaatagacaaattggattacatcaaaataaaaagcttctgcacagcaaaggaaacaattaacagagtgaagaagcaacccatggatttgaagaaaatatttttgggccataaatctgataaggggttaatatcaaatatatataaggagactaaacaactctttggaaagaaaagaaatagtttgaataaaaaatgagcaagggagctgaatagacatttcttaaaagaaataacacaaatgaccaataggcatatgaaaaaatgctcaacatcggtgatcactaggtaaatgcaaattaaaaccacagtgagatatcactcacacctgtcagaatggctgttatcaaaaagacaacagataataagtgttggagaagatgcagagaaaagggagccctggcacgctgttggtggaaatgtaaattagtatactttttatggaaacatcataaaagttccccgaaaaaccaaaagtagaattaccatatgatccaacaatcctacttctgggtatttatgcaatagatttgaaatcagcttatcaaagaaatgtctgcatgcctatctatgttccttgcagtactattcacaataggcaacttatggaatcaacctaagtgtctatcagcagatgaatggataaagaaaatatggtatatatacacaatggactactattcagccttaaaaaagaaagaaattgtgtcacttggaacaatatgactggaactagagaacatgttacgtgaaggaaggcaggcctagagagacaaatattgcatattctcttacatgtggactctaaaacaatgaaacaatctaaaactaaagaaacagaaagtagaatggtgattaccagaagctcggggtggggagaatagggagaagatggtcaaagaatagggaggagatggtgaaaggatgtaaagtctcaattagacaggaataataagggttctttttactatgagatatattgtaaaacatggtgaatatagtaaataaccatttattgtacatttcaaaattgctaagagagtaaatttcaaatgttctcaccacaaaaagtaagtattttaggtgatggatatgttaattaacttgatttaattttaacgtatacattgtattcataaattgtaacatcacttggtaactcaaatatatacaacaataatttttcaattattaaaaaataaaatttcaaaaatgaaagattttgaatattaaacatatacctattattcctatagagatgatagatttagaatacataaagtgaaatatagtttccctttaggtagtaaataagtgtgtcttaaggtgattgcaataaaagtatagttatcatgatgtaaatatatcccaaaataataaattcataaatgatttttatggtgattagaaactgattttattcagtcagttccctttgtattctaggcaaagtgcctatttctacacatgggatcacattcattcctcaatcaactttgagggggaagatagaatattctccacatgaaaaataaagaaactgatggtagagtgacttgttccccattgattctccagggattaatgtgattaatgtgatacatggcaggtattcagtaaataatttggggatagattaatgaatgaacgaatgaatgagtggataattgaatgaattcacctttgacacaaaatgtcttttcgtgtcattggcagtgagaagatcctgagaaggattgttcttgagtatgacccaggaaagtagttctgatttttttaaattgagaacttacatttcaaattaattttcttccttctgtgaccactctccataacttgttctgattttttgctatctttccaccttctactattttaagcttcacatgtctgatttctccaacctaaatatgtttgtccttgtccagaattacatactacttatatatgcatattattaacaattttctgtgatctggaccatctttttcaaaatattttatctttggaactcaaaaatcattttgtttaagaatgagcattttttgcattttgcgttttactataggagtttggaggatgaaagatgtcaaaacagctgactgtgacttccttttacacatctgttgtcctatataagcaagggttgtatccaaggatgagaggacagaaagagaaagtgcactgtctagcctggtcttttgtggaattaagggatgcacttttcagctgtctctatgcctatgaccaaatggcgaacggttctggattacaaatgccctaatgtcccatcatgctttgttgagagcaggtacaacacctgacacctgccgtgctttttgtttagcaggctctcacccaagggctaattcatttaattctcacagcaattctatgatatatttactattattgttcccattttacagatgaaggaactcagaaagggtaagtaacatggcagggtcacacggcaagtcagtggcctcatctggacccaaatctcggccatctggctcaagagcctgtgctcctgtccctcagacatgactgcctctcaaagaagaattttaaagaagtaatccctggctttatcaatcacagaaattattgatagatatcttgatgatgcatttcagtttgaagacagtgctatttgtggaagttatgaaagttcctctatataaatactaccgaaaagtccagtttctggaaaatgattgctgaaaatgatttgtatggtctctattttttttgagacttttaagtttttctgcacccaaaattcatttctaaagagaaactgtagcatagaaaaaaaaaaaaaaaacagaatgcagttttccagttattaatgttaattgtccaagtcagattttatgtttaaaatccatcttttggtggttgtttactttgacatgacccctgccttaaaggagggtatatgtagtttcagattaagaaactgctctggacagaagtttattatttaggaaaggctttaaaagggggaaaaaaccccaccgaggtgtcttgagagttaatacaccccttcttcaaacggtgggaagcactaaatatgcagagcgccatccagcaccacaagtgctcctcctgcccttgcctgccattccgcagccctgcccctctacaaatggtagatcattaagccatccaggcagtgaggagtattttcatatagctactgccctttatagcagcctggcagcgagtgaccataataaattatgcactgctctgtgagactgtgacacaatgcactggaggaacagcgggggtgttagaaaatccattatttgaaatttttgtttctttttcttactagattccatgctgctcttttcctgtcatcttgttcctttttttcctatctattgttttgagggttttgtgtctgacagttcttttctactgctggttttgtcctttttgttaccttgtttctgccttcatgggctcccccaccccccttgcttgatcttgtgtgttctgagccttgttctcctttctgtcatgcgtcgtttgccttacttttctttctctttccgccttattgtctcatataatacagaaaaacaaattctctttttgcctgcattcttttacatggtgttatgtagttgtcattttcccttcacgaaaggtgcactttactgtatgtactattcattttggttccaagaaccccaaacacgtgtccggaggagtgccaatgctgatggcaataaaaaacaatcaaacatcatcccacaaagtagggaaggggaaaaaaaaatcaaacaaccagagtagttttttttgaaaacagtgtagacctatttcttccctgtagatcagttcacatagaatctgtaagattttttttttttttttactatttcaggttgttcaatattttcctcttttctccaagagcaagtcttttccaaagtgacaaatttttgacactatttcttgtaaatccagctgtctgctcattctttcattgtttcccactgatgagtacagcctgaaaagatagttccactaagtggaattcagttaattcactgattcatttaattcattagttattaattgagcaactattaggtagcaggcctcatgcagatgttagagacactgggaaccatcagtttaggttttgttcaatcttttatattccttagttggttatgtccatcattcccaatttttctttcctctttgtgtggacacgccacattggcacttgttgtctgacctcctccactttcacttccttgatccctttggatctagagctccttctttttatttagagttatttgagaaggacttttttctgcttgaaaatctcactgcatcattttagaaagttcaaacctccttggcagtgaataccaaagaatgtgccagattctttaaccccatttttgtgtcacactcaaaatgaaataaaaatagtaatctccacctctggtatggctacaaatttttgtaatacttgcagtagctgaattaaattgaattgagatgtatagttatgaaatataagtgagttacatcaaaatctgcaattcaattcttcttttacggtattgagttccttgttccttttaaatgtttttctccatttgcttttatttgcctgactgatttcctcttttataaacattctcttttctaatcctgtttctcctgaaacacgtttgattttgtttctctccctatcgtgtttgctaattctccattttttgccttattgtattctaagattaatgctgtttttatttttgttgtagttattattttaaataagattggggatagtagctcaaaaaagttagtgtactgtcttctaccacggacatgatttcttctatctctgtattcatgtcctttataattttaacctttccccttgacctcatatctctaaatttccagttcagtgtttctttcattccatgatttatttttttcttttcttgccactttgattctgccctttacctttttcctgtatcaggcttatttttaaaagaaacattggttcttttaatatcattttgcaaacgccgtgggaacatcttctctcattttatttttactaattgggctttcagagtaaactctccaacttgtcatatagttcattttaagcacctgcaagaataagtcagttgccctgtcagcttccagatgcagtggaatgttcatgttagatcttacatatttcaaacttctaatttttaattactctcttctcggtttggagaagagggaggaacagatataaagagctatgaagttttgaaagagagataataaactgaaaataaataagcaaatgtgataacggggacacttgcttccttagaggatgtcacagggaaattatttatagtggctgaataggagatacaaagttcagcaaacctcccacagattctttcctgaaggccacgacttcctgtagccaattgcatcaaacatagtggcttttctataagttcaccatatagagtttcattcatttcattactaaaagactcagccttggtaaggcactgctcccattttacaagtctttgacatgacacactcatttttaaaagcacacagtatcggttgctgttgaatctcatattgcatttctattgaccagattccagttataacataaacacttgggtaaatgattacattttaaagtcagtatgtaaaacaaccctgaacaactatgtcagatgtttttaaattttttctgattttgtgactcacagcattattaataattgaaactctgttctggctgtgcttaactagtgccagttttaatacaaaacctgtcatatttaaacacaactgctccaataataagctattaatatatcagttaatttatttcactgacccctgtaacctaaacttttaggtcaccttggatttgtcaaatgggatggctgcctacaaaagttcagtcttatatatggaggagtaaatataaaaatgttatgagcaacccacattccattataaattgtaagcatagaaagaatgtaagtaaatttgaatgactaaattatttttaagtatcagttgtatatagtactaagcttcagattagtactaaacttcagattagaaaactgtttaaataagacattttggacaaaagcctatggtttgagtatttaatatgttcctccttaccagctatatcccagccagtattacaataaagtttaattctttttagttaaaaagcagatttcaattttcccatggcttcctttctttttctttggtctccttctttgtcactcctacctctatctgtttcccagcctacaagaggagtggtcttcagctctgagactggtttctctcactgaattttgcttaaaaattaactttgtctttctgtttctttaattacatatttcttctctttttgcttacatagcatttctcttgtttgaatctgcagcattttttttttttttggattcttttagaatcattgccactttctgattcctcagggatctagaactagaaataccatttgacacagccatcccattactgggtatatacccaaaggattataaatcatgctgctataaagacacatgcacacgtatatttattgcagtactattcacaatagcaaagacttggaaccaacccaaatgtccaacaacgatagactggattaagaaaatgtggcacatatacaccatggaatactatgcagccataaaaattgatgagttcatgtcctttgcagggacatggatgaacctggaagccatcattctcagcaaactatcacaaggacaaaaaaccaaacaccgcattttctcactcataggtgggaattgaacaatgagaacacatggacacaggaaggggaacatcacacaccagggcctgttgtggggtgggggcaggggcgagggatagcattaggagatataccaaatgctaaatgacgagttaatgggtgcagcacaccaacatggcacatgtatacatatgtaacaaacctgcacgttgtgcacatgtaccctaaaacttaaaatataataataataaaattaataaaaagaaataactccaaaaaaaaaaaagaatcattgctactttcttcagtaagaacttgtaggattggctcacattgataatattaaatggttctcatttttgagagcttattttatgccaggaaatggttaacattttaagtagattatattatttaatcctcaaacaactctctgagctagtgtactattattcgtactttctagatcaggaaactgcaggatagaaaagttgagcaacttggctgaaattctacagccagaaattgaccacaggtttctgtactacaggactgtacacttaatcactactccgtagcttttctgtaaaatgacaccaggttatattacttgcttttcttcttgatgtcagaataagtgatttcctcactgtgtctttccttatcatgaattctgatgacagctcagagaactgaagcagaatagtgtccatattgggggaggggaagttgaagcctatggctttaacatctggatcaatattccccttcataccttctggctcccttctgtccgccaactgcatgagattgtgtcacacatgacagctcttatctctgttactagagtggccactttctaagggcaaggtctttatcacattctttttcatttccctcacattaccttgtatattaatattttccagataaaaggacagaaattgtaggccctgtggatgagccttccaggcaattctgctgttcagtactcaagctgtgccactgtttttcctcaaaattcaggaaaaaggaatagttcttccttccatgtaagccaggtgcagacaaagtggtctgttttgcaagaacttcattgttttacacaactgtgttttccttatttacggaaattggttacaagaaaggaagcaggataacttagctaagtagttaactgtttcttttgtagaatgcaacaatctcagatacttgaaaaggttttgcagaattttaaataagtgttcccaaagagcttatgtttttatttcaaattacgattcgacagcattcaatcccttgttattgctttgtcagacttttaattgaattattcagaacatgaaacaaaaggaaagaactgtagatatagcacagtaatattaacagaattaccagagtgctgagaattattaaagaggacattatgtttgttaatcgggcatttaatttttcttctgtttgttgatggaaaacatcctcttggaaaggattttctcaaaaaccttaattgtgacaatgccttcttaacatccatgaatatactgtacaagcaaaagctatttgaaatctaattagtcaaaaagattcctaatttccattttaactgtagaatggctgaccagcattccagtgagattggttttcagtacacaagagaaagctggccttccaaacaggctttagaaagtcagaaatgcaggaggaaaggttttaagctattacagactatagcaaaaaaaatgatatattgtattcttgagaatactgagaatgtttattgtggtctcactacaaaaaatgaagactgtgtgagataatgcatataagtagctcaatttagctattccacaatgtatatatacttcagaacatcatgttgtacatgataaatacctacaattttgtctgtcaattgaaaaaacaatcagtcaataaaaaaacacaatactccctcaatttatgagcccggtacaaccttgatattgaaagattagtgtaagaaaagaaattataggtcagtctcactcataagcatcaatgcaagatatgaaacaaaatgttaacatgcagaatccagcaacatattaaaagattaaaaagatgaatatggcatgacaacatggagcttatctcagtaaatccaggttggcttaaccgaaagaaaacatcatgtcatgtaagtcatcatattaacaagttaaagcagaaaaattatatgatcatctcactagatacggaaaatatgtttggtagaagtcaagattcattcataattttaaaaacatcttagaaaattgtgaataggaaggaacttccttaaagtgatcaaagatatttgcaaaatatctgctgcaaacatcaaacttaatagtgaaatgtggtaagcatgtctttaaaatcagaaataaaacaagggtgcctgctgttagcatattcattctacattgtactagatataaaatgccaatacagtaaggcttgaaaaatgaatttaaaataaagagataaaaaatgaaaatatcaggattgggaaaaatgacattattcacatatcttctgataatctataaaaaatatccaaaagaatccactgatttatatatttatatggatgtttaaaaggccccaaatcaccaaggcattcaataataataataaaataaaatattttatatagcatttatgctagacattgttctaagcacttaacatatattaacttggtcataaccactttcaacaattcttataaagctatatctcttaagataggggttttgacacacagttggataaattgagcaaactcgcagaacacagaactcgtaaagatacccagacagatatggaagcttgatttttgtctgagctatcattacaaaccagtgagaaaattttgaactattaactaaatactagtaagacaatcattatctatacataaaaatcaagtttaagtagatagacctttatgtgataggcagtacggtaaatgtttcaaaaacagtatagaaaaatgccttatggaccttataatctataaggattctttaaacaaggcagaaaatacagagatcataaaagtttgttaaaatttcttaatcaaaaaataccatgaggaaaacgaaaagacaagatataaattaggaataaacacttgttctacaaacaagagacagaagagtgatatttagaatatatgcatttcttcaaattcagaagcggaagacaactcaatataaaaactaaaaaaaggatcgagcaaccacttaagagaagatatagtaataatttaaaaactagaaacaaccaaatgcccatttatggtagaagagataaaaagacttgtaattatacagtggaatactttgtagcaataaaaatgaatgatatatggctatatggaaaacataaataaatctctgtgatataatgtcagattgacaaaggaagttgctgaagaataaggaagaatattatttcatgtatatggaagataaaaacatttaatactaaattatatgttctttggagatataaatgtatatggtaaaacttttaaaagcaaaggaatgagaaataaaaacttactttacctaatatatgtattataaatattcttttgcatttactgcattaaacaaaattttaaacctatttttacagttcttgcaacatgttgggaaagtcttgtaaaaaaaatcattaaaataatatgacccaagtgtaaatattgtttgtgtacttctattaggcaggtttcatagtgattaagagcacatatttcagaactggattgctgaattcaaatgctatgcatactatatgttatcatataaagcaagtgactttgcactcattttgtcttctgtaaaatgggttaataacagcattcatctcatggagttgtaatcaagactagaagccttcttacacacataattgcaagtgaggtacccatcacttttcttcctgctgttttctacctgtcaattaaaaagcattttctcgcatcccgacagtcaccgttatccagtctaggatatgagttatgagggaaaggtgattgagccattccacttggactccatttttgtgttttcaaaatgaaattttgcttggtgaaaggatttcaatgttttcttacttttgttttgatcacaaagtttaaaaagcatagttgtgaatgaacatttaagggtatacaaaaatgtagagcccattttgttgagtgaagaaaagcaatgacaaatagaatgggaagcatgattccatctcatctttaacactaatgtcagaatatacaccaaaaatattatggacagttttcatcttctttttgtccatatgtattttttaaaatgataatgcactcttcatgtaagcaggggaaaatgggacattaggaaaaaatatttttagccagttactaagaaaatgacaaacaattcagatttttaaaaatggatagacaatttaaagaagcaaaattaccaatggccggtaaacgtgaaaagatatccaacccagctggtcagaatggaaatacgaattaaaccaacacagatattatatttttcatcaactaatttggcaaagagtgattaccattagtgctatagagagtgtggggaagcagtcactttcatattttactagtggaaagtgaaacagtaccaccctttgggaaagcattttgcagcatctaagtaaatttcatggcatatacttttagtcccagcaggccaattctaaaaatctctcctataaaaattatagtacatgcataaacatgtttcatgtagttcaagttagcaccatttttaataacacaactggagacaaatgtccatccttaaagaacgttgagtaacttatggcatgtacacaatgggatactctgtcactataaaaaacagtgagatagatctctatgtcttaatgaaagggaaaaagtaaagcaattttcgcatatatcaatgtagtgtgtgtgtgtgtgtgtggtgacatatatagattatatataatgtaaagagaaaaaaattgaatgttaaaataacaataatacatgtattatataaagatgtacatatataaacatagggtttaaagaatgaaaagaatagacaccaacactactagtgtttagaacctctggtactgggaaaggagaactttcatttctttgtacaattgtctatatatgaacaattctcaacacctgtgtgttttattgttatcttctgagttatgaaatggtactgcatagcattaactcaagcgtgaatgttggtctgtctattcaaaaaataaaccatatttatttggaatcatactgccctacttctagaattccttagaatggttactagcaagtacttttggcgagattctctctctctctctctcttttttttatttttaagaaataatgaccaataataaattatcctcaattcatttacttaatctagggttccttttcataaaatactttaaaatagctattttccactaataagtgtaattctgcagttctatgtaaatattgaataattatgtattaatataattgcaattattagtgtaattttttaaaaaataagatgcttgtttaagaagctttaccatggaaacagcacatgaaactatttaccatttaccattggagtaaataggtagtaagtgatgatataaatataaacgagttaaaattttaaagacttacagacttttttaacttggcattgcttttgtgaagatttataatatctcactagctattttctacctatttattgtagtaaagggactttgttctttcatacctgaccacaaaagaaagccatttgtagctttagcactcatatattaagggagttgtatgctttttaaaaaaaattctcatggaagacataaacctaatcaaacctttctaccctctagctggtaacctctgcatgaactaaagagttgaaatattgtttaatcatgctacataccactttttacagttatgagaaacattattttgctgctatagaagcaacaaaacaaaatgtttttactctgtgttaaggacaagtatattttttaaattatttattttaaatagcatgatttcttatactacactttcattttctgtattttaaatattacttttagcaaaaggcatatttttaaaataatgataatacacatgcaacctagggaccagagaccctcatactgacttgtgcctcagataaacaacatgtaatttcagttggcaatctttacttgattccttcagtccaaactcaactattattaacctttgtttgtgacaattgaagagaataatggtggaatttggggcctttaatgtcacattgaaatcaatagctgtaaatggtagttgccacagttctaactgatctgtcacattcaaacaaaagaaggcctttctcagttcatagaagatagctgggacaattaaacacacacatacaagaatctcaaaagacttttataacattaaggaaatgtactgattcacagtattttttaaaaggctttgtttatttgtttgtttgtttgtttctttgagtgtttttttttcctctcctgaaattttaagtcaaatacaggagatgtaactgacttcatccagagatcaaaaagtgtgctctatcataaaaataaattgaattgttcttctcaaagtggtggtgatggtaagtggtagggggagtgatgataagctccttcatgagctggcaaggccagtaattgcaaaggccactaaataaaaacaattcaaaatccttgaagccagatccctgcatgccactgacagcacccttaccacgacttcaactcccaacacaaatgtatcttttagacttctgaacattcatcagtgctaaactttcagtgctcagttttgactttgtttttaattttcttattcttctggacatttggggaatgtaaattaaggggtttcagttcaagtttccatacatgactttgatacgcatatttgtcaactctgaacctactactagttataattggctgtacattgattaattccactaagaacataagtcgactttgcttagcactgtgaagctgtatgaagtaataagaatgtttcagtgattttctagaaagaaaaagccttagtaatttttatccttataataataacaggtttccaagttttattaaggcacaatatgaaatattcttattcactgaaataccattccaaccatcctttgaaaaattaaattagttgttcttcgaagtagaaactagaaagattcaatactacaagaatacaggagattaaaaggaagaaagtagacaagatcatgtatttaagtcgccttaagcaaaagtactattttttctcagcttacaattttatatgacaatttttcacacttaacattttccaaaattattagtttaaggactccattatttttctaaaaaattatacttctctgaaataaattcattgactcaagaagaacataatcaatttttaatacttcttttccccagtttatttcttctcactagagtatgagattctaaacttcgtcagatcagctacctggaacaaaacaactactatgctagtgaagcagttctcctgaaaacaaatctcctatttgtagcatttgttgctggtttctgtgttatgaattctctcactatagccaatttcaagctaccaacctgatgtcactcaacatggaatcgactccaggacaacactgaaacagttaggctttctctaggaaagacttgattctgcagctactgttagcatgactagaacactaacagtagaaaaggatgtgctaatcttccttaaggagaaaaacagagtgataaaatggctgaccagaaagtcagctgttcttaccaggtcttcgtgattatctgctttgacataaaggaaataaggatccttaatttggtaaggtaaaactaaaaagtttttaatgtaaatttcacctttttaatatgctaacctagagaactcaaaatgttcctctttaatggtgtggtctctgttcagtaaaagaacttagagagatgaaaattccatgggttcctatgtatatcctgtgttcaggagatctgttccttaaattatattactttaggagagagaaggattcatgagaaaaaattttacttgtcaagtcttgtgcatagaaatatcaatctaagcatatctgcagtaaattaggggctttgcaattcaacttgatgtaattgaaggtatttgtatgaattcaatatacatgtccgcatgtatatgtagtgagagacagagacagagggagagaaaaagagagaaccctgtgttaatcagctccttttgctatgaaacagaaaggaaggcaaactagcctaagcccagtaagagaaattgttgactcagagccaaaccataggaatggcagtactcctgacatgggggaagaccagagacaaggacctaatgtcatggtactcctccttcaatttctcttggtaactagcctttactgtcactttcctgcaaatataagcagttgataaaggggtgaggtaggtcatctgttggtttagatttagatttattaaattctagtcaaagaacccaatgtataaaacagctattttgggggaaattgccaaggtattcttgtggccaactgtatgtcaagtaattcacatgagtatatgagaaaaatacatgtgctatgtatgttgctacataatttcacaattatctattaaatcaagcaagttaattgtatcactcaacttatctacgtatttactgttttcaatctgactgatcagtcaaaatctaacagatacctattaaaatttcccattgttgtgtttttattttcttttattttttgagatagggtctcactctgttgctcaagctggagtgcagtggcgtgctcacagctcactgcagcctcaacttcctgggctgaagggatcctcccacctcagcctcccgaaagtagctgggaccacaggcacacatcacaacacctagctaatttattcttactttttttgtggagacagagtctccctatgttgcccaggctggtcttgaactcctgggctaaagtggccctcctaccttggcctcccaaagtgcagagccaccatgcctggccatcgttgtgtttttatatcatttcccactttttccctatatgtcttttcttgtttgatatatagtttatgcatatagctttgagaattattcctgtaatcattatatcactaattatctttattagtgcttttgacctgagttttcattgttttcttaacattaatatttccattcctgcattctttttttcttttctctattttcataattcattccattaacatatatagtggtaaatgacctatttacttattattataatattttgtgtttactgtttatttactttgttgggtgtttttccttttttaaaagtctcttaatttggaaattgcattcttctgctattcacaataatatgtgaaacaatatttctcgcttagtatatccagttcagtaatgacaatgatcacactaagacagcctacttgcccattttactcctgaatctctactccctgtacctttttagagacttttaaactcctttctaccttacttcctcttccttcttttctccacaatttttggatttttctgagtagctgaaagctctttgttacgggttttaattaaacacacacacaaacataaattttaagaacactgtcttataatttctattctgtcttagttatagaattatcatcacataaactaaaacaagttaacactgtttattcactgtattaacactgcattgtgctttgctcttcttgtaaagaagagatttgcttctggtagaaattttatgagattgggagtacttccttgagtattttcttcagataagatatcagtacatgggtggcatattttctgaattcttgattgttgaaaaccattgtgccttttttcttaacatttgattattatattgattggctggtataaagattcttgggcgacagtcattttcttttaataacatagtcgcataatctttcttttgtaagaaaactattttttgttctgagtagaagaaagaatttttttcattagcattggaggtcagacattttccctgattatgtctaggtgtgtggctttttgtaaaattaatcctgtctgagtcttagtgagcccattcagtcaaaaggcacaagcctttcttcaacagaatttttattctgttatttccatgattatgacttctatttgatagaagctgaagttttccccatctggaactacttctctttgcatgttatgtcacctagatcttcctctaaatcacttattttatcactaatttccttctttgtccctttattttggtcatccagacagttaattcaggtctcagcagtagctactctcttttttttttacctcctctctttgattttagaactgtgaaaatcattattgttagttcaagtaattattatttttattttctaattgtatctctttgagaatactcattacattgaaactaacattctcctctgtctcattcattagctcttccttaatagtagctacctgttcaagcttgacctccctcccacaagtttaagagtacatgaaataggtagcaatttttctttgacttccttgtaatgtagattttgccacacaagaacaggccaggtttgaggttttcttgagcactggtaaactggaggtttgtgggtgcaatggcaattttgtctggtgagctagtgattacaccctagcataccagaacctcttcactgggacaggtataagaccaggacctaagactctctaggtccaagggggacaaagttccttctaaaatataaaaacttgtagcattttgtcctacctattgcatcacccctaccctcccaggactgcctaccagccgcatgaggcaacctcctgaaggactgtgtgagaccttggcagacgtgctcttctttggatgatcgaagctccaccggcatatgtggctgggcagtctccagtggccaaggaatctgctatatattagcttcagacctgttgggacctctgttcttctcccttccccaagataaatgaatcctcacacttgctctcttctccaggaaactcaaggcttcagtggtactacttggcttatttaagtgttgacttaccctggcatcttcccatcttcctagaatccattttcacagttttaaatattgccaccaagtgtaaaggttttaccgtatacaattttttttattttcacctttattttgcttagattatctctaatgaatctaattttcccaatgtctcagtaaaaatagctgtggggttaaagtggcaggtgaaaataatgacaccataatgtcttgatacttcatgtataaaactctgtaacaaatagactgtataataacagacacatttagcaaacaggaatggaggaaccactacatttagaaaaggagaaggagagaatcaaggtgtaagttgtcaatggtactaagtacagagcccattctgcctgggagatttagtggcaactcacttcccatgaaataaagcaagttctttgtgtagccagactgagtgccacagcttcaggtcctcttgccggggaataacccttgcccagtattggcacagtcataaatgttaacatagttaaatggtactcaactgttaagcaatcccatgccattctgccagacttaaagtgtctctggaaatacagctttttaaaaattccactcagatctgtattgctttcatttgagacaatctcctaactggaaaccaattccaaaaaaaaaaaaaaaaaatgtgttaagtcatgagccttcaacttagccctggtagtttcttagcaaaaggcctaggaggtcagccatcagctaagatctcgtttgaaggtgttctgtcttagaacagtggaaatcagagggctgtcttaggaggcctaggtgaatgagatgtgttacactacagaggtgagccagcatgtggtggtcagggcagaaggatggagagtgggaaattagtagctttcgtttggacaggaagcataacacgaggtatttgatagagtcctgaggaattctgcttcctcccagctctgactcacctgggaatatttgtttctgctcggcattgtactttaagctcagtatcagatagaagaacttctcctttcggagacaaacttccctactcatatgcttaatctgagcctcatcaacttcttaaaaatcttactctctgttcagcttttacatttttcatttctgcctcttcatggtccattcccattctcctacatgcatgataaaaattgctttgattctgccaccctctcaatacacttgtctatttttcatcattccttcctttctggtcattcagaaaattctttgcttccactctccaaactctttctgtctgtgctttctcctactctgctcaaaacactatcagaagtgtcaccagtcacgttttcacaatcatctcccttttcatgtactgcacagaatttgaccttatttataacttctccttgaaacctctttaacattgtatttttccattcaatcccatctctgtgaccacttcagtttctaccctctgctgttccattttcaccttgttcctaagtcagaagtagaactcagctttcctagctcctgattcacatctctttccttgatatgatttgtttgtttgttttgagatggagttttgctcttgtcacccaggctggaatacagtggtgcaatctcagctcactgtaacctctgcttcctgggttcaagcaattctcctgcctcagccttctgagtagctgggactacaggtacacgccaccgtgccaggctaattttttgtatttttagtagagacagagttttgccttgttggccaggctggtcttggactcctgacctcaggtgatctgcccacctcggcctcccaaagtgctggaaccacaggcatgagccatcacacccagccttctttccttgatatgatttaaatatgttagtacatccattcattctacaaacacttattgagaacctagtaggtatcgacacctcaggtttgatgcctggtggttttactagacttagttctttaaatcatctttgcagttatgttttaaaaactgctgtaaaactttcaaaattgatttgggctcattgatactgcatttacctgttctgggtcaggctttgaatagcctaccaggtgtaattcaagaggcactccataaaggcttacttgctcaaatgtatctcttctattattgtgccatggtgtttgaattatgcactattattgagtcattctgtgaggtggagacactgtcacattgttgcttttttggagctttcttttaaaatatgaatattctttataaggaaaaactattaagctgtttataacttcatgactaaaatatgaaaccagtcacctcaaagagagacttgaagagatagagaaagacacgaaggacaaggatacgaaacactgggcaaaggaaaatgcccatgagagtcaaagggagaaggaggtctgggtagccttgaaacactgggatggagggggaggaacagaaggacaaaaaatatgaaagagtaaattgactctgttgtctttgctttcaaaaggcaggtggacttctttgaagtaaagcagcaactgtactattttcttttcccatatgttattttaaaatgcaagaaatttagagttattttgatacctatctgttgaattggctgagtggaaaaggtaatgcagagggctatggggacccaactaagttagagagagctgtggtaaatggaactctttgagttttgacatctttacaaataatgcctgatgattatgtattcagttgttttaaggaaaaatatatagtgattcccatggagaaacacagcattatcatatctaaatagattccaccttcacaccctgttttaaaaaatttctaaggaaggtgatatgagctcaaagttctcctgcaatcatttctgaatattggaatctgtgaagctcttttaaacagttacatggactgcctttttcctgagattcttcaggaattctggatcccaggcatcgtgtgtgtgtgtgtgtgtgtgtgtgtgtgtgtgtgtgtgtgtgtgtacttaactccataaatgattgtgatgcatagccagcgtgaagaacaactaagccaggaatttgatgagcttagtttgattagataaactgcagccatggaaagaagaggggaggctctgcttccctgttaggaaacatcttctaattaaatttaggaagcagcctctacaaaagctgacagcaaagttttctatgcaggctgcaaaggaaagcatgatgaaaaacacaggaaatattttctctagaagtttgtcacagtgacaggcattctgtcgttttttaaaaacctactctttgggtctgttccccactgccccaacacacacagaacctccgtggtaacacacttacacacagtgcttttcccaatatgcaccgggctctcttgttccctacagcacctttgttcattcttaggtggcggcacaaattcccctctaatgtctgcctcatcaagtctatttgttctccaaggacaaatttaaatagttctgctgagcactgatatccaaaatgacttctcttctctaaattctactgtagtttgtgacactgatcttataattataatttattgagctcctactatgtggtcagcaccagtcatacagctgctattcaacagagccaggaaagcagaggcttagttgatccaaagccaacattcttttcattgctttgcaagttgcagtccctactctataccaccttctattaatactttgattactcggactttgtctttgctcctagcctgaaagcgacttatggtcacagaccacgcaatatgcatgttacaaatcccgtaattctgctattgttttgtttgtttgttttttaatgtagacagatgagttgaacaatgaccatgcagcaggaattagcaagagcaggggttataacttcaaccataccccatgctagcacttgtacatctggagcagttgcagttcctctagcatcttaagtcttaagtttttaggcattttactgtcaaatttaaaataacttgcaagaaaactctgcatcttcaaaaaagtagagttccataataagctaagtaagccaaatttttgcaattactgaaaaattaacaagaaattattggggaaaagtaaatctactagtgctgagacttagatattcatgagggatatgtcccaagaccttctcaaatccccaagtatcattataatatataattttcctcataaaatgcagtaaagtgtaactgaaatatttaaatgatccctgtagacccctaatgagtctatagaaacagaactaaagtcgtttataatgctattaacgtaaattctgaattgagcactggctaaaacattttcaaatatcactttttcttgtttccatatagagcatatggtatgctcatttttgtctgagtcaccatcaaatttatccagaacttctcttttttggctaggacccatcaactttcaaaaactgtacttaaaaattcagctgggtgcggtggctcatgcctgtaatcccagcactttgggaggccgaggcgggtggatcacgaggtcaggagatcaagaccatcctggctaacatggtgaaaccccatctctactaaaatacaaaaaaattagccaggcgtggtggcaggcacctgtaatcccggctactcgggaggctgaggcaggagaatggcttgaacctgggaggcggagattgcagtgagctgagatcttgccattgcactccagcctgtacgacagtgtgagactccatctcaaaaaaaaaaaaaaaaaaaaatcctaagacttagcaattggggccgggcatggtggctcacacctgtaatcccagcactttgggaggccgagaagggcggatcacaaggtcaggagatcaagaccatcctggccaacatggtgaaactccatctctagaactagctcagagactacaggaatagaccgaatgtgcatcattataaagaagcagctctgactacagaccaccacttgcagagctgggcaagaagggtgtattactctggacagtagatctaggcccagaaataccaaatattaaaatacaaaaaattagccaggcatggtggtgcatgcctatagtcccagctacttgggagcctgagacagggtaatcgcttgaaaaccagggaggcggaggttgcagtgagcagatcatggcactgcactccagcctggtggcagagcaagactctgtctgaaaaaaaaaaaaaaaagaattagcagttggctttctttgggggtcttttaaataaaacttcacaaaattaaactactaagttaaaaaaagagttgagactacagtgtaggggctagctggaaaagctcttgaaagttcaactcattcttagccatgtgagtcattcacataccctcactgcatgattcaagtttcttacagaattacatattaatatgttctttacaaccattcacaaatagttgaaacagcaaatgtttagtctatgactctcagagatttagattatttaatttcagcctcttttgtgtttttcaatgtatccatcaacaataataaagaatttacttacttgactatgcattttgttcatttttccagagtttgtgatttacattactattcatactatgtcaggaatcaaaaaagtgcaatatcttttctattacatgacaaggcaccactatcgttttgttggtaactatcttgaattgtattcatgcccaagcatgaagacagagtacttggcttggagcagatgaagatgcttctaggacacaaaactcaacgaaatcatcaagccttcaaactcagaattcctagttcaataatttgcctatagtaatgctattcctagttctactttaatattactaccatccttattatattgctaaaaatacatatatgcgtgtgtgtttaataaaaattgaatgcatgtgtgagaaacttgaaataactctgttttatacatgtacatttttatttagctcttttaaattttccaaaaacaatctggcccatttaaagtagttaaattgtaaaacagaagcagaactagctcagagactacaggaatagacaggatgtgtgcctcattgtagagaagcagctcagacttcagattaccacttgcagagctggacaagaagggtgtatgactctggacagtagatctaggctcagaaataccaacggaattctcagtgttcctaggcacacaattagaagataacaatgatcaactaatagcatctcagatggaattcataggacctggatatgtaaaccttgaatacgagagaaataaagcattctttcttctaaggtaaaagtttctggataatagataaaacagtgatgagaatatcccgttaatactcccattagatctgtatttctcagaatttttcatcctgacctgaacatatatagcttccaagtggaattttaaagttattttcttaataaaatcacaagcattctttatattatcctgtatccatgtctgaacaacaacaaaaacactattctttattcttaagctgccctacacaaatggcatcatcatataatttgtagcaaaagctaaatgttataatacttcagaggagttattaataatttaatttattagctctagtcttctttagtctttctttcctccttctttgcttttctcctttgtgaagaaaatctcattacctacccataacccatatgaacatgagtgcaaacatttgcagtttcaactattggtgaatggactcgtataaaatataccaatacacaattttggcaggggggttgtttgtttgagacagggtcttgctctgtcatccaggatgtagtacagtcgcacagccatagcttactgtaacctcgaactctcctgggctcaagcgagcctcctgccgcatcctcccaagtagctaggactacagtcacacaccaccacgcctgactaactttttaatttcctctttttctgtagagaagaggtctttgttacgtaggctggctctgaactcctggcctcaagcgatcctcctgtcttgacctcctaaaacactggaattacaggcatgagccaccacacccatcctcaatatataggtttgcaaaaaatttgagtcatgaggctggtgtgagctagtgacttggctaagagttatcctaactcttagaagctttctcacacctgtatctcagtttcctcttactgtgttatatagaactggatcatgtagacaggcaatgatcatatgaaatatgtcagcattacatttgctttgcagttgcgttttatttttaaaaagttttatctaagtaatgaatatttagtcaagaattaatattcagtcaacaaagatatctactgtgtctttcatgtaccaatattatgattgtccctgtggatgatattgcatgatgaaaaaatacatgatctctaactttgagcaactcaaaatctgtgagcaaagacaaaatttaagttcatgaaattaaaataatttaaaggcaactataaaagcaaatggataatttgtgtagttatagaatatacggagttaactgtgactttcccaaaaggttatccaaggtaattcatccccagtgtaccacacccttacagccactctctaccccctcatcccttgccctgttgtatatttttaaatcacctacttgaaattatattacttatttattttgttcttatcatattttccactagaatgaaaacttcatgagaaaagtagctttgtcttattactgtcgagctctggcagatagagtagcagttgaatacatatttgtggagtgaatgaattaatgagtatcatcaaataaggattattacagactggttatataacatgcagcccactactaggcaaataagataattatggctgatgataccctactgtttaccattcacatactttagttattatgcaagtttggatattaattaaacaacagttataacaatgaaccacaacaaggagtgatataaaagagaatgaacttatcatcttttcaattttcaattttttagggctgcttttgagctcatcctgatttcttttaaagccaggaaaatcagtatttatttttattgattcactttatattgtgtcagggcaaaatacaggaaatttaatgtccaaacagttgttcactatctaattaggaattaagaaatataagtaaaatgtttcttgtatattaggattatatacatatatacataataacgaaagttgtagtcaagttaggacttgaattttttttgagatggaaatacattgcatattttggtgttctagaagtgaccagaaataacatagaaataagatatcaaaatatttccattctttgtaaattttaaccttcatcaaaagtcacaaacatggtaaaaatgacctgatagtcattcttttgtgaatctgtgttcaaacatagggtaagacatttatctagtgtgccattcatgcatggggtctcaaaattatttctttccttttttttttttttaagatggagtttcactctgtcgcccaggctggagtgcagtggcacagtctcggctcactgtaacctccacctcctgggttcaagagattctcttgcatcagcttcccgagtgcctagaattaaaggcacacaccaccatgcccagctaattttgtttttttaatttttagtagataccgggttttgccatgttggccaggctggtctcgaactcctgacctcaggtgatccgcccacctgggcctcccaaattgctgagattacaggcgtaaaccactgcgcccagcctcaaaattatttcttacccttacccattagtagccacagagtgctcatcaaacatcactttaatacaggattaaatactgaaaataaagaatgttagcagtgtacatttgtaatgctgattacatcccaaagagacatatactttattttgaatatgcttgtaatataaatggctgttcccactctaatacggataattcaaagttagtgacatcaccacaaaaatgaatttatgcagtattcaaattggtagcatttccacatcctgaaatatctttttgtaatgctcatttctattcatgaaatcttaacaaaattcagatttactattattcttcttttccttcttgtttaataggtgctttaggcttaagttcatcctaccaaattgtccaaaaatctaggaagtaatattcagaagttgtttctcactcaccttggaaaatattttctctaatcaaactttaaacaaattattagctttaattaaatgtgaaataaaacaaaagcatacaataaaaagccctttggtgtaaagagctgatacaaataagtccaacttgaatattcacaacttttctgtaataattgattgcaacataatcacagtaaaatttcagcatactttaagtacatttatttgtataaaagtaaatctataactctgaaatgattaacaaaatactacttaagtatactttgtaaaagtaaacctatattttatgtaatctgaccatttttcccttttctagtaggatatagttctgttatcttttctaactaatgtgtcttttggatacctataacactattgatacttttcaaataattttatcatagtatccagttatataacaagtagtattcatttattcatctgttaagtacatttctattaagcaaaaatctgagtaaaatctgaaggaaaagtaaatgagtaaattcactcaagggcaggagcaagtgtgtgtgatatgaatgggatggatattgtggatggaggaaacaacattaataaactctggcctgggagttaaacataagtagactaatatgactttcctaacatactatatagtgactggttttcgctgcatgccatgatttatatgtattatataggctattgtctctttcttaattatttagaaataaccatgtctataatatagtagcattactgttttatttcttaagaggcatctctatggtgtataaggtttaggcaattctattatgaataacataggctcagattatacattgtggacaaatcgaattatgcatgtgctatctgagaggagatctgtatgtgagcaagacatagaagccctgtatactctactctctctcagaggacagaggagatttgaagaccaattgtggatgggtatcgtgcatcaactgaaatacccacttatatctccttcatcagttgcccttgtgttaacatacagcatcaaagttcctgcttgtgccaggcccagagctatggattacccagttcttctaagaagttatatcttctaaatgcctattgttatgtatttgctttttgtaatatcagttttgcctatgaacacagcacgtagcatcaaaagcaaggcaatgtatgagcaccacctattagaagagatttagtgccatgttatttataacaaaacctggaaataatctcaacatccaaaaattgagaaataaataattaagtaaaatagggtgtatctatatgatttataaattattatatgaaatatatgactgttaaaatagtatttttaaagaagcttagtgacatagggaatgcaccttatataaaaatgaaggatatataactaaaaatgataagcattaaattttgagtacagtgtatttactcaataaaggagtaaaattttcttactcaaaggaaatagacctttttaattttatttctatttagttgtttcattatgagtaattttagttttttcttctttattcaagttggtatttgcttccacaataattaagaactttttttataatcaggaaaataacatttgaaaaatataatgtaggaatattgaatgaattatggtaaatagttgtttcttttctcattcaaggtaagacaagtagatatgattttaatctgtagcaggataagaaagatattcattggaatttgatgattataaatattatgagaagcagagtctactgtatctgttgctagggataatttgaaagaaaataagaaagctggaatgatttaagcaccgtaaagctaataggtgagaggacttggaaaatcattaactgtggtatatatgttagttttaatattgtctgggaacttcttcaggtcctatttaggcctgtgatctcaattatgtgtttaataagcaaagttcatttttggtgtctcagacagttgctggtttcacattgtaagaattcaggatgttgtttaaaccacaattgatttattttaaaatgtcttataatctctttatctttacatacacttattgccttgtaacataacagatgatctctttcatcatgtcattagttctaattgtgagaactgtaaaatgataattaattgctatatttgttttatacgtattttatgtaaaacacagttatagactctgatagttcagattaatttattgttagttttctttgactatatgtttgcaaatattaatttcttaaccccttgcaatctgccttccatcttattaggtgtctataactacattcccataagttgccaataactgtgagtggtatattctattacttacatttcagtcttcattctacctaatttctctgcagtattttacctcaataatttcatccacatcttttttaggggaagtggtcttctcatttatatttttcctggttgttctcctctctctctgaccattataaggattctgcaccttagtattaatgatcccaaagcttaagcccttttccttccatcttctcatccattcacaagacatcaaccaccatctactaattagagtttaatttgagagttatgccaatgactctcaaatctatgtttccaaaactcctttctgagatccagatttctattaactctcaaccagattctttcaggtagatgtcccatagagacctcaaactcaatgtatctgaaattcattcacccttccccagcccttgccaaaacctgcttctcttgtgtttcctaacttgattgaatacattactatcctccagcaattgaaatctgcaaaattttaaattttcattccccaactctgatttgtccttatcttgaaactttttaacattcatctttaaaataacatcctagtccacttgaaattattgattttcactgacattgtttcacattagccataccttctctttctgattggtctcctgcttggactcttatactctcaccccatagacatatataagagttatgtttctaaaacatggattaaacatatggccttccatgttttcttattgcctaaaggataaggcacaaaatctttcaaaaattgaccctaaactctagctgaaccatgtggacatgtctcctccctgcttccttcatatgcactagtttccttcccatttcatatgataccatgcattcctatgcttttgaaccttttcttaagtattttttagtcatacatttttccataggctctactccagccagtgattttgtgaatccctcaagattccaaactacaatcaccttcactgttgtctcctcacatctctctcatacacacacactctagaagttaataaaaagtaatcactccactgctaagttttcattcacttcataaacacttcaagtagagcagattgttttggatcatttttatgtctgtttattttaccaaacccagaatggcctaaaccatgaagactgtaaagctttcatggttagaggcaggatagttgcaagtgctcatttaaggacattggtccagattcagaaggtttcagtattcccacaaattattcactttcaaaaaaaggaaaaagcagtaagaaatctgtgagttgcatttgtgattttagcagttttatgttaagttctaggaatagtagcaatttgaaaggtatgaaataaagacttctttatagtgctggatgctgcctttgcccagatgatgtaaaaatctaattaggtgctgctgcttctaggtgttaattacataaccagcaaagttcaccatagtatgttccttgttaagtgaaaaaaagcgcaaagttttaaactatctaaatttagcagtcctttgggtactctgcatttgttgaatattgcaaaagtaaatacccatctgttttagtactaatatgattttgtatatcaagcactttaaagatttttttcccccatgaaaacttcatcaactgttttatcaacaatgtaggcttcaggcacttctgtaaagttgagttgggataaatgaaagatccttgtcgaattggtaatcatgcaggtattgagaatgaaagggagatcatattttaatttaacttcagtgcctcaagatattttcccttatggactatattactgttctctgtctacatatccatcttgtagaaatcatagccactgttaatacatttcaaataaagctttcctggatctgggtgatatttatcacttctttctgcaagggtctcctgaattatatgagggcttactcattatgacatattaaaatgctaaatgatttatagaggaatagagatgtattgtaattctaaaggccatttttatattctgctgaacctgacatagtttaagtgtcacaactgaaactataacttgattgtaagttctttgaggacaaagttgatgccttactcttgtaatttccacatagtccatgaaactaaggacctgctcggccaggccaatagctcctttctaaagaaaagtaaacagaagcagtatttggcatacacctgccgtaaaagtgtgtgtcctggctaccttgaccacaatttattggaccagatattgtatccctgagcaaaaagcaaccacttggagactaaataaaaagaggtcagcaacttgtcaggaagtgtgatgccataacccaggcaataatgtcactccacactggatagtggccaactgcctgtatcaattaacactcttaattgcaagcaacagaaactgactggctgtcagaagtgaaaggagatttattggcaggatacaagatggcttatggaatcaaagaaggcaggaacagcaggcttagaaaatgggcaaaaaacgaaaaggctcagagaatgaacaccaagagttgtccagctaatacagcctctaccagggttgatatccaccactactgccatcatgggatactgtcaggagatgctgcacaacacactaccacaaatacaatttaaccacttttctgattgtgaggttaaaactttgggctggatcttcagttgcctaggcctagatcatgtactggttttttggttgcaagacagtagaaagagtaagaccctcttttcaaagacttgcgaaatggggatagttcctgtgtcctaccaatgcttcatatgatttaaatttcctgcaaataggaagggaagtcaaatttcagacagccaaaatataaagaacgctatttgtactgagtgttgttctctgtggatttgtttttaaatatattatatatatatgtatatatatgtgtgtgtgtatatatatacgtgtatatatacacatatatgtatatatatgatatgtatatatacgtgtatatatacacatatatgtatatatgatatgtatatatacgtgtatatatacacatatatgtatatatgatatgtatatatacgtgtatatatacacatatatgtatatatatgatatgtatatatatgtgtatatatacacatatgtacatatgatatgtatatatacgtgtatatatacacatatatgtatatatgatatgtatatacgtgtacatatacacatatgtatatatacgtgtacatatacacatatgtatacatacgtgtacatatacacatgtatacatacgtgtacatatacacatgtatatatacgtgtacatatacacatatgtatatatacgtgtacatatacacatatgtatatatacgtgtacatatacacatatgtatataagtatataaatgtgtatacatatatacatatgtatgtatacacatatgtggatatatatacgtgtatatatgatatgtatatatacatatatatttacacatatatatgcctatacataaacacacacacatatatatgcatatatatataaaaaatagtaaaaaaattgaatcggaaaaccaagttcaactcaattttgaaaaaaattgaattggagaaccaaaaagctaatataggaaaaaggagaaagtgagtagaagtagaaatggaataagagatgctgagaaataagagcagatgtattcgtattgcagagtttttaatccttaaaacaatagacacccattcctaaagtaacaacaagaaaacaggagctgctctttagagctgctgtatgtcttacaaaatgatttatggtgtcccaatccccagaggcctagcccttcctttaccaaaaacatttcacttacttttttatttttccatgtatagttgtaataaactccccaaaatggggtaacctcgccatgtttcctttccttgacacctgaaagattaaaatagagaactctctttttacacagacacaccccttatgacatgtatgcttataaaccaccacatgagtgtaataaatatattcaaggatttttaggttcaagattgctaaagattttagataaaatccagtatccatgaatttcattttgaatttgtgaatactacacttacaaaaggtcatgtttaaagccttctctatcccacattatcaccaaagacttctaccaaagtcacccactttagtatttccttagtattattatttcctttagtatttagttttgagtatttacctcaaaaagggatatcagtccacagagctggcaaaaacaagcaagcaaacaaacaaacaaacaaaatggcctagatatttctttccagctcctacagcagcagtgggaagaaatttttttttcccttcctaattccttttatttatttatttattatttttttttattatactttaagttttagggtacatgtgcacattgtgcaggttagttacatatgtatacatgtgccatgctggtgcactgcacccactaacgcgtcatctagcattaggtatatctcccaatgctatccctcccccctccccccaccccaccacagtccccagagtgtgatattccccttcctgtgtccatgtgatctcattgttcaattcccacctatgagtgagaacatgcggtgtttgtttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggctgttttttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctgtaatccatcttgaattgatttttgtataaggtgtaaggaagggatccagtttcagctttctacatatggctagtcagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgactcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgacttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctagttgaataccctttatttctttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagcattgttgaattttgtcaaaggccttttctgcatctattgagataatcatgtggtttttgtctttggctctgtttatatgctgtattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatgtggtcctggactctttttggttggtaaactattgattattgccacaatttcagagcctgttattggtctattcagagattcaactgcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcagaaaaccagctcctggattcattgattttttgaagggttttttgtgtctctatttccttcagttgtgctctgattttagttatttcttgccttctgctagcttttgaatgtgtttgctcttgcttttctagttcttttaattgtgatgttaggttgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgttgtctgagagatagtttgttataatttctgttcttttacatttgctgaggagtgctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtgtctcattattaatgtgtgggagtctaagtctctttgtaggtcactcaggacttgctttatgaatctgggtgctcctgtattggttgcataaatatttaggatagttagctcctcttgttgaattgatccctttaccattatgtaatggccttctttgtcccttttgatctttgttggtttacaatctgttttatcagagactaggattgcaacccctgcctttttttcttttccatttgcttggtagatcttcctccatccttttattttgagcctatgtgtgtctctgcatgtgagatgggtttcctgaatacagcacactaatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcaatggtctttacattttggcatgattttgcagcggctggtaccagttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattgaaattctttaaagaactataccaacttgttatggatgagttctccttagtcggaaccattcattgccaagggattgcagtttttctctgataggttatttaaaattgcctcaatagtaattctttcttgcttggatttcataacattcccaggacagaagcgtgacttccctagactctcttcatcctaaatgtatcagcatggtgggtgctccagggcagaatggtgccccacactagcttcctccctgtgttggttaatcattcacttcaatatggaattataaaaatactgaggttttatgcttgtggttgttttctaagtctagcactgaaatacataagctaagtgaatagaccagcagatgtataaaatataaattgttatactgtttacactaatgctttgcattaagaaaacaaatgccaagctgcttgaagtctgcaaagaataaaaactccttattatacatttacatacacacttgcccttatccaaaatgaatccatacatagtagggcaagcagctgcctatatttcataacccactgaggtctttttaatgtgttctaagcaatgattaggaaacctgctggggttcattttggctcagctggtccacaattttgaacacctactggtggtatcaggaaaatgtgtacatgacctgtttctgcatatattaagatcttccaaattatgctgcataccctcattaataagcaaactatggatgacaccctttttgtatggtagataaaactagcattttaatttaaagataaataatatcccacacataaagaaagttcaagctcattttttggcccagtataaaggattcaacaaaagaataaactattctgaaatgctttaatgtagaagatttggaggtgtcctaattactgcgaaatatggccaatgtatggctctcgaagagttttttgtttgcctgtgaagataggcctatggaacctgtgtcaatcttggttttacaaaaaaaacatgataaaattaaagacaagggaaatagacctgggaatatacaccataggtaaagaaaaacattataaggcagaaaggaatggctgcccctaagtgacagacaagtcatggatcaattttgggtgcaaggtaggcaactttaggtcaattcaggcaggcatagaggctcagagggatccaatccagaaagaagtgaacaatggataaagtctagaaatgtagagtacagatagcggaaagggagaactagacttcaaacaagcagaatggattatgaaagctaaggcagacattagaatggagtacagttcagaacagagggcattggaggcccaacacacctggaagaagtttcatctgacctctcaatgaatgatattttattttattttattttattttattttattttattttattttattgagacagagtcttgctctgtctcccaggctggaatgcagtgacgcaatctcggctcactgcagcctccacctcctgggtttaaaggattctcattcctcagcctcctgagtagctgggattacaggtatgtgttaccatgcctggttttttgtttttttgtttttttttttcttttttttacttttactagagacaaggatttgccatgtgggccagggtggtcttgaacgcctgacctcaagtgatccaccctcctcagtcttccaaagtgctgggattacaggcatgagccaatgtgcccagcctctcagtgatgttttaaagggtttgtcattgattgcatctgtaagagacaaagaattggaatgagtattagcatctacactgattcctctggccatcctcccttgatggataattttgtcttgcggacacaaaggcatcatgtcctttatccatgggcatttgcacaattgcttccagagtcccacatcacaatagtgagtttgagcaagttctgaatcaaaagatcaagtaagtgtccaaactctttaaggatgtctctgagttgtctttttgcagaggtcactcaatcattgtctcctaccatgtccctaaaagcagtctttttctaggaaaaaaattagccctgcttcctggtattggaccttttctttcccctgagcatatattggctattgctgggtaggtcaccaacaaggcttaactgtattcaggacattccaagagaccttgttctgtcaagccaagggtagaactagaattcagaagaaatttgagagattcgtttggattcagcgtagctttcttgaattcctctcagtaagatatcctggggtcacttgggcaagtttctttcttctttgactttcctagaatatagcgtaatcctcttacagggagaattcttcatacaagtagagaactgttgtgtcagttgagtcctccaggaatcagacacagagagggagttaggagggccaaaggtttattggagagaaatgcttgtgaaaggaaaaaagtggaagcaaaattggaaaaggggagccattggaccctgatacagacacaagaaaagtctttgctagcccagtagggagcttcaggacaaaaagtgcctattagaggagtcccacattcaccggaaatagctagacccttgtactacagttttgctatcattcactggggtctccctgaaaggagcatgaccccagtttaaaagcgaggcacacctaaaggaggaagcagttagaggcagtcagctcaccacactcctgcagctgggccagagtctgttcctgaaggtagatccgagtggttcatgtctgtgtctgttgcagttgcctgcttctgcatgtatttttcttagacgttttcagaacttagttactttagcatatctactcatcagttctcgtgaaaagttatgcgactcctcaacattgcagaaagttaaccctttaaattgcagagccccctctaccatgcagggtctgagccctgcttccatttctttgatgcaacatgggattcctggaatagagacaaggtatttacatattaaaatagcaacagtgctacagtgcccctgagaggctcagtgtctagaatagcacatgaaactgtgggcagaaggtgttcattgatctgtttatttgggcaggtacctctcaaacttcattaccatggccaggtgaggccgtggatttcctgttgggattagccggcagaagcaagataattctatgaaatctgaatctgattccatagggacaaattgtggcagaggagatctgaaatttgaacagctttcagggctgatctctacaattaacactgccatttgagagtaaagaagtgagctggtggagaggatctgagagtcctcacagagaattaaaatagtgcctgaaagaacgctggcagtcaggaattaactaaacagtgagtagtgtatggcaattcttgtccatttgtaaaaaaaaaaaaaaaaaaaaagaaagctttagcgactaagtggaatggggagcattgacactaagaatgtcagaggaatggtacactagggaaattttgtctgaaaggaagaaaaaaacatcattaagttatgttcaccagaaatgatatttaaaggaacaaaacaggaatatagttccccttagctgataaaaatatggacagcatctcccttcccctcaaggtcccagggactaaagactgagagttgaggcagggtcagggtcagaggtacaaactctggaaaagccctcaatatattaaaggttcagacagaaaggatcatggtcagcctgggtcctcaggtgggttctcgtggacttctaggccacagtaggagacagttctctccaagtattttagctcactgatggagagcatcaaaagactgttttcaaactcagttggctcctggagcaagagctgctaatatcctgtatctccagcttattttggctccatggaagaggagatgcaaatgttttgtggttcatgatggaaagctggtatgcaattagaaattcttcattctttcattcaacatggtatttattgtctttcatgtaccaggctctttgctaggataaaagagtaaaatacatcccctaaaagactaatagtctagtagaaagaaattgattatggaacagagaagatgactataaaacactgtgataaatgcagtaataaagaaacattataggagcactaaagaggcagtcatttactaatccatcctatgctgaagtgagatggaaggatttgtcatggagggctgcgttgaagggtgttattcaagggacaaaaaatgaagggcattccaggtagaaagagaaaaataagaaaaaacttgaaatgagaaacagaatagagaaggctatgtgcttggggaggagaggacacacaggtgggtctatgtcatcttctatttaaggcacaaggaagtagccacacacacacacacacacacacacaggcacacatgtacacattccaggtatatacagttacaacattttataatcacattatgtgtttgttgtatgcatttgtctcccctagattgtaaagtattttgctttatgtttttaaagaacagggatagcatattacatatctctaaatctgtattatccaatatagtacctaaaacagttatctattatgttatcctggacccagtatactgtactctcaattttcctccaagtacatagaaataagaaagtcagtgtcaatttgtgtggtgtaggctctatcaattcaacaatactgttgaatgcctactatgtgtcaggttctgcgctacatgctctgaaataagctgaaatgatagaacactttcaggatgtcttgtcttttgtgacacttaatatcagatgtccattttattgtgtgcctggtttgcatttccttgcagactctagtttcattcatcttagtgttcagcacggaaaatttgtagtgcctcatggtcaataaatatttgccaaaagggtagaacccacattacctacaatgccactttctttcatttttctatttatatttgagtgcctttagaattatttttagaataatagatgaaatttatctatattagaaataatttacctatattagcatgaacacacttaagtatagagtttgatgtgttttggcaaatgtctatacccgattataccacattcaaaatatggaacgtttcagaggtaatcactgctaacaggttacagcataaatgcatagtctgtttttcagacctctatataaatatatgtacatatttatattttaaaaacaggattaggctatctgtgtgttattctgtgtcttgcttttgttcacttaatatgttttggatatctttccatgtcagtttacaaagatttatttttaatggctgcatagtatttcattgtatggattatagtacttttcacaaatcttcccatattgacatttattctttttttccactactgcaaacaatgctgtagtgaatggcagacatctttgtacacatattttgaatgcatgtggatttaattaggctaggtatttggaattggaatttaaaacttataagatgagctttacatttttatacatattaccacattgttcttaaaaaggagttattaatttactttcctattgagagcctatgagaatgcctgtttctttgcaacctcagcaaagagggatattatcagtctttacattttcggcaaatcatgataggtgatcatgtttattcttttgtttttctaattactagcgagattcgatgtcttttcatatttgctggtcatttgtatattttcttattgtggaatatagacaacatacatgaaacatatatgtatgcatttataaacagatacctacacacacacatatatattttttaacaactcataatgtgcacaccatgtgaccaccaggtcaagaaatagaacatctccaacacctcaaaagctccctatatgtcccaccctaacacaaccctctctgtccactttaacaccatccctactctttgctttgcttttcttcgtagttttatcacccatatatatgtctctaaagaccatatttactttctatttaaggaatttatatgaatcaaattatattgtatacttttgagactggtttcttttgctaagccttatgagattaatccttatcattgtatatagctctagtgtgtttattccattgtatgactatattaccatttatttttcattttactcttgatggacaatttggattttttccactttggggctatttcaaacagtgctactatggatattttgaacatgtattctggagtttgcatctttaaaaggacatatacgtaagagtggaacctagatcatgtgaaactgtttcccaaagactcttgtactgatttacattctccccagggtgtattgactttcccccaaccccccaatctggtagatagataatggcatcacattgtggtttaaatgagcattgtccttatatggaaaaaatgtgaaaggtgttcataaggctgatcacatttcataaattttttggccatttggatttcatcttgaatgaaatccaatgaagtatgctatgttgaacgaagtatgttaaagttttgcccatttttctcattaattttcaggtggtcctttatatattctggatactactcctttatgaattgtgcttcagaatcttgtcccactttgtgccttgtcttttcacaatgtttttaaatatattaacattttaattttaatatcttcaaatatatcaatagttttcctttaaagaaaatggaacatttccattaccctcaaaaattttcttatacttatttccacttaattgctcctccagcctaattctcagtctcagcaaccactgctctgctttccatactcatggtttttcctcttacagaattttaataaatgtatgcatataatgtctacttctgtaacttagcatcattttgttttattaattccaagttgtggcatgattcattagtttctttttgttgttgaatcatatttcattgcgtggatatgcagcaattttgtttattcaactcacatattgatgaatattggcattatgtcaaatttgggcctattttgaaaaagtttctgtgagtattcatgtgcaagttttaatgtagaaatatgtttccatctcacttgtatatataattaagagttgaatttctgggttaattagtaagtccatgtctacctttttaggaaactgcacaactaatttccaaagtggttggaccacctttagaatacttaagtcagaaaaacagatgcaagaaggacacatgctaaaaaatagttaataaaaacatctccatttcaacacatagtctttgcattcactaatattataattgtgcctggaacagttgactgcctgtcctgttttattgacatagaaggataatacatcacgtttgctcattatgttgcagctacttctagtcttacaggaataagtgaagtagaagccttcgatagttctagtttacaattgatggctgaatttcacttcagggagcaattttgctaaagaagatgaaggtttaggacatgataatgggaaagaaaattaagaaggtgaaattggtactcagattgatcttctgggccccagttctttccatcagaaacatggatgtaatgaaaattctagccacctcttggcatgtcatatgaattaagacttaagagttgcttagtgaaaaacattttataactggtaaaattttgcagtggatttattgaaatgccagattctaagaaagccattttgaaatgaattgtacagagtgaaaattactaggtaaatgggagagaaatgtttcttcaagtcaaaatttcacttgtaatttagcttatcaggaaattctcagtctcattctgtagtgcttattcctttgcagaggacatgaaaccagtgagatttgatgccctaagtaattggtagaaatacctgctctacaatgaagaggtcatcttcagggtctcaaaagcagcaggatgggtcatttatagaactcccttaatgtgtaactaaatacagagtagttactagaattaaaaattattatcttgtgtcccagattagaaattaagctttaaaaacaaccagttttgcataatggacattactgcagcaagtaatctgcattcctcagcattaccttttctagttgtgttgtcaccgttgtttgattttcataggaatctattcccgataagattagttgcaggcagacactgggctgtacctcatcaaaattttcaaataggccaaatttgcctctagcttgcttttatcaaaactcttctcagcacttcacaagtctgctctggtaccttcactttatgtagtatcctcaagaccaccatttgctccctagatctgtcactcattctcttaggggcttcaagtgtctttctgcttataatgccatgcacctctgtcacaggaaatcattttgttgcttcagagctttctttggtgatcacattgaatagcaaaagggttaacaggtattgaagaacatgctcacacacacacacacacacacacacacacacacaagacaagcaactactgtgacagagattgcaaatcatgttcagggagaagcattaatgcctttagaaagcaccaataaagcctttgtgatctacgtagacgtttttgtgtattagacatttttaagattttgttaagctattctgtttttcttaattatccatcactttttcacagaattaccagtgatttgtaaagtagtcttcctacatttcatgcttttggacattgtcataaaatatagctgggtttttcttaaatctagacatagtttatattttgatggatatataaggaaataatgtgaaaatatgccaagttgccaagttttcactcatttctcattcattgacacaacatatattttttagtgcccagaaatagagcagtcaataattgttttttgttttccttcttcctcttcttcttctccttgtatgtattggtaatggtaaactcttgatttgtctgagagataagagtacttttgtatatttcagatcctgaagattttgggaagaattagaaattgtctaaaacttatttatttcaataagattctaaaaactggcttgttacaaaaggcaaagccatctcatgctatcactagaaaatgagaaggtcaagatgtagaaacactactaattgcttttagatcttgaacattcatatcaaaattttgaagaaaccaggaaaatataaatagttacagtctattcgtgaattccctgaagtatatagattcatttcatgatgttattgacctcaccacatttctagttgtattagaatattctctattatacctgtcaaacaaaacattgcaatttacagaacaatcattaatttttatggtaattttggttagaagttgtttttaaaattctcaggtagccaaactgtacttacccttggctgtgatgattagtcagcagctggcttgcctaagtatgaagatgagaaaaatatatgtgaacaccgtcaactttactcatggagggtcaaatttactcatggagggtcaaattatggtatctcaaaatagagacagatgattcaagtaaacagtgctaaccaaaaaaaaccatgtgtttctaagaatttgaaaaactttgaacaaattccagatcattaagcaatgggtaagaggcagtcatttaaagcagtcacctagtgaaaatcaggaaaaatgtctgacagatgttcagagtaaattattatggcatgggggtcaatagtattgaaagccacttggaagcctatatcagattattagtgtttactctattggaaccaaataatatttcaaatttgtttcagtaattcttatcaggacacattccatgtattatgccattcaagtgatctttaaattattgtcaaagtctaccttaaagagagcttccacaaaggacatgcaattcatatcatctagagttactgtcatttctaggctaagtcccatggaaattcataacttagaaatgaaagtcacaaagatgcaactgccttcataataccaatgcagtggttataaatatttcatgagcattgcatgggcaggggcagatctccattttcatgagttagaatttgtacagctaagtctccacattttactattcataatgcacactatgccctgtagagcattccatatagcacttttttaatatttatgtttaatgaagaaattactgttctaaaaagagaataagccaagccaaagacttctttttaaaagtattaagttttgcttaatagagatgataacaatcaacagaaattacctcattgcagtatcttagcacaaaaatgcataactttttgagtaatacaggatgatggatcaagacacattaaacctaagtgagaaggttctttctaaaggttataacattacaaatctcatcttaaaggaattcgaaaggttaaaatgcaaagagcaactttcttacatacaaaaacattaattacaaatgatatgcttgcctgctatttcatagtttaaatatatgactgtatttctctgggtttttcttttattcaaaaacattttaacttgctaagataatattaccaagttcgataatgaattgctattgcatactttaaggtaatttatcaaagcacattatcagtacctgtcagaataaattttgcactaaaagtaatgaaaaaaaggactattgtatgtgttgaaatcaaagaacattactgtactgtagctaagttattcaatggagaggataggtgtttgccctctaaatgatacttgccccatgagaaaataagagcctggaaaatcacagaaaataggcacatggaaatgtctatttcttgctttttaaaatgagcatttgatattttatttcatttttgtcattttgatcaattctgtcaagtttgtgagtgctgaaaatgctgcacagatcttggtaacatttacaaaagtaaattaaagttactgatcagctcatgtataatacaaggctgaattattccatatttgcatatactatatatcacatgtagattgatgatgaagtcatagattttattttgaatacacatcaagactaagtctaataatgaaaacaagctttagatttaatatcattcacttgagtcagcagttttaaatattttttattttgcttaaaccaatgagatcactagaaattttgtaatgtttcttgtacttaacatcaaaagtttgtgtttcattcctgataatatttaactgaaagtgggaaacactgtcttccattttgttctttgaaattttattttctaaaggctctgttgaggaatttaacctttatgtgatgaatttgcagttcacttgaagtgtgttaaccttagttccctaatgagtctaggtgtaatactgaggaggaatttgagaaatatatcatgtagctcattgtcaagttggatttgtcttgcacgtctccagctttgctgttgttccagtacacattttgatcacaattctttaattttgttctatatttaaccgacctatttgaacaggatccagagctggtgcggaacatctgccgctgggttaggcaagctgttcagattcctttttttgccaagctgaccccaaatgtcactgatattgtgagcatcgcaagagctgcaaaggaaggtaagaacttgacttgaatcagttgcccgctattgtaaatattggcccacattatgtagccatactcaagtatgtcttttcctacaaacatgtgcatattttttgtctcaattttaaaagtttccagttgagcacttgatcccacaaacacaggagatttacacctggactcatgctagcaaattgaccatgaattttgatctggaaacacaagatcctttatagtttttcctaataaacacttatttcacacattataagaacaaaaaacacagtcacagcaaacccgtccaaaataaatgacctcataatgtaacaattcaatatattaaactttaatgagtaaaaaagaaaaaaagaaaattcaatttgcacaatgtgaaatttcttatgagttctcttcatattttgtagggcctagctgacttccttaaacacatgctcaataaatatctgttgaatacaaaaatcatgcgtgcttgtgttccatcccagggaaattgcaccctgacttgcaaagacattgtaaattacctggaaaataacaccaaatacaaaacatttggtaacaacaagtctgtataatatttgagaaagtaaagttgtggtaattaaaacttctttaatgtttaaaattttaaacataaatgtaggagttaaattagtgaagaactttgaggagaagacatgttctcaagataaaatagaatgcatttttctgggatgtgagggtttgaatgggttttaactatcgtgtcttataagagctgcatgaaaatgttgatgtgtcttgcataggtggtgccaatggcgttacagccaccaacactgtctcaggtctgatgggattaaaatctgatggcacaccttggccagcagtggggattgcaaagcgaactacatatggaggagtgtctggtaggtgttgcccacttcttgcattgtgctttcttggaggttgctgaaaaatcagaaggtcatgttgcaagagttttgtgccctttatgatcccaaattcttataactcatagctgatcaatattcctaatagttatgacagaacggattgaatatgaaagctcaagtgacagcacaggatgagagaatatcaagataaggtcttgcacaaattctattctcttgtggtccatgctttcctaagaatttctcatcgtctctcagttcttttgccacttactagtaagggttaatatgagggccctctgagagaaaaatataagtaccctcattataatatctttttcatggtctggactagttttcattcttcctagaatttagacatctaccttcttcaaaaaccttgtcccaactgtcccaaacaagccattaaaacactgaattaagcatcagctgacaagacatttgcagacctcacacctttgcacgctctttctcatcagcatacgcttgaatttgaaaaagaaagagaggttttaatctcaaggtcctgttcagtatctttaccctgtgcactctgtgactgtgacaacatgaacttggtcttgcaaagacaatgctgtaaggttcttgactgtactggtttgggattagtctccttggtgatagagaaagtggtaaatatacataacataacagtgccccactgttcaagaaaagcattgctgaatcagaccaaaatgtgcttttggaagaggctggacagacacaaataaagctctatccatgctgaggtattcagttttgagagtatgaagtatgcctgtgagccatgaagaacaaaaacggttatattctgcttttaattgaatgccattcccacaatgtcagaaagaagaaggctgacgaggagcacctgctcaggctccagacacagctcgcttttatcaggagctatcaaacagggccttaaatattattgtaatgcagaataacgtggaccgcgttagcatgtgccacagaaagagagtcaagagactccagagttgggctgtaacatgcactatgttttctgtcagcccatttcaatttttccagcctgccatgttgacagcaagagaataaaggaggtcacagagggtgctgaacattaaaaattaataaaagaactattgcagtagtattttatataagtaacaccattcatgttttctcatttaagctgcaatgtctgaatattctcccatactataactcagtctaataaaactacaaaattacagcattagaaaaagtcttttgtgttgcagtctttaagcatacacacactggaaattatagcagtacctgaaaacaagctcagtcatacctcagggcctgttagcatttccataaaactctatttctaagatttataaattcatatataaatattcacttgggctataagcttaggtaagcctgggtagaactttcattttaaacaacaaaaaatccctaacattttaaaggacttgtacctcatttctaataggttctatattaagtttcttcacattaaacaatctgttttgaaaatagcctttctccacattgacagaattaatatagttttcctcctttaaagtaatgcttgcttaagtttaaaagtaatagaatctgaaaagcagtttaaataggcaatgataatatattttaggacagagcaagttctataacagagtaccttcagtatgagttatagcaaaacttagcctagcaaaattgtgttaaataataatggtttcaaattttacgagagttgtatcaaatatggttgtcaggacttcaaatgctgccttaatactgaaagttacacaaaataagctagatatttttataagatttttaaaaaatttaccatagcacagtgctaatatctgctcaagtgttgtctcagagcatggcaatgtctgctttcagagatgctgcatgaatcacagatttttaaaaagtgaaaactaaatagagtttaattttggatagccacctgaacacaatacatacttttcattgccagtgaaggatattttcccctttcaatatattctttagctgtttattcaattgttattatttttctcagaataagatttctgctctttgaaatgaagattatgttttgtttaaatacggaaatagtgaggcacctggagtagtatacctgctgtagaaaactgggcacatttcaggaatgttcttctagagaaaatgcattagctaataagggacagtgacttgcattgggaaaacgggatctcagctaaggaatgtcagtggaattatttccgatataagtagcctggatttgagagcaatgtctttcaaaggttggttcccaactcatgagtatactatgcaatcaagtttagtgaactgtaatcaacattttaaataatgaaatagaataagaaatgtcagaatgctttgcatatagttgggataagcattgtttggccaaacttctttttcagttatacacataatatacacttatatatgccataatgtaaaacgcactttttacttagttaacttcaaaatattttgagagttactgtttcagagggaggtctcttttgttaaataaaagaagtcaataagactatagaaagataacttctacctgctgtagcttaaaagttacatcaagagagcaaattaggacctcactccaaggtcttatcctcagctttgctattttagaagcactttttctaattcatctacagatgattaaactctggggggcggtgcttaaatatatgaaacaaactcataataaagtgatttataaacttgaatttcaattatgggagaaatacatcatagtattgctccattaaaaagttgaattatataccagatgatttcatagtgagaacagtataaaaggaaatcttgtttggtatccaaaaggaatattttttatcaaacaaggatggctgattcagctctccaccatataagtactctgtctaaaccattgattctaaataattctgtacctttctttggacagtatagatgtaacactaagttgttacgacctttcctttttctagaatccatgcagaaaacttctgttgcatcaaacagcagttaattcatgtatcatcacacagctgaatagtttattgggtttggagagaggaaaggaagaagaaattctttgacttatttgattggaaaaaaaccctaatctcagtaacaattataaactccatccttgactgcgtgacccattatttttcccagtttaatttctttttttcttgttttagtttgaaattttgacctttttttctgacttcattcccaaataatgagggcatcttaagatagcccccaaatcagtgattactatcacctatataaatggtgttatccagctgtggtgtgacattttcacatgaaatcctccctgtgggtaagattctttcagagctggttaagaatcagtcctgcatggcataagctaaagatgtctttcttgcagctgacttcatgaggataacctttattcatttacaggtgcttcgggagaaacagtattcaagcatttttcaatggggtgaattcatttgaagttttcgttgttgttccttgtgtttttaacttttttttattaatggggaatgaatttcattgtcctgtatatattttgtgtgttgcacttacaaacacatgcacattcacatatataggaaagagtgcagaaggcacttaaattgaaataatgatagacactttaggctcaatataatttacttcccacaagcttgaaaaacttattattttaaattattttatttgccaaatttgttctattttcaccaaaggaaaggaaattcttgttcttaacttcaaattttgaatgcttgtttgaagttattcattatgtatgaacttatacaattacaacaatagaacacatttttttcagtattaagacataaactttattattgatttctgaataattcataaaagatggcttttaagattttctgtttcagctcaaagttactcctctcatagaggttattacagaatccagtaaatgactgtgtatttctaaataagttataatggaatattccatgaatgttcttagagtctacaagtgaataatgaatgatttgaaatctagctgtgtgagatattggacactggcttgtatggttactagcttcctaaaggtgttttcattgtaaatccaacataggaaatactaataaaagaaggtacaagttagaaatttagctagtaatttgtagatctgcgtcagtgtagggccagaagtgagtacaaagtgtataatttagaaaacttgcacaaatgtgaatcaatatagtagcttagaaagggattttaggcatcgacttcacatcgcatagtttatgtgtttttaagatagttacttaggcgtgaattgttagaatgcaataataacttggcagcatacactgtgctactgggcattacgtaaacacaaatccagtgtaacccactctaatcatacacttattttgttgtatttattagtgaatatttgtgtaaaatcagggagatggcaaaacaaaacagattacaaactcagaagttttagttacatttttctttaaataactattttcacgcatgccagcaactgaagattttggcaggattgctttaagttcttacaccacacattacaattccatcataaaaaacagtgttagtatttttttaattgggaagttgtttttaatgtgctggatttttttatgtgtcaatcacatgattatcgatgcataaattgcttttagaaaaacatgcctattatctgtcatcaaatttaagctatctattgtaatcatcttgatcgataagagcttaggctttaacattgaagatctaaaataacctgatagataaagatagaatttaaatggataaaaatgtagtaattcatgcaaaaagaataattaaaaggagagccttccattttatactcacttttttcctttttttgtatggacaaaagtaatgcaaaaaatctggcctgttattcacctatgtaaaaacattcttagcttattacaagtttaactgatcaaactattaaagaacttgttatacaaatatgtatgtactatatttgcagaacagtcaaaagtaggcatttcaaatacagatgctagattacaattttattataaattatcactttggttgagagaggcttaccattagaaatattctcatttaaataatgctcatttgaatatattcatgtacagattgacaaagaatcccctctttcattatgttgcctttctcagagcctcagtatctcactgtttagccatcgttggtctgtgcaggagaccagggccctaataatagatttttgacagtgagctcgcctgctacctgccctacacaaatcttcactgttcatgtttgcttcatggcaacaaagcagacagaaggaaaatgccaagtgctgagtctgaggtacagccttgccttggcttgacatttcagcagaatagcagtttatgagatgcataatttttcatctgggactcagctgccatattcatagatgcttacagctcatggacagactggagcaagggcaaaggtttaaagcatagatcaaggtctacatcctttccttaggtattttaagataactattgtcctgcagataaatggtagaaccaaatagtatttaagagccaacaaattcatgggtacctggatattatatatattttcctttggttaaaaattaggaaaataaattaatgtctgttccagttcctaagaaaatatttgatagactttgtaaaccaaagaactctgacaagcatattaagaaaacttacctttgcagcagtggtaatgaattattaaatttctttcctctgtgtgtgttttttcataaagaatgatttcaagcttgaaattaatcaaaaaatgttctattatgaaagtaaaactagagagtattgtgtcactgtttgagcttgaatttaaatattcacagattcatgcatatctactgtactaaaaaatcagtgtaggtacacgtcagtggctgtttaatttagaactacacatctctgtaagcttcagaaacagttcaccatgtcacagtctcatacagaacaatggtacagtacattggattaattaaggaagccttgcagagaactgagttctcagtatgtcaagatttcagttttatgttaaatattttctaaaggccagacccttaaatctcaggggctgtaccaagcagtgagctgtgaatttaaccataggctaactgctaatgataaggaaaagagtcctagttgaggcagctgtaatacagtcattggattaggctatcaatcactcgactccctaaggaaaagggggagaagaccaaacagtgaaaagggaaattaggaaaggagagcatgactggaatgagattcctcaccatctctatccattcgtcgtcctaaatccctaagcatcagaccaaactctctagcattactctgactatacagccagcatatttattccttaaatctagaggactatcaaaatgtcattgcctctccgtagttgaagatcttgaaacctgctagaagcaaatgtctgattacataagaagaaatcagattcttaatttatgggatttaagatttatatttatgagtcttttatggatcaggattcatctatgttagtaaagaaaaatatttttatttaacttgtaaactgtagccaatttttgcatatcaacatcctcttggtgaggtgagattccagtagatcagtggttctcagactttagcatgcatcagaaactggaaggcttgttgtgacacagattgctggacctcttctccagagtttctgatacataaggcttggagggccttatgtatcagaatgtacactgctaacaagttccagatgatgcttttgctaccgatctgggaaccacactttgagaacagtagatgaagaaagattagtatcatcgagcattttagttagaatatcttatttccaaaataatgtcaaacgctttaagcaatggtaaaattagaggggtatagtatttgataaataaataagaatctctgcccacagttaagtatctgaaacaaattatagtaaatgaagtcagaattcttagaaaaagtggaacacagtctttgaggtctcagagtagggaataacattcactcttttaagattaaatgttgagtggaaaccattgtttatgcaaagagaatttattatgagtgccattgaagacaatttatggatatcactagtcctttgaaaaggaaacaggtgtgagttaggcaaggataaaattacgttctcgattgtgaaatgttatgtttttcttcttaactttgtatagacactagcatattgagaaataacagctctcttctaggacagtgcttacatgcaaatttacctagttatgttctcaaacccttaaagtgtgggaaacagcagtgctggtagcttactgctcttctctcttaatttactgctttcttgccatccccagacaatgctatccttttattagtggaagggaggagataatcaatgatttggagatatgctatttcaatgcagtgtccctgctgttagcactgttacactatgcactgagctcttccaaagtcatctttatagactgttcatgatattattcatcaatcctggaagctgcttgaaaccttctctgacagacaaatgtcctgatgtgcattcccaaaaatttagtaccatgtgaatggctggtagaaaacacctcaaattccaagaggtccttaagtgtggggcatagtaaacctttgagacacatacatggtgtctgatacttgaaggtggagactgccagggttatacaggagtgatgataagagttgttatcagaatagagaagagaaaggaatttggtcaggccagcttaactttacttgctatgcttttggagagtccaacgtttcaattcaattcagtgaaaaaatgttggattggaaagtgtactgaagatttttatatacagtacattatttctgtggttttcaaattgttatgcttacaaataccctacaattaaaacgttataaaccatatactcctcactcattttagttgacctgagaattttagcagtaagttcaagtgctagcaaaagacataatcccccatgttttgcaaatatgaattctttaaatgaaattgtttcagcattttttaaataaacctactaggaataaataacaccactgtgcttttttatatttatcatcacccatttaaaaattcataaacatgctctaacaaatagtgggaagttttgcctcttttttcctccttaaactcatattttaaaacaatttctccatcaaattttatcctatttttatgttttttttaaaatttgaacatcttaaggatcctctttggaagtactctttaacaaaatatatgtctataaatggacttttacattttaaaaattcctagattcagtctttaaatgataaatgatttcctgtattgttagaatttataatttatactttatcaaaacagcatgaatatatcataaatattgacaattattcaaaataaaagtgaattttattgaagattcatttattaatgagaaacatatggctttttaaataatttgatcatgtatctatcgagacatattattcttaaatagagtttatcatcagttttattcttttttttaggtgtagacattggaaatccttgtttatctaaataaataaactggaaggagtttattatagtcattttacctaaatatttggacaccttctccattgtaagcctaaaattagttagcgatcttcaccaaaagtgattaagcaacttgatgacttgctctttctattttattgaaatcagaaacctgggttttacctgatttgcaagaatttttgtcactcaatcattagaatcaatcattttctcaaaaccaacaccaatattttgaattattttgtttggtatccccaaatttttatattctatgtatatgttattgtaatatttgagatcaatgaaaaatatgctttttttcgaaagtaagggaaagactgttgaaacagaggagttgagacagaagaaccagcgggatgccttgattgcattgtttctcaggcatacaaaatttaagacatcatacatatggaaattgggaaactagaaaatgattcccttaaaatcagtttacttgtgggatatatagatttctgtgtaaagtgtaactctctgtgtgtatactctgtgagaaaaccactaacatatttcacttaatcttcacacaactttatgacaactaagcaataccttggttttccttttaatataaacttaactatgtctcttacagtagcactggcaattttaagaaaattatcaggctgagagcgatggctcacacatggaatcccagcacttcgggaagctgcggcgggcagattgcttgagcccaggagtttgagactagcctgagcaacatggtgaaaccctgtctctaccaaaaacacaaaacttagcctggcatggtgacatgcgcctgtagtcccagctactcctgaggctgaggtgggaggagcgattcagtctgggaggtcgatgctgcagtgagccaagattgcgcccatgcactccagcctgggcaaaagagtgagaccctataaaaaaaaaaagttatttatagatttataaatctcagtatttaagttaatatgtgctctttttggtatttggaaatttatgttgacagacttgtattgctagaaaattgatcaacatttctgcattcctcagcagcactggctattcaagcaatgcatagcagctgtgtgggaatatcgaggccttggaataatacaatctttatgtgcccagaactttattgaacactttgtatgcattcttatttaaataaccctgggaggtggataccattgggcccattctgcagacttagagactcaagtctagatacttaagaaacttgccagagtttacataaccaggatatgtcatagtctgggttcatactcagatctttctccaaaatgaacttttaggcatttttattaatatcagagattaacatctgtcatatctgtctaaatatagtatactcattaaattctaatagtctacaagtgtcacttactaatctaacatttattctctctggttttgaaaagctgccagtgtactcttctgtgacccttgttaaaattatgggccgatattacctgtttcactcagtctctatcttggaaaattgagtcagataggtaaattagggaaacattcttggattcgtttcaaggaacaaaaatgagaggcatcattcaggcatttttcttgaagtgtaagcatgcagctagaaatgtagctgccatcaatatagtaataaaaaactttatttcttactgccttggatgaaccgtctgagcactcagtctaactgtgatgccaagagcaactttggatgtccttcttaatttcttctttgtaatcctgagtaagttacaaatacctgtgttcctgcatatgtctcaccttcttttcgaacagattcatctttttccccaaagcaacatcatctcttttataatttcaactgagcttgcaaaagcctagtaagtaattcagatatgctaccttttcattagatgaggaaaaagagaaggacattttgaagacggtgaggtagggaagaaattgagatttaaaaaacctatactaagtcctttctgaagtgaaaaaggagctcacactctttctcatttctcctggtttacaacaaaacgatatataatataaataaacaaaaataaacaagaaggttaaactgtcttagcacatatctgtcatgatatggtgtgagaaatgttaattagtgtgtattaatttgaaaagaagtgtatggaacagaaaccatgagtccaaggaatgttcctaattagtctcagttcatttagcacattcggttgatgactgacctgtttggattataaacatcttaaaagcaagagccgttgtttccttcatatcgactcctccagaatttatgaaagtttcagggacatagtagacatgtaagaaaccccattttattcttaatattcagttgcatacaagcaggagcatttagtgattggactggttttttttgtttgtgacagagtgtcactcagtcacccaagctggagttcagtggtgtgatctctgctcactgcaacctccacctcccgggttcgagcgattctcatgcctcagcttcccgagtagctgggattacagactcacaccaccatgctggctaattgctaatttttgtatttttagtagagatagggttttgccatgttggccagtctggtctcaaactcctgacctcaggtgatccatctgcctcagccccacaaagtgctgagattacaggcatgagccaccacacccggcctggactgacttttaatctttgccagccatcttgattttgctgttgagctttggaaacttagtaagaaattctagctaatagaatataggccatcttactatgtgttagatgtcagatgctgggagcttttcacatgttatgctatttaatcagtacaacaaaccaatcaggtgggcacaattaggggcctgcttttttgaaatataaactgagacacagaaaggtcaagtaaattctataacatcacacagctggtatccaggtatatgggaatctctactgtctgactcttcatactgtacacttaagcactgtgcttcagctgccccttctccattgctcattctgtattaatttattccattaagcttttgtaatgtcttaacatattgtaggatgaaaatatatagtcacttttgtacttgacaaaaaaattgactgaaaacaatctataaatataacactgagattaatcactgttttaaaaaaattcacagtaatgacaggtcacaattacactgtaagtggtctagtaaacctctccatattcctattaacctctgtgcttcatgcatttctcatattaatatactgagaaataacacaaagaaacatatgtacttttcaaggcagatgccaaaggtttaatggatcaaattatttctatgttggatttttattcaatagttccaaacatttggtcttttttttagtttactccaatactaaaatgaaattatgaatttctctattaagtagttaaaatgaaaacataatagaaatgaattaggccaacaacaatgccttgtgttgttgaaatatctttttaccctagtgttcccagatccccaaacccttgttttaatagcaagcttatactagatgagggtgtggtaatattttgtagaaatagtgtgtgtgtgtgtgtgtgtgtgtgctcgcgcgtgtgcgcgcgcgtgcacgcatgtgtgtttgtgtctgggtgtttgttccttgtacattatttgaaatcactctcaaagacctttctttagtttcaccctttttatataggcttgtgatatggtttggccatgtccccacccaaatctcatcttgaactgtagttctcataatccccacatgtcatgggagggacccaatggcaggtaattgaatcatgggggcagttacctctatgctgttctcatgatagtgagtgagttctcacaatatctgatggttttataaggggcttttcccccacttcactctgcgcttctccttgctgccaacacgtgaagaaggacatgtttgcttcccgttctgacatgattgtaagtttcctgaggtctccccagccctgcagaactgtgagtgaattaaatctctttcttttatacattacccagtctcgggtatgcctttaatagcagcatgagaacagaccaatgtagcttataatacagcagaggtcactgaagtctttagtatgataatagtcacctgaggagcttttcaaatacacagattcttggaattagagcatctaattcagtagatgtttgttaaggccaagcatatatattttcaattagcatctcagaggattctgatacatgcaactttagtccccactttgaaaggaaaaaaaataaaacctaatgtggggtataacgcattataattttgtgtaaaaaaaatttaaaatgtttgttttaaggagaatgaaatgaaaaatatatatctttggtaggttaaatttagtcagtgatcattctagtactagtaattcaaatataggaatttagggttttttttagggtttattttattgtattttattatactttaagttttagggtacatgtgcacaatgtgcagtttagctacatatgtatacatgtgccatgctggtgtgctgcacccattaactcatcatttagcattaggtatatctcctaatgctatccctccccactccccccaccccacaacagtccccagagtgtgatgttcccattcctgtgtccatgtgttctcattgttcaattcccacctatgagtgagaaaatgcggtgtttggttttttgtccttgcgatagtttactgagaatgatgatttccaatttcatccatttccttacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccataatggttgaactagtttacagtcccaccaacagtgtaaaagtgttcttatttctccacatcctctccagcacctgttgtttcctgactttttaatgattgccattctaactggtgtgagatggtatatcattgtggttttgatttgcatttctctgatggccagtgatgatgagcattttttcatttgtctgatggctgcataaatgtcttcttttgagaagtgtctgttcatgtccttcgcccactttttgatggggttgtttggttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgttaactctggcttttgttgccattgcttttggtgttttagacatgaagtccttgcccatgcctatgtcctgaatggtaatgcctaggttttgttctagggtttttatggttttaggtctaacgtttaagtctttaatctatcttgaattaatttttgtataaggtgtaaggaagggatccagtttcagctttctacatatggctagccagttttcccagaaccatttattaaatagggaatcctttccctatttcttgtttttgtcaggtttctcaaagatcagatagttgtagatatgcggtgttatttctgagggctctgttctgttccattgatctatatctctgttttggtaccagtaccatgctgttttggttactgtagccttgtagtatagtttgaagtcaggtagcgtgatgcctccagctttgttgttttggcttaggattgacttggcgatgtgggctctcttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccacttgtatcctctttaatttccttgagcagtggtttgtagttctccttgaagaggtccttcacgtcccttgtaagttgggtccctaggtattttattctctttgaagcaattgtgaatggtagttcactcatgatttggctctctgtctgttattggtgtataagaatgcttgtgatttgatttttgtacattgattttgtatcctgagactttgctgaagttgcttatcagcttaaggagattttgggctgagacaatggggttttctagatatacagtcatgtcatctgcaaacagggacaatttgacttcctcttttcctaattgaataccctttatttcattctcctgcctaattgccctggccagaacttccaacactatgttgaataggagtggcgagagagggcatcactgtcttgtgccagttttcaaagggaatgcttccagtttttgcccattcagtatgatattggctgtgggttagtcatagatagctcttatgattttgagatacgtcccatcaatacctaatttattgagagtttttagcatgaagggttgttaaattttgtcaaaggccttttctgcatctattgagataatcatgtggtttttgtctttggttctgtttatatgctggattacatttattgatttgcgtatgttgaaccagccttgcatcccagggatgaagcccacttgatcatggtggataagctttttgatgtgctgctggattcgttttgccagtattttattgaggatttttgcatcaatgttcatcaaggatattggtctaaaattctctttttcgattgtgtctctgcccggctttggtatcaggatgatgctggcctcataacatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattgctctattcagagattcagcttcttcttggtttagtcttgggagggtgtatgtgtcaaggaatttatccatttcttctagattttctagtttatttgtgtaaaggtgtttgtagtattctcttatggtagtttgtatttctgcagtatcagtggtgatgtcccctttatcattttttattgcatctatttgattcttctctcttttcttctttattagtcttgctagcagtctatcaattttgttgatcctttcaaaaaaccagatcctggattcattaattttttgaagggttttttgtgtctctatttccttcagttgtgctctgattttagttatttcttgccttctgctagcttttgaatgtgtttgctcttgcttttctagttcttttagttgtgatgttagggtgtcaattttggatctctcctgctttctcttgtgggcatttagtgctataaatttccctctacacactgctttgaatgtgtcccagagagtctggtatgttgtgtctttgttctcgttggtttcaaagaacatctttatttctgccttcatttcattatgtacccagtagtcattcaggagcagattgttcagtttccgtgtagttgagcagttttgagtgagtttcttaatcctgagttctagtttgattgcactgttgtctgagagacagtttgttataatttctgttcttttacatttgctgaggagagctttacttccaactatgtggtcagttttggaataggtgtggtgtggtgctgaaaaaaatgtatattctgttgatttggggtggagagttctgtagatgtctattaggtccccttggtgcagagctgagttgaattcctgtgtatccttgttaactttctgtctcgttgatctgtctaatgttgacagtggggtgttaaattctcccattattattgtgtgggagtctaagtctctttgtaggtcactcaggacttgctttatgaatctgggtgctcctgtactgggtgcatatatatttaggatagttagcttttcttgttgaattgatccctttaccattatgtaatggccttctttgtctcttttgatctttgttggtttaaagtctgttttatcagagagtaggattgcaacccttgcctttttttgttttccatttgcttggtagatcttcctccatccttttattttgagcctatgtgtgtctctgcacgtgagatgggtttcctgaatacagcacactgatgggacttgactctttatctaatttgccagtctgtgtcttgcaaggggctagggagttccctttcctagtcaaagaaaggggtgacagatggcacctggaaaatcaggtcactcccaccctaatactgagagtttccgacaggcttaaaaaatggcgcaccaggagattatatcctgcacctggctcggagggtcctacacccacagattctcactgatggctagcacagcagtctgagatcaaactgcaaggcggcagcgaggctgggggaggggtgctcgccattacccaggcttgcttaggtaaacaaagcagccagaaagctccaactgggtggagcccaccacagctcaaggatgcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaggggcagactgcctcctcaagtgggtgcctgacccctgacccccgagcagcctaactgggaggcacctcccagtaggggcagactgactgctcacacagccgggtactcctctgagacagaacttccagaggaacgatcagacagcagcattcgtggttcatgaaaatccgctgttctgcggccaccgctgctgatacccaggcaaacagggtctggagtggacctctagtaaactccaacagacctgcagctgagggtcctgtctgttagaaggaaaactaacaagcagaaaggacatccacaccaaaaacccatctgtacatcaccatcatcaaagaccaaaagtagataaaaccacaaagatggggaaaaggaaaaaacagagcagaaaaactggaaactctaaaaagcagagtgcctctcctcctccaatggaacgcagttcctcaccagcaacgtaacaaagctgggcagagaatgactttgacgagttgagagaagaaggcttcagacgatcaaactactccgagctacaggaggaaattcaaaccaaaggcaaacaagttgaaaattttgaaaataatttagacgaatgtataactagaataaccaatacagagaagtgcttaaaggagctgatggagctgagagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaatgaacaaagcctccaagaaatatgggactatgtgaaacgaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactccttgagaagagcaactccaagacacataatcgtcagattcaccaaaattgaaatgaaagaaaaaatgttaagggcagccagagagaaaggtcgggatacccacaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttctcaccaccaggcctgccctaaagagctcctgaaggaagcgctaaacatggaaaggaacaaccggttccagccactgcaaaatcatgccaaattgtaaagattatcgagactaggaagaaactgcatcaattaatgagcaaaataaccagctaacatcataatgacaggatcaaattcacacataacaatattaactttaaatgtaaatggactaaatggtccagttaaaaggaatttaggtttgtgattggacactcgggtggactctccaaaagtctcactaaaatatatgaagacatagaggataaacaaaaatttaatgagatgggagaattgcctgagcctaggaggcaaaggttgtggtgagctgagattatgccactgcaccccagcctgggtaacagaaagagaccctgtctcaaaaaaaaaaaaaaaaaattaaaggaacaataaaaagttgactttcagccaattgtcagaatggccaagaaattttcacaaatattccatttagtgaacttcacatatggatttaaactttgagtgatgggattcagcagtagtagtccttctttactactcctaatttctgaccaggtatttctgagggtatgtatatatgattgtatacatcaaagagcaattataaggatactgtaataagtggttcagattttattttttgtgtttgttttctaaactacgaatagataaaaatagagaaatgaagcacttggcacttttatacctactttaaggcaagcaggattgctcttgttctgatgccataggatagaacctacagtgaaggaagcctcttcatttctcttcgtttctgcgagcaagcagttgttggaagcaatgcctaatgtttaagaggtctaattttcagaagccatgatcttcaagtagaatcagagacttcaagtttcctgtctatttactgtgaattttgtagtttacatatatcccttctatacagagtgttagaggtcaaggcaaggaggaaaagttaaaaccctccacctttagtcttgtagagtcccataaaaatctgctagattctgccaatttggctttgatccagacccgttagcatcaatgttgtgtgtgtctctagtcctgaaaaggggattttcccaaacaagcagacagaaaaagcagggcaattcacactgggttgaaacaagaagatacagaatggataggaaaatacgtgggaaatggaaagacaatacagaatcaaaaatacagcagcacaaataaaatacacattgctgttgtgacagagcagaattgagatcatggaaaattgaatgtgttgtgaaggatagccataggaatttctccagaaaatgtagaaaaatatgacagagtaatcaaaattatgaaagagaaggtgacaatgagacaacccaaaatgaattcatgatgaagtagcaggatgggagtgggggagcagaataatgaatatacatttatattcataaatgaaattgatctaaaacttttatttgatgctttaaaaaattgactagcaattaattttatattaattgctgggaaattaaattcaacagcacattaaaagatatagccatcctgaccaaagaagaatattccaggaatgcaaagatggcttaatattatgaacattattaacataatatactatataactgtatccaatatgaaaaagcttaattcttttgaaatgatctggaaactcattctaaaatttcagtatcactttctgtttaaaatcttagaaaactaaaagtagtttatgataaatattaatattgagaatatacatcataaaccaaaagtcaaactcacacttaatgagtgagtttactattaaaaatagttccattaaaataaaagtcaagacaaagatatataccatgaacattgttatttaatattgttgtgaaagttatgtgtgacacatgtaacatgaaagaagtgacgtatcattctagaaaataccattattgttaatagagatgctctgttcatatacctaggaaatgtgaagagttaatttaaatctcagaattaattaaagtataagatagtgagatgataatggtgatgcttaaggtattatatcggctgccttttattaaggagattttgtgtaccaggctctgagttaggcagctttcacaaagaatcattttataaatgagaaaaacaataccaaggcctgaggtccattggtacttgaggtcagatctgactgattccaaggcttatactcttggacccagtgttccactgtacagtagacacacaaacaattgctttcctatacaccagcattcaaactagcaaaaacgaagtataaaacactcattcttaaataatatatgggactgaaagaaacaacataactacttcagcatagagaagcagctttgaatatatgacaaaacacaatatgttcttatagtagaagactcatagtaaatacagcgtttatttcaaattgagttatattaaattgagttataataaaagactcataatatggcatttagttcaaattagaaatgaatatggcagttatttcaaattaagtcaattacaaaattgaaatgagcttttttctaagacacataaaattactttaaaatttaagagcaagaggaaacaggaaaaaatcactaagcaactttttcacctagatgaaaggtgaaaaaggacatacataacagattatttaaaccaatttcaaaattataataactaagacaatgttttctggcacaagaaccagtagattaaaccaatggaacagagaactctgaaatagtcttcgtatttccaagaatatcgcatataaaagaagacactcaaaccaattgtcagggaaacaaaagatgttttattaaacagataatcaatggataaattagctatttatttagaaaaaagtctaagtattaacttttcttcatactatgtatcaaaataaatagtagactaaaattttaacaattgtactaaattaaactattaaaaaagaaaaaagataggtgtatgtttatcctatttgaaaatcatttcaccataaagacacatgcatacatgtgttcatcacagcactattcacaatagcaaagacatggaaccagcctagatgcccatcagcagtggactgaataaagaaaatgcggtatataaacaccatggaatactacacagcatatgaaagtgaaatcatggcctttgcaacaacatggatgaagctggaggccattatcctaagcaaattaacatagaagcagaaaaccaaataccgttctcactcggaagtgggaactaaacactaagtacacatggacacaaagaagggagcaatagacactggggcctatttgagagaggaggttaggaggagggtgaggatagaaactacctatgatgattaactaggtgacaaaattctctatacaccaaacccatgcaacatgcaatttatacatgtaacaaacctgcacatgtaccccttgaacctaaaataaatgttggcaagaaaaaagttgaattttattttaaaaattttatactagtaaattagcttctgtctagtcaaataaactagtgtatctagaaaatatatgattttctgcttttgtctattagagtcataaaataatattaatgtatttcctaatattaaacaacctctgcatctctgaaaaaaagagaaaatggtaaaggaaagctttgtaaagataaaataaatggaaaaatatcagtgaaaatattgcaaatatttgactgcatattgtctttaattttttatatatcaaaaaaagaacaaaattagaagacgaatatgaaacagtgttcataagacaacaataatgcaattgcttcagaatcaaggtctatgacttctcactcagagagtatgatgtcataaaatagctgtatcctcaacaaaagctttgtagtcaacacagtaacaccagtgggttttctcttacaacatccctcagtgtaggtttaatatcaaacataatatcaagtggtaagtcaataaaagcaactctgagctgctctggcttaaaatagagatagatatttaaagttatttgagcaatagatggaaaaaagccaataacttatgtgcaaaaactcttaaaactcagtttgcgaagacatgcaaagtgaagcaatggtgagctatttttgagtatcaaattggtaaaatatttaaaggcaatatataattcaaagataatgatgaggtagataattttataccctactcatgatattgcactttgttatacatcatgggggaaaaaattaaaattattccctgtgtgtcctaattgatgttatttagggatgttccttagcttatgtgtgttaaaccctctatttctggatcccatacatttctcacccttagtatatttacttatttttctgggacttagtttgataacttcctgagatattctaagcattctgagaaactttagataaaatttgcatatttgaaaatgtttttattctatcctcatacttaataatttgattgggtataaaattttatattgaaaacaatttttaattaagtatttatagccaatattctagtttcttctatcagttatagagagggctgatctcatctgttatctgctctttgatttaaattatatatatgcacatccatatatatatttatatattttctctctttcaaattgttttatccttttggtaggatctactctttatctcttgtgatctggttttcacaacctggattttccttttaatttcttgttttactctcagctcttttctatgtggaaaattttatttttaggtctggaaattctctggtgttatctgtttatcattttttcttcccattttctccattctttcttttagtcattctcccctctgatttattttgttttgtttctcctatttgaattttgctttctcttttgggagatttctttgatatcatacctgtaacttattttttattgatcattatattttaacttttgtacaactctttctgcttttgatagtttttaaaataatgttgtatttataatcgaacaataattgtatttttatggggtgtgtagtgatgttccagtgcacgaatacattgtataatgatcaaatcggggtaattaccatatccatcactctaagcatttatcatttctttgtggagataagatttaaaatcttcgaggtatcttgagatatacactatattgttatttgctgtaatctccctactgtgtaatgaaacaacagaaatgtttcttcctaactataactttgtattcattgactaacctatccaggcccctgctccccctacccctccccagtctcttaataccacttttctactctctacttccatgaaatcaactttttcagattccacatgtgagtgagttcatgcagtatttgtcttactctgcctggcttatttcacttaacgtaataccctgcaggttcatccatgttgccacaaatgaaaggatttcattctgttttatggctgaatagtattccattgcgtacataccacattttctttatttatctatagatggccatttagtttgattccatatcttggctgttgtgaatagtgctgcaataaacatgggagcacagatatctcttcagcatattgatatcattttctttggtggtttcttcttgattgcattatcttttggatgcagttcattctgtactgtctctgaagatgttagctatgtttggtttttttcttacagtttcccttcaatgcgtatataaatctctatatcttctgcctcattattcatttatttattttgattatttgttttggtttctctagttcatgtaaaaaaaaagacttctgaaatgtctggagattcaagacatcctcaatttagtttttaagtgtgagatattaaaaagttgattggaagccttgagtatgtgagtgaaatttaacagctagggagctttattgcagaggagattgagtggtaagctcttccttttactgtggctgacaaatgtgagtatcttcaggtcttttctctggggataaacaatttcttagaaggatcctcagatctccgtcatgaaagcaatgtgcctttctgtaaaaaagggatcagtggatgaatggtagtcccagctttcaatatgcagactttcatttcatttccttgctttcagtttcctgtctcaattacagccttccactagttttgatatctggagtatctctagtacacttctataaaaataaatttctgtctcacgcctgtaatcctaacaccttgggaggctgaggtgggcggatcacctaaggtgaggagtttgagaccagcttggccaacatggtgaaaccccatctctactaaaaatacaaaaattagccaggcatggtcatgcacacctgttgtcccagctactcggaggctgaggcaggagaatcgctcgaactccggaggcggaggttgcggtgacccaagatcgcaccactgcactccagcctgagttacagagccagactccatctcaagtaaacaaacaaacaaacaaacaaacaaacaaatctctgtctccagtggaccactagaaacctgattgcacagggttgtgatggaaactggggtccaattggctctatataccatcttcagacagtcttcacatttcacccactgtgcctccctgcttgaactgtgctctccagtaccctgtctttagctgcctttttgggagttctacatgttgaatgttcttttttttctactaagtcagttatcattttacaatctgcttttcatcttccaaaacttctcatatatgtgtggggaatctgccatgtttaaacaaagtatggggtatgcttaatgtaatttcaaaaacaatcccttggaaattgtaatatcagaatctaatgtcttacagattcaccactatgctcactacctgggtgacaggatcattcatatcacagacttcagcatcatgcaatatactcatggaacaaatctgcatgtccgtcacctgaatctagaatcaaagttgaatttttttaagaagtcatatattttaaaagtcaatttctgccattcagaagctcaagtttagtgtctgcaaagagctgtgggaaaaaaaaaatttttacgaaataccattgtcttagtaagagtgtaatatatatttatgtatatatgtgttagagtgtgcatatatatctacacacagttaaaattcatacactgatagtaaatttcattgtgcaagaaaaacagattattatctgcactgtcagaattcagggttatagatttctctagccctttgcatcattactacataacagaaaactttgtttcttcctaaatgatgctttattttcaactgtacacatcagattatcctcatttggctgtcctcatttttctctgcatattttgaaacttttagaggggagcaacaacaggaaatctgtttgggggtttaataaaaccaccaggtatttggcataattgcagctctgatctgtgactttttaaatctaggcattgagttaagaacattaagaaacattgaactatcacagcttagtcatgtgccggcacattatcaacaacaatggcacatctctttccctgtccatttactttctgtagtttctggttgttctgccctgaactgtaatgtgataaggggcagtcagaaagtaaatgtaacttttaaaaattagattatcaaaaacacagatttgttatagactggcgcattacttttggcttttctggtactttcttatgagatgaagcccctgagtaggcaaactttcactaacatttctggtagttactagtagttaggtattgctcaagacagaaagaaacattttagaataaggaaaatattaagctgcaatcaagagaaattctttttaatctttgcatttcctggaacagactgagtcatgagatgaattgacagtaaacacttaacactggcacattagtcagagttagtcacataaggtgaactaggcaatcacaaactaaataaatagatcagaaatcccaaagacaaagggctaaatatagtagaatgctcagaaacagcaataaggatgcatggtgtgaagtaagttgaataggagagtgaatagttgacaatgagattggaggactaaccagagatcatgtaggccctgcatggattttgggatttattctaattgttaaggtagttatatgatctaatttcaatttctaaataaatgggcaccatggctgttgtgtagcagacagactatacagcataagaatggggacagggcaattatttttaaagctaattcaggaatctaagcaagagacagttgtggtttagaccagtgtagtagcaatggaggaattggaggagggagaatgttgtgttcagaatatgttttagagaaggtcaatgggattaactgatgggttgaatgtgtgatacaagaggaaagggaattataaataacttcaaatagtttgggctgagcatgtgaacaaacagtagtgccattttaagtaaactctggagaacagctttatggcaaaagagtaagggaggaggatcaatagttcatttctgatttgaggggcattttgtttgtttgtttatttgtttgttttgtgttttttgtgttctctttttttttttaatttcaactctcattttagattcaagggtacacgtgcaggtctgttacatgggtaatttgtgtgatgctggggtttgggatatgaatgatcctgtcacccaggtagtgagcttagtacccagtgagttgtttttcaacccttacctcctttccttcctccctttctctggtagtcccaagtgtctgttgttcccatctatatgtccatgtatacccagtgtttagctcccacttataaacgagaatatacagtatttggttttctgttcctgcgttaattcacttaggataatggcctccagatgcatccaggttgcttcaaaagacatgatcttattcttttttatggctgcatagtattccatggtgtgtatgtaccagattttctttattcagttcaccattgatgggcacctgggttgtttccgtgtctttgctatggtgaatagtgctgtgatgaacatacaagcacatgtgtctttttggtagaacaatttatttccctttggatatatacccagtaatgagattgctgcattaaatgctggttctgttttaagttctttgagaaatctccaaactgctttccacagtggctgaactaatttacattctcaccaacagtgtataagcattcccttttctccacaacctcaccagtatctgttgtttgttgacttttttttttttttttttgagacagagtcttgctgtgtcacatttgttgacttcttaatagccattctgactggtgtgagatggtaaccctttgtggttttgattttcatttctctggtgattaatgatgttgaacattttttcattttttcattgttgcccacttgtatgtcttcttttgagaagtgcctgttcatgtcttttgccagctttttaatggagttatttatgttttgctggttgacttgtttaagtttcttatagattctggatattagacttttgttggacgcatagtttgcaaatatttcctcccattctgtaggctctctgtttaagctgttggtaatttcttttgctgtgctgaagctatttagtttacttaggtcacacttgtcaatttttgttgttgttgcaattgcttttgagaacttagtcataagatttaaatataagaccattaagagtcctagaagaaaacctaggaaacaccattctggacatcagccttgggaaagaatagttctttttggatatgttgaacttaagacatcttatcagacatccaaatgaagatatagattaactagttagatatttgaccctgaagttcaaggagaagaaagaactgaatacataaattgaaccttcatgccataaacatgttataaaaagttgtggaacctgttgagataaactaagaaatgcatacagataaagaaaaaaaagaggtccaatggctattttagcattttatgaacaggaagagtaagaagatccagcaaaagaagctgagaggaagaagatcaggagaaggcatgataagccatgtgcagtgagatagctatgcacatgtctatgcctcaaggagagaggaagctaacaggaagctgacttatcatggaaaagaactgaaggaagatttcctggaaagaggaaggattgagataaattaatcttcaaggttttaggcttataaataattggcaaactattatccacctcttctagaatctaaatcttgctccctttaaggtgtgtgcattcttataggaaatagatgacatatattcaaacacctcaatttttagaaatttcaaaatttctaaagccactttcacatactcataataaccctgaatgacaaatgtttgtaactactattacgcagagtttacaggtaaaggaaaataaggtgaacagatctgcccaaaggcaaatagaccactgcaaagtgacaaaattgggagtagaacctcttgccctctgaatcctagattcttatacttttcactccattacctattgcagtagaaaatttggtacctgtcaaaggagcaattcaaacaaagatctgtaggagctccatgggggagtgatcacttcttactggaaggatcagggaagactttgtgggagagataacattttaactaaaacttgaagaaagaatatgattccaggataaaagttacctagtcatggtattccatgctctggatgattttgtcccagcttacatctccagccttttctgttgccatcccctgccactgccccaggccataatcaaccatactgagctactcacacttttacctaatgccaaggttgctcttgcttctatacctatggtacctacaagcatactgctaccttagacacagaggcatttctacccttagaaccagcttctcagtccaatattttccttacactccccaaactactttagaagcccttacccctgattccatgcatcttatgcatcctgtgcatctctctcgtgtttatatcatattctacatataatttcttatctgtgaacttcaggggatcagagacttgcctggcatataactgatccctagacccacacactaggatacaatggttaccaaccagcactgatcactttttgacaacctggagcaacttcctgtgtaatagaacatattatgttggtgcaaaagtaattgcgcgttttgccattgaaagtaatggcagaaactgcagttacatttgcaccaacctaatagtaaatgctggtttctgctttatcatcatgaatgagtatttgtactttggttcatattattttgtattagtccatttcgccttgctataaaggaatacccaaggctgggtaatttataaagaaaagaggtttaattgtttccaggttctgcagactctacaagaagcatagtgctggcatctgcttctagtgaggacctcaggaagcttctgatcatcggggaaaacaaagggagagcagatcagatgtgtcacatggcaagagagggcacaagagagatgccaggctcttttaaacaagcggctcaggtgtgaaataatagattgctagaactcatgcattaccacagggatggtaccacacccttcatgagagatctgcccccatggcccaaatataacccactgggccccacctctgacagcggggattacatttcaacctgagatttggaggggacaaatatacaaaccatatcatgttctaggttccttgaatttagatgtatatatccaaattcatatttattttctcgtttttattctttaaaatgtaagctgctaaagtaaatattgccttaactttatgttgtataaaatctcctatttagcacaataggcatcaaagaataattcacaggctgtgatgataataatttagagttttgttctttcttcaaaagtaaatgtttccttcaactttaccctgaaaattcaagaggaaaattgaaatgatggcttgtgaactttttgttgcatatacatttcattattgccttatccctggaatattattactaaataattttgtttcagaattgtacagatatcaagaaatattggggcttcagggtttcaaataatgcaaaagacatatcagacaagcaagacacttgcattttaatatgtgtgaactcatgcaagaaagagaacaggattgagagagctggataaatgtcttacaaaaaagcaataaacatacaaatcctccaggaaaactggtgcagtaattcaatcacatattgacaatgtctatattcctagataaatgcaaaaagactttccaatttataaatagcttaccaccttccttagtcctctctccacactgtttaaagtccatgacaggtaaacacacaaaagcaaagatttacactttaaaggtttaactgccattttgcagtcagtatggaggtaattgtactatattaaaaagtggtatcttgtgagagggagtagtttagttggagtatagatgaagagctagtctgtgcctcaaacatattttatataattctgcattgattttctgcattccttttttgcaaagattttaggatcagaaaatattgcgtttcacccttggccttgttgggcccatggcaaactatattttgaaaggcctgaacagttagagaattatgtttctaaaatttatctttttgctggatactattagcaaatttgacttaaaacacatttaattttgaaaattgtatgtcataacattaaaatacagtcatctacaagttgtttgaaataactatttggcatttaatgaaaggaaacatcccacatttctgtctcctctttaattttatagtaacacccgtaaaatgcccttatttctgattcccttaggcaactttagggttgaaagttttgtacattgacttcagcttaaatgtgatttaacatttaatatccactctcctctgaaactgacgggagaaaacacacttgtttcattttagcacaactgaaaataaagaccagtgataggccacatcctacttatctgatctcagagacaccttataatagaaagttcagggttctgattgttcaatattctaaagcagtcattcatgtaagttccatcagaaagatatgaaatagcttgtagtaacgtatcttttcctcagtcaaaaagaaaaaaagcttgaactgagtgaagatcactatgtcattaatctacttaaagattaacctttttaaacagccaagatgtgtaacgtacttgttcttattcaaagttcaattgtgttcagcaccatggaaagttttatgattgaatatatgtaattatagtatatagagattaaaaataactcaagggattgaacaaagttttccagtagttaatcattaatgaagatcttaaatctgtactttaaatacagacaaaactagttataatgatctcattagtgccttattaaggttatctattttagtatttgtcaggacaattcagacggaaatgaacttcttaacatgtttaggagaggttgatgatcgtttactcagttaaaagacataccatagctgattaattgctgtgcaaataaagagtcagactagaagcaacagaatagctaaatgtagcccattctgaaatttaactttcatgcttgtgctctctgccacatttttgtttgtttttattcatgaggccagaaaatatgttttaaaatatagaggaagttggagaaaaagtagagaaaaagtaaacaagactgtgagttttattttcctaggacttggctgagtgtcaaattgaatggagacctttcacaggcgttcaaaacttgtgtttttaaaagagaaaaatgtgctggtttgcctttgacaaagtctgttgctctaagttcaaattgcagaaagaataaaatttttcagaaagaggctagcaattacttacggtatcagtttgctcttaaaaaggaacactgtgatataagggcaactgaagctgcagttattgatataaatatacttcagggagaagaacagagtgaatgtcaaatcatcagggaacatgcttgagatcaattattcaaagtgtggaagtccttccatttggatattgtgattcaatagttcaccaagtgggagaaaggagaatgcagctatttgaggatgtggtaaggtacaaaacagtagtgagtagggactaaattgaaaatgatctatatatttatgccctagtaatttcttttaatctgcattagcaaaacatgcttttatggggttttcaaaatataatatcggcagaatgtggagaatatgcagatttcttgaaaaaggttgaatttaaaatagcaatctctctttgatctttattacaatttttcctccagtacacattacctcttctaagaggacaggtgaggctttgataagtattgccatatctgattgatctctaaagcccaaagaacctacttgcttaaagtttttctgagctggtcctttttgtctaattccacaagattatctctgggaatactgcaattaacttcttcctgattttattttatttctctcccttctgtccattctctacactacatttaattttcttttattttcaaaatccttgttaatgatgtccacaagctcattcctaagaacgtttctatccttagctttccctgcctgcccccaggctcagctgtgctccagtcagagggaactgttctactctctaatgcaccatgctccccacactccgtgccttatctcttgtctggggaaatcccagcttccttcaatgtgccaacaaaccttctctatgaattctttagctgaatttgatgcttcctttgatgggaaacatactttcagtgtgtttctgtcaaaggacttatcattttgtgtggttactgcatttctcttttagcagtttgcaagttctttcagcacagaaatgtcctcttggtcattttttaaatcttgcattagcaaagtacctggtatgtagtagtaggcactcaataaacacttggggaaagaataaaagaggcaggtattaagagcagaaatcttcctgaataaatttgctcgaaatatgtaagagtttgtgagagaacttacataactaacttctccttaaactgtttaaataggcaaggatggctcttgaagaacataaccagacaaagtttatctttgtccctctcacttttacttcctcttttagcagacaaattcccagtgttcacagcacctttcttcatttgagacaaacatttttctcccaaactctaccttatgtagcaattgtttatatatgaaatattttctggccccacacttgcagcagagcttaccagccccatgttttaccctctcacagcctttagagcacaggtccatatgaatggggaatggtgtaaatgttgtagttaatgatctttcacagaaaatgtgtgtgtgttttaattagatttttctagatttaacacaaaggaatagcttgaatatgagaaatatcagcacttggttgagatattgcaagaacacagattggggtagggaagaataaaaaattatagtctatacacattctactggaatattatgatgcctctcaaccgcaagatgaccatatatctttcctttgggaagactaaacccattctccggttgtttatgaatttagactcctaatgggaaattgttagtgattctattgctttctttactacttttcttgcctcctctcttcctttaacaaatagagtgctttctatatgccactctgctggaatggcatgaaggaaacatacatggccccaggccttcgtggtgcttataacctatgtccctccgaaaagcacctgaaatatggaagagtttacagttcttcatttgagccaaatgatgtgacataatctcatatgcttttcagagggaatttgggcaattaaatcttatcataaatttgctgatgaagtaatttacttggaaagatattgagcgctgtgtactgaattgtgcccctccctccaaagttcatatgttgaagccctaacctcctaacctccaatgtgactgtatttggagataaagcctgtgaagaggtgctgaaagttaaatgaagtcataagggtgggtccctaatgcaatagggctggtgactttataagaagaggaagagatatcagagctctctctctaccatgtgagtgaggacgcagtgagaaagcagccatctccaagctaggaagagagccctcaccaggaactgaatcagccagcacctcaaccaccgacttcccagcctttggaactataagaaataaatctctgttcattataaattacccagtctttggtattctgttaaaacactataaaatggactaagacaggaaattggtaccgagaagtgtgactgctgctataacaaatatctgaaaatgtggaaatgactttggaactgggtaacgggtagaggctagaacagtttggaggagaaggctagaaaaagcctaggtttccatgaatagagctttcaggacaattctggtgagggctcagaagaagacaagagctacagggagagcctaaatcttcttagggattacttaggtggtcataatcagaatgttgtagaaatgtggatggtaaggggcattctgataagatttcagatggaaataacgaatgtggtattggagacttgagtaaaaagctatccttgtgcagttgcaaaaaaaaatgtggtagaattgtgtctatgttctaggatttcgtggaagacagaacttaagaagaactatctaaacaacatctggcaggataaatatctaagcaacaaagcattcaaggtgctatatggtggcagcttacagtaaaatgagagagagaaatgttttaaagatggaacttataattaaaagggaaacagaacagaaaacattgaaaaactctcaacttagccacataaagaataaaagaatgtgttcaggagggaatactaagtgtgtggctaagcgactgtttgctaaagagattaatatggatagaagaaatccaggttttattcatcaagactatgggagaatgaccatggaggcatttctgagatcttcaaggcaagttaggtaggacattgaaggcagggtttctagacaggggctcatatcggacctcagcattaggtgccctgcactatcttgagactttgttccctgaatttttgtccatcaccctcagcttccccagcagtggctcaagcaatcctaggggcaccttgatccatcactccagaaggtataagctgcaaaccttcacagtgtccacatagtgctaattcttcaagaatatagaatacaggagctctggggccatggcaccctccacctagatttcaaaggatctctcggttagcctgggtccctaagaagagacttgtcataggcacagagccactgcaaagagctattactagggcaatgcacagcagagtgcaggagtgagactactgcagggaatccccactttgacattacttagtagagccatgggagtgaggcagtccctggaccccagaactgtggtgccaccagcatgcaactgtagcctaggagaactgcgggcataagacgccaaattgtgagagctgctgagtgtactgaacccatcaaagccataaacagggctgcccaatccctaggggcccaacccctgccccagtgtgtccaggaggtgggacatagagtcaaaacatattattctctagctttaaaatttaatgttcccttcttgtggtttggacttacatgaaacaagttactccttttttcttgcctatttctttcttttggaacgggaatgtctatcctatgcttgtctcaccattgtgtttttggaagtagataacttgttcgatttcccagactgatgggaatttgcctcaagatgaattgtgccttgggtttcccccatatctgactttcatgacactctggactttggacttaggagttcgtgctggaatgggttaaagccattgggatggaatgaacatattttgtatatgagaaggacatgattttgagggaccatggtggaatgctgtggtttgaatgtgtcccccaaaagcatttgttggaagcttaatccccaatgcaacagcaataagaggtgtgaggtgattaggccataagtctccaccctcatgaatggattaatgcccattcatgagggtgattcctgagaggtgataagccataaagctccaccctcatgaatggattaatgcccattataaaagcgcttgaggctgccagttcaatctctttctctcttgtgtgcgcctgtgccattctgccttccaccgtgggatgacacagcaggaaggctctcaccagatgcaggccccttgaccttggatttcccagcttctggaactgtaaaaaatgaatctgatcttcaatctgaaactgtaagaaatgaatctgatcttcaatcactgataccctttcttccacttgatcaaaaagtgggcaaaggatatgaacaggcacttctcaaaagaagacatttatgcagccaacagacacatgaaaaaaatgctcatcatcactggtcatcagagaaatgcaaataaaaaccacaatgagataccatctcacaccagttacaatggcagtcattaaaaagtcaggaaacaacagatgctggagaggatgtggagaaatagaaacgcttttacactgttggtgggagtgtaaactagttcaaccattgtggaagacagtgtggcaattcctcaaggatctagaactagaaataccatttgacccagtgatcccattacggggtatatacccaaaggattacaaatcatgttactataaagacacatgcacctgtatgtttattgcagcactgttcacaatagcaaagacttggaaccaacccaaatgtctatcaatgatagactggattaagaaaatgtggcacatatacaccgtggaatactatgcagctataaaaaaggatgagttcatgtcctttgcagagacatgaatgaatctggaagtcatcattctgagcaaattatcacaaggccaaaaaaccaaacaccccatgttctcactcataggtaggaattgaacgatgagaacacttggacacagggcagagaacatcagacactggggcctgtcatgaggtggggggcagggggagggatagcattaggagaaatacttaatgtaaatgacgagttaatgggtgcagcaaaccaacatggcacatgtatacctatgtaacaaacctgcccgttgtgcacatgtaccctagaacttaacgtataataataataaaaaaagaaatgaatatctgttcattacaaattacccagtctatagtattctgttatagcagcatacagcagattaagacaccaaagatgcagaaccctgaactgcaggacacagcaatgatttgtttaattgatattagatagcactcctagattttgtcttgatgtccttgtaccctctctccatggtgcagacgtatcttctcttaatagatgagcattctgaacactaatgtgctatttttcattctctagttagtattctcccttgatatgctaagccaattggatactgctgcctaggggcatttattaatacccttctgaactcaaaggaacaaatgacacagattttataacacaggatatccctgaaattcatattctactaaaaatattatgagctaattattgtgaaacttagattaagtttatttatttctagatgtccctattagctaaaaaacctggtgatcagcagtaactttattgtgtagtactatttgtctaaattcatgtgactttaaaagtaatttttacctttacttaaagcacaatgtatttaccaattaaaatgctgtagaatgcatctcatatagaaagtttaatttgtaaacttctgagtaaaggaatcaaatttagaccaaaatagagtgatggggttttcttagaaacttagtcatctaagtagagagtatcaaaattttctaacttatgagtagatagagtacatgtttgaaattgagcatgttagtcagagacctggaatgattaaagaaaaaattgtatttaaaagtttaataagaagattaaaaggtcacatttatctcaaacagtagtgatataaaaactatacactacataataaaaaacagataataagattttttgtacatcacaatgacacaaattctaccacattcaaactcccacaggtgggactgataaagacaaatgttattcttaaaacaattcttgtaggatatattacatctagatgttaaaatgctctgattcaattatttatccattaaacatatatttgtaaaagagcctaccatatgccaggtgctgttctaaattctgagcgtagagcattgagcagacaggaagcagggattgctgtggggaggagagaataaaaaatacataagaataatctcaaatacctctaactgttatgaaaatagcaaaactaggtggtataattgtgatagaaaaagagatgggactttagattaggggtcagagaagatgtctttgagaaatgacatttgggctaagacttgtatgaacagtgccaatcatgcaataatatggatttagaacaccaagaagagggaaaaggtcatgcaaaggacctactaccatgagcttgggaatttaagaaacaacaagtatcagtgaggcaggagtctgataaacaaggtgaaagtggtatgatgtaatttataacgaggattcccagtatctaataatggcactgtccacggatgaacgggacagtcttgctattactatctattggggtaaaattgaagggacaaggcaaaatataactgaaaactataaagttttgtctttctcataaccatatctttgacacatgctgaggaataacatttctctgaaaacaaaaacactttcaggtctcgaagtcatagtggttttatatttaagctttgccttgatcaagaaatatctgatgtgtggataaagacagcaaaaaggttgtagtcagcagacccaggttcgagtcccaatttaaatataaattagctttgccttgtggtgttgaattgtgctgttttgatccatctgagcacaatttattatctataaaatatggtaattgtgaagatcagctgacatttaggaagcttaagttagggacaatgatggaaaaatttattactgtgtaaaagttaaaataggatttagggatgtggcttatgcatttgtcttagcttagtaaaacaaatatgattaatggaaacggtattgtttcgacaaatcactggaattttcaattcagaaatgtataaagtgggaagagaagggttggctcacacctgtaattccaacactttgggagaccaagcagggaggattgcttgagctcaggagttcaagaccagcctgggcaacatggcaagacctcatctctactaaaaattagaaacaaaaaacataaaacaaaaaaatactagccaggcatggtggcgtgtgcctataatcccagctatttgagagggtgaggcaggaagatcgcttgagcccaagaatttgaggctgcaatgagttctgcacttcagcctgggcaacagagtaagactttgtccaaaaaaaaaaaaaaaaaaaaaaaaaaaaaaacagaattttgctattaagattcagaattggcagtcatagctatctgtaggtaaccaaaagaatctagatcatgatctggctcttccatttcagcctgattctcattgttgcagcattgatctgattttatctttagtcattattttagaaaaaaatagataaaagaaaaaagataatatcaagggctattttcagccatgttataagtacttgacatatattaaaattttgatcatcaaatgaagggggtaatttttcaattatctgaagtatgtgtttaacatgtttttgttgtggtggtagggtttattttgtttgttttggaaatattttggtcagaatctcaccatacccaatctcatagaatgttttgtcaggttcagtgaaaaggagaatgtagatgtccaattaattgatatctaatgaggaataaaagttagaaggcaaacaaatgtattaatttggaaaaatgctatttttcatatcatgtattatacttaatcaccatagagggtataggttttcatcagtgtactactgattcccactatattttcttaagtgtaattgttttaatggttcaacccttaaataataaataataatggctatataagcttcaaaacctcacagcatccttgtagcagaagattctaagtgcagagttattaaaattgtaaactatttgtttttaagtttgtgggaatcattacccatcatctcatctgtattacatttgtttttgaataaagattaacatttttttccaagcctttttctatattgtaatcatagtggggaaatggtatttcagacctcagataaaagctttatagtgatttcatgtgacagaattttatctgggtttcaaggaactctaataatagcatttacaattcttctatgcaatttcttctcttcttgttaccataggagtatggaaaacacgttcttggtttaaaaagctaaaagaaagaaaatcagcagtttaatctgagtattaggaaaaggatcacaaatcctgctatagtattttgtatttaagctagtttctgtaaaggcccctgacatgccctctgggagctaaatattgacaagcatgctttggcaatcaagatcaagcttgttgaattaacacagctcaagtcttgcattgacactataacccaacactgagaactgttatcttaccccatttattttggctttgtaggtgatactttatacttgaattagggatttgcactgtatcttaaatgctagaattgtggattaatttgatttgagaatatactagcccttatcatgttcacagtggaaattataaatgaagtgtaacattcattgttttctctcccagcatggatccagaatgaacctgctgtagacctaagtctgatattatcttctctatcagaaaatgtcttataattttcacctcctaaaaaaagaaaaagaaataagaagaattatattgttctttatatagcttctggtaaaagaaaatatatcccaaactgctaattctgtagaggcttcgttcagaagttaagacaaaatatagatcataaaagaaataaagattatttttcattactactctcaaaactttagaattttaaaaagttaaaattaattgtcttcaagttttagtggaaaatgtaacccatttttattgtccaggaagttgaagaacgaattgttaattactaggaataataatgataaaggtgatgatgttggtaagaactgacatttattaagggcttacaatgtgttcaaccctatgtggagcattttacatgcaatcgctcatctaactcacatgagatagatacttccattggcctcatttcatatatgaggaaaccaagactcaaagaacttaaggagcttatctggtcatgcccagtgtgcgtaaagattacctttattttctttccaatggatatacctacagtcaaagtagtaactagacatttctcctgcccttacggagctcacacattaaaagatgaggcaggtgggtattgctattattcaagatgttgttcccactcatgctagagagaacaaaaagaaaggaatctggtgattgaggatggtctaggagtgctccccaaaggatgtaatatttggtattagccttaacaaacaaagagaagaagacaaaaacaaaaaaaaattcaggcagtaggaatagcaggagaaatcacacagaggtgtgaataattatgatattttcaagaaacagcaaatagtttagtgtttaaggaattatcaggtagaagtcacatgaatgatgaaaaaaacttacggagttttaatgtcagaaacacactcaccagctgatgacctcagtaacttcactgtgaactgaagataatgccaaaaatcagacttcatagagctattatgaggaataaattagctaatgtatgccaaatgcctgcctagcctaagttctcaattctaaaaacacagttttatctcttaactaaattcataccctttgctaccttcagaagtaattttggaactgccatctcaaactattttctttaaataaaatagtcatttggcacaatttccctttgaattttcctgcttggcaagttaggagagagacacaaatcgttcttttttaaaaaaaaaaaaaaaaaaaaaaagatgcatagtcttttatcattttctcaaagaaagtcatcataacttcatccacactagcaagtgtcacttgatacttaattttctcatatttgtgcagttggatctctacattaattttggatagatgtgattgcagatacatatatttacaataaagtagctgtcataaaaataatgtattctaaagttaaaggtgtccatcacagtgcccagcgcatagaggcatccattagctccccttccctttctttcctttcaaatttatattaaaagccttttctgaatctacttcgaaaagctacatggaaagagaactccagacattttgccagtgacttgtttgtcatgtgtttgtcatacgtcttcacaattctagactaagtcttcacaatccagcaactatttacacccctatctacaattcagtgatcatttacaaactgtttacttatggtgaacgattatctcttcattctgtgaaaacaaaatatgtgttctcacttgcatgccttctttgaaaacatttctgaagtttgatatgcctgtggtccatttatctgattttgtacttaaaatgcttactgcctccatgtactttctggaacttgcctgctctctgaactccctctggactgtctgctacattcccctggcatttagatttcgtacattatatagttatgttcagtctgcagatcctctctccagcaaaatataactccatttaggttaggaacctgatttttctgtttatttgacacagagtgaagttttgctttggaaaatgaaaatcaccatgtgtccttttgttttgtatttgagtgttttttgtttgtttctactaaaccacacattcaataaagtttatccatgcaactatttcataaattactgaaacattctaattttatggtaattttaagacttacacaaatatttttcaattgtatacttatacaacaaattaatatcttctcaagcaacacttttaataattatttaaatttgttactcttcagattaaatgacctacagccatcacacctctccagaatactttcattgtcttttttggctatatctctatattttatttgttataaatatgatagtacagaatactatcatataagtttcattaccaaaaaagatacagaaatcttaaaaactaaatatttagaaactgatgtaactagttataaaaccataattatataagagagtattcttttataacaagaagtcttcacacctgtcatccagtgttttaatgcctatagtacttattagctgactatttctattattaccattttacaagcaagtgccattcttgaaactgattgatgtttaggaataaagcacatttattacatgttgccaacttcagaagagcaatcttataacctacagcgctttttgagaagtgatgataccttatatttctggaactaatcactgctaaagaaagtaaaaaggtgaaaacataattttttttcttgtgaagacctttcattgcattatatgccattcaactataaagtgattatagtgttttatctgccaagaatgacagtggtgaaaggtaactttatgtatatatgtaaagagatgtgtacatatctatctatgtcaaccattgcccatatcatcttccaatttcagtctggctagtctgacttgtacagatatagaagaaggatgaaaattgaaagcaagaaatgaaattcttgttgtatgtaatcaaaatttgtgatgttactataattgttttattatttcactgcttcttccaaatcattattgtacagttttcactcaccagtctttgaagttcttgcctccattataccatcttgaccttatacactgactttgcctcccattatgccacctgatctcatctgctaatcctaagtcactgcccaaccttgattgaatactttgatccttggccactggtctttcaatttctgcctgtggtaccagctacttaggaggctgaggcaggaggggcacttgaggaggggttcgagtctgcaatgagctattgatcacaccactgtactccagcctgggtgaaagagcaagactctgactcaaaaataataatatttttaatcggtaaattccagtttgtggttgctgttaagagaggaaaggagaatgtataccaagctttttatgatcctaaagttcatacacagttttcaattgaataacattttagcaaactctttctagtagtcagcattgtcacaatctctttgagctctaggatcctatttataaataaggcatttatagaatcccagttttacagtactggagataccatgcatggcaaaccaaaacataagtaataggttatatttcatgtttttaagtagctcagctgttttccatccagttagcctcaggtatttacccaaactcaaatttgttatcctctaaatactttaaaaattatcacagtaaatggcattaacctgagtcctcttgacactgttgacccttttactctgcatttctaattagtcacaaggttttatatagtccatctccgaatgtgaatgaaatcttttatgtcattttctatcttatataggcttgacttagtccaagcccttgtgtttatagacaattcttaaatgaccatctgctaatcactttcactttcttgtccttctggtccttatgcaacaccaccatcatatacaaagtccaaaatacaatcttatctggtaactaccttgctcaaaattctcagaggccctctcacttctgtaagaaactgtccagaatgctgaatgcagagtataggacccttcacaaacaggcctcattgcatctctgccttagtttgagttcttacaaaagcaaagcctgaagacaaggacttggatgaaagtggcctatttgggagttgatcttgggaaatagacatcagggaggaggaaatatgagacaaagaaggagcaaaagtcaacttaagcaggtatcacttttagatcacaattatgaactcctagaaagtgtgcagaagccttatagaattgtccccctgaaggatggaaggcgggagcagcctaagggctgtccctgaaagtatttattcacttgcctgtacttttgtggcttggaagcacaggcttagtaggctcttgtggtggcaggagaggccctgggacagggggtacaaagaagtttagcaaagcatgaagtggggctctgttttcttggggtcagtcagagctgacatggaactgactagaagagctgctgttgaattagaggtggtcaaggaggctgtagtgtgtgtcccagaaatatctgccccactctccatctagccttgtctccttcctctccctcctaatccatctttactctaggccctacgacacacctaacattccagccagatctgtatccttttgctcatgccgttatctgtgattccctccattccttctctgcattcaaaatgctagttatcctttaagacatagttcatatttcatcttcaagtaaagatgacccaactagacaaagtacaatacacttttctctgatttgtcatgatcattttctaaggtttactggagtcattaacatacattataataagttatttatatattcatttagctagagtgtacatttcttaaagacagggataatgtctaactcctatttatgtcaccagctccaaacataatagctgcttcatagctggcattcaataaatgtctacttatttaatgaatgaaaatatttggtttttaatgtctagtttaaatttgtataaaaattaattttaaatttagaattttttcaaattgatggtatgaaactttttttaaattgaaaaaatagctgggaagatatacttgtaccatatatatacacatatacatacacaaatatatatatacgtatacatatatacacacacatatacatatgcacactatatagagatatggtatatgtatatttacataactcacgtgctctctctctctttctctctctctatatatatatatatatacgtatgtatatgtacttttactttagtaccagtagtaaatatcaaaatatgctctcagaaaatacatttcaggtgtcacttataaaaatataggtctcatttatgtagtataaatacatctgaatgttttactagttggagtagtttggattctaataacaagatatcaaatatagagattttataaataggtgagtatatagtatattttcatattatccaacctattatttttttaattatgtcacttttttgttgagtacattccataattttataataatttagttttcttctttcaaatgccaaatgttctaatcaaaaaaactcagaatttttctttccattgtggtatgttaaaagcacattgttttttgtatgtcacagtgcactgagtcttctgatttctttttaccaatttttggctttgtgatttccaaaggaacttgttggtaatcattgcgtagtgtgaagtgggaaggtgggtgggcagaggaagggtgtagatattttaaagtctggtttgtggacaaggatatgtattacagatagactacatgattttacatcatatgttccaactattgacagatttataaaattataaagactgagggactttaagcaatccacacttaattttgttcttagtgctaaggtgtctgaggagaggggagaggtaaggtaaagatgggagataaaggaaagaagagatgttagagaaataagaggaagtgtattagtctgttctcacactgctaataaagatatacctgagactggataatttatacaggaaagaggtttaatggactcacagttccacatggctggggaggcctcacaatcatggtggaaggcaaggaggagcaagtcacatcttaacgtggataacagcaggcaaagagagagcttatgcagggaaactcctccttatgaaaccatcagatctcatgagacttattcattatcatgagaagagcatgagaaagacacacccccatgattcagttacctcccaccgggtccctcccacaacacatgggaattgtggaagctacaattcaagatgaaatttgaggggggacacagccaaaccatatcaagagggaaatataaaagaaagagagaaggaaggatgaggaagggagggagagagaagcttgggagctatacagcattgtttcagaatataaagactgctattattgggtatgcttaacaatggaaatgttttactagcgcttttattagcgggcaataaaagacatcctggagggaaataattcagtcactgtcagacgttcccacttcaaccataggccttcaacttttggtaggaacataaagtcttaaaataggcaaaactgaaagctgtcataatcaactatcatcagtcatcagtcaatactaatttcttatagaaatagcattaattcttttcatctaggagatcttgtttataaaggagagaaattgtcacccatttgggctagccctgcccgaaaatgaaatgatgaacttgacttctcaagcccacatgacttctagagcatgagatagtctgctgttctgctgctgaaagtcagcaacctagcatagggataaggaacgtggactctggcgctaactgcttggggtaaaatcctggtgccaccacttaccagtttcccctggttagattactcagccactctagatttgttttcccatctgaaaaaaaaaaacggcaaaaataaaaatacctacccctctgtattagtctgttttcatattgctgataaagacatacccaagattggacaatttacaaaagaaggaggtttaatggacttacagttccacatggctggggaagcctcacaatcatgacagaaggcaaagaggagcaagtcacaacttacatgaatggcagcaggcaaagagagagaacttgtgcaggggaactcctctttataaaaccatcagatctcatgagacttactatcatgagaatagcagggaaagacctgcccacatgatttaattacctcccactgggtccctcccacaacatgtgggaatacaagatgaaatttgggtgggaacacagctaaaccatatcaccctcctaaacactgtgaagattaaattacttaatatttgtataacacttacactagagcttgtcatataggaagtgctgtataagtgtatgcacttatgcttatgaaactgggcctttgtccctgaagctttgctccctgaagactttgattacatgagccttctctaataagtggggacataaaataaaacatatattatctttgcagaaacacctcaaacagtgcatttcattcataatttgatactcaggcatgccctaaactctcagaatgacttaagataaacgtgatgtctaaatgaagccaatgtaggtggtgatgatgaacagtttaccacaaccacagagcttttaccaggtgttaagcatcaaacctcctcttccaccttctgatctgaacttccacataccaaagctctagcatcaaaacttcggttttatcttctgcgtcttggcctcttgacatacacttagcaagtgagatcttttcttcttgttttgggtaagtcttctgaagtagggagtgttgaaataaatggcttatgacatgtatagtgttgaaataaacgtttattttaacacttcataagtcatgagccatttattttaacagttttcacttgaagtttttaaataataggttttatacagggatgtgtcatccactctgtttaatgtaaaagtgaatatgtaaatacatccatctatctaatctggattttacaccctttggctgccaaacagcctggttgccatagtttctggagtaacctgaaattaaattttcttctctttctctttctgttgataggtaatttgatggtacataaggtgattggacatcactccattaatggacaaatggttaaatacagtttttttttcagaaatctaaaaaagtgtcagcaaagaccagagttgacagttaaatgctttcgtaactagaacagcttttactagaaaatgtcaggatttttcctttcgtttttagaattaatagcaacttgttgcagggttatttttgagcattcatacaaataagtatatatataaaaagtatatgtacagtgcaatgcctagagccaataggtacatacaaatatcaacttattgaaggaaggcaaaatgtttgtgaaaaacggccctagtttgggagtcaacatatttgggtagaatctgagaccttccagttactcttataaagacaagatatttaacaatttttagcataaaaagtgatagctcctggagattctgtgagatttagataaagtaacttaagtaatattaataaaagccttaatagagttctgtgtgcatatttagttcattcaacaaaggatagttattgttattgctattattccttgctaggaaatggcaattaattaaaatagctatgaatgttatatttttaagaattattttcaatattcacaagtttgtgtccttgtttttcccaaataatataggtaaactgatatttttataagagcaagaagaatccaagtgttatataggggaaacttttaaaaataaaggtttattttttaatgattttagacttacagaaaagttgaaaagatagtggagagaatccctatatacttctcatccaatttaccctgtctctaattacaaggagtattttaagaatttgtcaaagtaataccttgtgttggaaagtttttgtgccaaaaccggaatttaaatgctaatagtgatgggaaatgaatggaacaaaaacattgtgagatggaggatgagaatggcacaagggaacgatgccacgagaagggaaattaaagggaaacacttagcaaaaccttagctctcacaaagacttctcatttttccatacataaaacaataccctcacatatctaagtttattgaaagagttagttgagacatgaaagggaaatgtttgcttttgctttcagatactaaaaaatcttttaaagaataattaaaagctgagaagtaaaaatgctccagaaagaatacaaatactggcattcgttttccatttgacattttccaatgtctataaatgctattgatttcaaattctaaattatttcacttctgaacacgccttgtaggattattacagtgctatttgtgtgggcttgtaatcattgattgtgacattatactctccataaatgtgccattgtgaataattaaacttgttagtattttgtttgcctacagcctttagagtgatagcccgttttttggcaatcataatatgtttctctagttcagtttgtgctggatatgggaaatacatcatttttttctgaaactttttcaatacatttccattttcaaattttaaattttaagaactgcttcataatatattcagcatttagtaaattagaattctgggagtcttatgatttgtatttcgaagtttatgaataaataatcttctagagtgaaagcagatctttttcataccagttactacctgtgaaaacacttgcctagagtaaaacaaatattagtgttccaaaaatatatacattgtgaccattggccctatttacactggattgcaaatatacttgaaaaaatttgaaagtgttatagtttaatatgatttctgttgacttctacacaattacaatgagtctctgagctctgttgagaaaaacagtatatagcggttttggcaaaggttactgaaaaatgtctctcccctcaaggcatggaaaccatgctctagctctgcctctgtaactagatttaacatatctgtgatgcccaatgcccaaatctgaatggtcgaatgctgtttggaattattatacacaatttaagcatttggacgatgagacacttatgtcaacaatataaattggaaaaaaacaagaaagagcatctacgaatgtggaaaaatatatgcatcacattttgcttagatatgtgcattagacacagactatatatcctttccccaccaagttggtcctgacaataggctgtctcctcttcttgcaaatggaagttagctaactgccatttggcaataagttgagtcatccagggttgcacactggccaatttgcctgcatatccatgccagtagacaaagtaatgacctcaatttgacaagagcctgaaatttcatcagaaaacattaaagattgaaaaaatagcaaatagagaaaggatacttcattacaaatccaccatagacttgacataactatgagccaaatattccttaaagatttgtctgggaagttaagtttatgactacaaggttttaataggaataacacccttgagtgactcctctctcgttttggagaggtaaagatatactcaaataccaatttgggcataaagtgcagaaacagacattctcattatatgttaacaatacttgtgatcagttgatggcattttttgaaatttggctctggggtctcacttagcactacagtcagcaaagggccaaactgcttctttggttcattgaagctgtgcctttctaaatagagtgatttttagcatgcctggctaattcaagagttacgatttagaggtatagtctagccgtaatacctgtctttatatgctcatcattttgtactccatgtgtccttattcttagtaactagtgatttatcactgacaatgtgtgtgtgtgtatgtgtatgtttgtgtgtacgtgcttatatgtgatatatgtggcttctttaaaagcattgctctcaagaaaatttcatggagattacgaacattaacaagagcaacaccaccataaaaattgctctcactgggtcatctaagttgacattgatttaccttacatgatgtactgtagatgatgatcttcagtcccattcacctttaaaatataagctcacagattcattttttttctttttttctttcttttttttttttttttttttttagacagagtttcactcttgttggccaggctggagtgcaatggcgcaatctcggctcactgcaacctccgcctcccagattcaagcgattctcctgcctcagccttccaagttgctggagaggcgcctgccaccatgaccaactgattttgtatttttactggagatgggttttcaccatgtcggccaggctggtctcgaactcctgacctcaggtcatccacctgccttggcctccccaagtgctggaattacagacatgagccaccgtgccctgccacagattcattttctatttgcaaatgggaagatgtcctcatatttcataaaattaagtatttgaaagattctgaccatcaaaagaattttttagaagtggattcatataggagatgctcacttttgagatggacattttgctacttcttatttatgtattcatatatttttatttttaatggagtatagttaaatacaatataatacacagatatgatatatgttcagataagttagctttcaaaatgatgcacatctgtagtaacacaatctgaaacaagacagaggatatttccttcacaccagaaagttctcttgggttgcttgctagtcaatttctccatctccagctgagacttataccaccatagactctttttatctgtactaaaacttcatataaactaaataatattcattctattctctctttctctttcttacctttcttccctgctacttccatgtgtgtgtgagtaggggacatgtctggcctcatttacgttcaatataatttttaaaataatattgtcacatacatcagtagaaatttcatttttattgctagtagtttacattctactgattgaccaaaatgtgtttattcattctccaattgatggatatttcagttgtttccagttttgagctgttatgggtaaggctgtcatgaacatttttgtacatatacttttttagttctgttttcactgttgagtgaatatctaggaaagaaattgctgggtgataggatagatgtatgtcattttttaaagaaactgtcaaacaattatccaaagtgatttatctttatttatttatttatttttattttttatttttttgagatggagtcttgcattgttgcctgggctggggtgcaatggcgtgatctcggctcactgcaacctccgtctcccatgttcacgcgattctcctgcctcagcttcctgagtagctgggattacaggcacacaccaccacacccggcttattttttgtgtttttatagagacagggtttcactatgttggccagactgttctccaactcctgacctcgtgatccgcccgccttggcctcccaaagtgctgggattacaggcgtgagccaccatgcctggccgtgatttatcattttatactccttccagcagcatgtgagagttcgttttgttccacattgttatcaacatttggtgttatcagtcttttggatttttagccattcctgtgggcctaaaatggtgtctcatggtgattttaatttcgagttccctgatgtggaacacttttttatgtatttattgatcatttgtatgtctttttaaaaagtattgttcaagtattttgtctattgtaatcttttaactgttggtttctagttcttcatgtattttacatatgagttcgttttaaaatatatgtgtgtgaatatatttttttctagactttggcttctttattttcttaatgatgtattttgttcaagtgtccagtttatcaattttttttttaaattagtcgttgcttttaacatcctttccatgaaatttttgcctaattcagggttacagaaatattctccttttcttctccctaggaactttatggtttcaagttttacatttagatttacaattcatcttgaatctttaaaaaaactgtatatgaagtgaggtagaggccatggtttcatttttttcctttcttttcttttcttttctccccccttcctcttaaaaatatcctgcttttctcacaccatttgttagaatggcttttttcccctcattgaactgacttcctgccttggtcaaaaattaattggccttacctgtgggactatatcaggactccgttctctttcacttatttgtcgtatattctaatgccattgtctttattactataaatttaaagcaagtcctaaaatgaaatcgtgtccttgagttattttctttcctgattgtttttgctaatctacatcctttgtatttttaaataatgttaagaatcagcttatcagtttcttcaaagaaacctttttggatttttgttttgagttgtgttgaatctacagatcaatttggtgaagtttaacatcttaacagtattgagtcaacaagtctatgattagtatgtctctttattttctgaagtatcatgaatttttctcagaaatattttacaaaatatttttagtgtacagatcttacatatcttttctaaatgtactcctattgttgctttttggtgctattgtgaatactattttttaactttctaattgcttcttgtgagtatatggaatagagtatatagaaagtatgaagagtatatagagaaagaattttttaacataaagtctgattttagctataggtttttttatagatgttctttgtcagattgaggatagtctcacccttgttttgcttacagttctcatcacggatggatttcagattttcctgtgtacactttctgtacccttttgagatactcatatgtcttttctcttttattcagttgattggtgaattacattaattgattttcaaatgttaaaccatgtattagtccattttcacactgctaataaagacatacatcagactgggcaatttccaaagaaagaggtttaattggactcacagttccatgtggctggggaggccttgcaatcatggtggaaggcaaggaggagcaatcacatcttacatggatggcagcaggcaaaaagagagcttgtgcaaggcaactcctgtttttaaaaccatcagatctcattcactatcacaagaacagcgcaggaaagacccgcccccataatccaatcacctcccactgggttcctcccacaacacgtgggaagtgtgggagttaacaattcaagatgagatttgggtggggacacagccaaaccatatcaaattaccttcatattcctgggataaactgtatttgatcatgatgctttacaccttttatatattgctgaatttatttaatacagatatttgagtctatggatattggtctataattttattttcctttagtttatttgtcaggtttcaatatcaagattatactggctttataaaatgagttgagattggctcattcttcctctatcttctacaagagtttgtgtaagatcggtattattccttcctttagtttaatagaatttaccagcgaagccatctgggcttgcagtttgctttgtgaaaatgttttttattatgaattcaacttgtgcaatagttatggatctatttttaattttgactttctgttttttgttgtctcaattttggttagttgtgttttgcatggaatttgtgcatttcacttcaactgttgagtttattgtatgacattgctcatattgttctattattatccttttatatttttagaaactgtagtgatggcatttttaaagcatttactatgtgcttgtcactgtgctgcctgctttacatagattattctattttattctatttggttctgtattagatacattagaaattcatgcctactcagtggctatacaaatcactactagtttttatcatccatttggttgaggcacatcctcagcttgtagtccaaagccctgaaacatcaggggtctcaggggccacacagatatgcacagcttgaaactagcttcccatttttggcaagtagctgacttgtggtatgttaagagaggttgccagattgctccatatcctcatgctctagggtagtattacagttcctttaggtaatactttaggagatcttgtctgaaataatgtagtcttaagttctttttcctttcctagttttttgatcatatgctctttttaatacatgctacagattcctgcactatttatgatgtttgttaaaagtatagatgcatctgtgaaaatgataattcacattactggcaatagttactgaatggttgaatggagtggaacacttgttctcttccattatataagctctctatattatgaaaaagtggatcatattattctagttgtagttcttatcccttctgtttgataaaaatcctaatattacttttcatcagactagaaagaactttatgatctctagaaaggctgcagacagggacatgtataaagagtacagattctctttagtgtcccctgagaaatatttttattggcagtaaatagcaatatttattaatttattaataattaacaattgctattaaaataggaatattatttttattaacaataaatagctttgaacttcccttacttgatattttgtttaaatttaaacctgtttattcttatactaggtcaatattttttaatgcattttaaaaagtaaaatgccatatagaaattgatattggtagctgcgagagctgggggtaggctgttttcctgcctacgaggcaacatccctacactatgtaatgcactgtataccatttcccaacctgagaggctactttagttttgctgttaacgtgttttataaatatgatttgttcattactatatctgaaatttttctcaccttgttcccaaactctgccacagtttgaaatatcctaatttttagccccagacctacccacttatctttcaagagcccaactgaagtaagtcctgcatcttcctcaaagccttcctagaccacctcagatttcctggctctccttgtcttctaagtttcagcagtgtctgttgtctgacccacaaaattgggcatgtgaacatgggttgtccatgttttttatctcattgacccagccttataagcttgctgagaagagacatctcttctgctgcctttgagcaacagccatggtgctgggtacaagaaataattttgactgaaaatgatttttcattttttaccctattgaaatttaggaagaaatgttattgtcaactaattgatagagcaactaaacagtaggatctctctttttcaaagtgcctggtcagttttagagtgagcattgattcagagggttcagataagggcccaggtagagatgtccttgtccacaccacatctttgagagttgtacaggccaaagaagagaacaaaacgccatcaactgctgtacagcctgtgtttcagtagactctgagggacacagccttatcacagagcatagagattaacacatgtaattctttgtaaagtgaaagagaatgtgttgctgagagtgaaaggaatggttttacagtacagcaagtgctgccatggacaccctggccatagaaccacccacagagtaaacagagcacaggatttcagagagaaaagaaattgtgattttccaaaggaagaagtaataggatcctaatggatgtggaacctcttttttatttttctgtatgttctcagaataatgcccacttgttatcctggattctcccaagagtaaaatgaaactccggtcatcggcattatcattgtcattataatcttcctccttctcctactcaaataatcatttttgaaaacacatagaatggtgagatttttatgctgtgtaacatttgctctggacatccttaagcaaaatcacatgagaaatattacttcaagtccactaagtctgtcataggtgagaataatttcttggctggggaaatatgtcttttttaaatagttcttctatttatacttataggtaaacctttaaaattgtaggcaaaaagcattgccagaagctcttatttggagagattgaggcatgtgttaatctggaaataaagaaaagtcctcacattcaaacccggcagtgaattttatggtgatattgcagactaattgtcttattgttgtaatgcattatctaaccacacggccctgcctttcttacatgcacatactatttaattccttgagcctgaatttccatgtctgtaaaatggagataatgtatatgtgacttgtaatgatgtcgtgaggatataaataacgagtgaataatttagcagagcaactggtacttaataggttctcaagttatttcagtctaaccataaaaataatattgccactggctttgaattctaattttattttttcatatgaagtggacaccagcttaaaaattataaaggcttcaaatagttttaccactcgcaaccaagacacactgtataatcccacatcaatggatcttagtagtataaggaactgaatagcaaggaagaaactgagttagaactctggtctattttaaatgataaatactagctgcgatgtaaaaccatttgtgcgtttcctcaataactctactttgaaagtgcacaccatttttaaagtaaaagtacatttaaggttgatagtaagaaaaatttactacttgttcctgcatcaaggttttagagcaaataatacaatgaaggtattatacatattcgtagatatatatgattatagttcacaccagcctatcacataaatcaacttgtaaaactctcctttcttgtttccaaagagagtacatatgatacggcatctaccatggaaactaaaccaacttggaaatagcaataatgtccttaattcagtaattctttttcttttagctgtgtttttcctctgggtaaacctctctgcgcactggatttctttctaaatctgaatgtcctctctggccatattgaagaatgtgctcactgtactgtttcattaaactgctgtgttgtcgggtaattgtttaaacataatgccatagcactatcaaaaggaaaggtgaactaatggcatttgcaaatgtcagggattatcttaacacttttattatagtttataaaaagtaggttcagggcatttcatggcaattatttctacagaaattggttatttaaataaattgctaattatctgaagatgacagtattgaaaatgctactaatgagttgtttaataagtgtagcttgtggtggccacctacaggttgaaaatagaaagaacatacatatagactaattatgcctagtaaatgccatatatttttctctctagtgacaaatttaaagacatttagctcttcatgccatcttttgagtcttggacagtatagtgagtttctaagctcctcataaatttggttttggttctaaaacaaatttcactttgcttctgtaattgtctttgtcctattattcttggacataattatctttagttatagctagtatgattttataatttatcatctgaactgggatacttttagaccaaaggaagatagctattgttacattatgtaattacaaataaatacaggtataataaactgggactctcttgggcaaactgggctatatggttactctagttatacaattactagctattctacttctaatttaatttttatccaacaattaatataatgtctatttttctataatgttgatttttatggttttatcatacctggataatatatctttattaattataacaattattattattaactcttctttctaaagcttaatttatatccagacacttaaaatcaggaagcagcatagcattgtggttaagagcatggtgttgggagtcaggtaggcctggattcaaatactggacccatactttctaacagagtgatcttgaggatgtggcatttatccctgctgaatctcagtttacacatctataaaaatagagacagaaatatctatttcatagtaatgtgaccagcacaatgtatgcaaaaataaataggaaactatctgtcaattagaaagcactcaaaagaggagcatttatatttaacatatttaatcttaaaagttaactcatacttgcttcttttctaagttaatcactggtatctgttggaaaactatagagcatataaaattgctcttaaactaccaagaataagttatagtatccccagattttgaattggaagagaaaaactaatccaatatttcctgtagtacagagaagtctttctgttgcatcttgctgtcaagtagccatcaagattcaaggaatagggaagttccattgtagctgctttcattgctgaatttacaataaattaattataaaaataagaataataaaaccaatcgtgtatgctgaattgttcgttccaatttgctacataggataagccctttttttcatgattatccttcaaatatttgatgaccatttataggatttcttttaatcactatatagatatatatgatatgtgtgtgagaaagacagatcaagagagatcatcctattcactctgttgtgtttgtagatcttttatctaaaatattggacacagaaccaaacatgttctttgtaatgtacagaggatagaatcactgtatgtatcactcatatataaaaatgtcacatcatatatactgatgatgcttattctcgtaaggtgaattttaggaacattataaaaatagatatttttactacagaagtaaattataacaccattttatcaaaaagaatccaacaataaaaagtatatatatataaacttgaaaggtcttcaatccctttactgcaggactcaccccctttcccagagatgatacctgtgaacagtatgaaattcaacattatatgcatttacatgcacacatactaaatgtaatcacatacttttttgccaacaatgggagcataccatatatattgctctgctacttgtgattaactcttaacattataaattagagctatttgcgtgtcaattttaaaggttttctggaatatcatatcttggtgaactataatttatttaatagagtaactactcatgatcctttagattgttttctacggtttttctatagaaagtaatacttccaggaacattgttgtatatgtaactttgtgtctaagcactaatggaacagattcttcaaaaaagacttagaagatatatatatatatatatatatatatatatatatatatatatatatacacacgcacacacacgttgcaaattacacttaaaaatctaataaagatttattcacacagatacacacatttactaccatagactcaagctatgaatattcataattttgaagccaatgaaataatatatgggttacaaaaggaaccccaaatgttatatctaggaatgaatattaacaacccttaaaaattaagtgtttatccttatatgtgttatagctgaatgtttatttttctgatcaattttctctggctttgacactaatattagcttatacacattataagctaggcactgtgccaagtctttcccatgagttgtatcatctaatacatccaaactccctggaatattattagtattaatgtccttgttttttaattagggaaaaccaatgttttaggaagttgaggagcttgctcaaagctacaattgtataaagcaaatggtttgagacttacacctaattggttggacttcctctgtgttctcatagcatcagtctgtactgatactagttttcttaggcaaaaataatccagagatggttcttttggtaattgctgcattgtcacttctcaataataactgaaaatgggaactttcatgtcgcagagactttatttttaatgtattacatcctttttaaactacgtgacactggataagttatttattcagcttgagcttctcttcctttatgtacaaaatagagaggacagcacctagcttcagagttacaagggttaaagtacacagtgtacatgaagcccctgcctcagtgtctgcacgtggaaatcactctatgaatgagtgatcctactcattccagtaacagtagctgacactttcagaaaggagaatggccctctttggtgaatgttattaattctcttggtaaaaataaatgcctgacacatgctaggtactgagttatttaatatgaatccactaggaacatattgaatgcattatgaagcagaaaaacatagctatgaagataggaagacttggagaaaacataaaaaattcaactaaaattaaaacattttcagaagaaatttttagcttttctgaaaaaactaaaataacatcaaataatcaactttattttttccatttcttctctttaaattacacatctctacatataaccctagatccttttagtacttcagtttctgattgaattatgcaaatattctcagaggaccctaatccatgtgtaaagatgttatttttaaataggtgtgtcccatgtatttattagtatattaacttcattaacattgtacacttaattttagtaaagcataaatttgttggtggttcatttatatgtaggttataaaaatcaatctctcacctcctaaatccttgaaattcttgatttactaattttttttcttctggatggtgttaaaactgttaacaattagacagtcaaggttcaatttctaatgaatttgttatccacttaattcattatattttaattaatgtaagcaaattaaaactacattttctttttgcatacacagtgagcacgaatgagtattataacccaatttctgttttattgccagctagagctattatcagggagtttattgtggacttagttctaacaattaattgtgtaacagtcgctgtcctagaggagtcaaatgattagggggagaaagacaaacagaattaaactcaattattcaaaattccagttatttagcatatgttccacactctcttgctcattaaaaattccttttttcttcaaggatttagtcatgcgaagtacatctctgcctccttttcaccaataaacttgagttcagatattgtaattaaaatccatggacattttgcttctcaaaaaaaaaaaatcttaaatatattgatgtcagccttttgaggctttttttcctttggggtcaaagtaatcttcatcaacattatgacactgctaaatgacagctgttaggaaaagagaaaaaggaggggacatgtatggtcctcttaaggtttcagaggataaagttctgtcatcataggcatcatgcttttgtctccaatttaaaaattggttttaattgcatcactaaacacacaagaacatagaaggcaatgtcaaagtaaactacataaatgctcactctgaaatcaattgtccttgagggcagtacaaattataacagcaaacacttctacaatttttattatgtcctcgccttttatatatattatgtaatttattcttcaaaacagctctatgaagacgttattacaatttttattattttatagatgacaaaattgagattcggtgggatttaaaaattttcacaaagtcacacagcttataaatggaactaagatttgaacctcaacagttggcccagttgtctctctgatgttggtaactagttcatcctcaaattgccttcttgatagaattcatattaatagtatttataaaatgtataatgttctaacaaatgtgaattgtttctaatggaatactggtagagaatgaataactggattcaaattattaacttgaaataacctactacaatgataagacctggtgttttgtgagtcaagcgtagatatatagttaggacacaaactgatgaaccaggaaaaaaaaagccataggtgcttaaaaaatattttgtggatagacagatgaatggataaatgaagactgagtaaggaacctgattgtcataatacattaatacacatatatcaatatataatattatagccaatgatagcatttctgaaattgtatttaaaatgatatctgacaaatgagagttcattttcttaagaaaaatacttttcatcaaaatcagattgattaacttaattcaaaatctctggcttactaaaatgtttttctgaaacatgaatcaattcaagaatgttctgtgtagtttatctaagacaatctatgaattcaacacactgatttgtattttaaattatgactacatggagggcctagaatgattattgaccaaaagttacagttcagtctagtccaccacaagagccacataatgcaaagcaaagttcttggtagcaatgttgcaactcataagtccagttcatttttcgtttgtttgttcgaacctgcagcttgtttcaaaacgtgggaactcagaatggcttgatttttattggaggattccacacagttgaagcagaatggcttgatgtaactgaattccccattaggttcatctggccaccccatgtagatgagggcttaatttaaattgcatgttacctgttagttcaattaagtgtataggatttcaatttcttgatttaaaccttgttgtttccttaaagatagagcccgcatacacattctttgaacttctcacactggcttcttcctccctagtctttggtctaaaatcattaatcactgtagcagtgacaaaattttaaaagacctttatctcgataattgtaattcaggaagtctttatgattttaattggcatatgtacaattttgtatggcattgatatatgtattttctttaaaccaacagttttatttttatcttgaacctattattacttcatttctgtcattttaaaactaaaaataaattctacatagcaatttagaaagatctttttatataccttcattttccttctagaaaccgttcttagtggatgaagtcattcttaagaactattccccataaaaatgctgagaacaggtagattatattttgtattaaatcagttgagttataaaaaatcaaactgggtttataatggaaataaaaactgaatttactgtagtccagcaacagagagatcatttcttcattttttggatctcatttcctcagagaacatagttactcttaacttgaaaaaatactcttattttttgaaaagattttctgttcattaggtacattataaaagcgttagaaaggaagaaaagcataaattggaaaatgtcttattgacctaattgaacatcttcaaatgccaataagaatttgctgatttttttaacacctgtgtaataatgttgccctttaagtgtcactggttaatttttcaaagctgtgttgcctttttatgtccattaatatcaatagaatatgtggccaaatccctgtataccactttgaaattttaccccttactgttaatgatagtcttctaacagtggaggtagaaataaattatttatctacttagctcaaatttactctcttgggtcaactaaataagggaggaaaaaaaccaatatttctttattacttcaaagtagtgtgtatgtaaagaagccattgggttggtatgtattggctatgccagttatattatgcagagatagctgtgtgtctatcaaaaagtttgttacagctttccttaaaaaatgctttcctttaacttttgttatgtagatttcttttagtataactgaagatatgtgtatatatatgtgtgtttttgtattctcactataaattctgtccactattagcctttttatggttaaaacataaaaactgtgaggaatcactgataaataatatagaagtagaatcttaatgtccggtttctaatttgcccaacttaatactttgtatccaaaatgtctattatgaattttgaagtgtcagcattgaatattcctaactaaggaatgctatagtaatatgtagaggaagatgtttgaggtgtgggagccacaagtagacatttccacaaacatttttgtgttgagtacaaaagcagtagtcatgcaaacgttcaattttatctgaaacagatatgaacaggataaaaagaaagccaccgatttttttttttttttttttttttttttttttgagacagaatcttgctcttgttgcccaggctggagggcaatggcgcaatctcggctcactgcagcctccacctcctgggttccagcaattctcctgcctcagcctcctgggtagctgggattacaggcgcccgccaccaagtccagataatttttgtatttgtttgtagacacggggttttaccatgttggccaggctggtctcaaactgttggccaggctggtctcaaacttctgacctcaggtgatccctctgcctcggcctcccaaagtgctaggattataggcgtgagccaccactcccagcctctgttttagactttattttttagagcagtttagattcacagcaaaattgagaggaagatacagagatactcaatatatccactgctccaacacatgcatgacctccctcattatcaacattccccactagagtgatacatttgttgtaatccatgaacgtgcattgacacctatagcctaaccacccaaagtccgaactttacaataggtttcacacttggtgttgggcattctatgagtgtaacagatacattctctaagtgtgttttgtgtgtgtgtgtgtaaatgtataacaacatgcatccaccattatagtatatatagtattttcactgtcctaaaaatcctctttgctctgcctatttatccctcccgttcgctccttactaccactgatattttcactgtctccacagtttttccttttccagaatgtcatatagttggaatcatatgctatctagccttttcaaattgaaagccctttaactttttgtttcttttcttatttaattattttattttattttttaatttaatttaattttaagttctggccattttttaaaggaaggctgtgtgtgctacctcagagtaagcactccagtaaatacatattgatattgctggtgactagtggtggtggaggtgatgacaaagaactcaccacgtgaggctgaaccagttatttgtttatgttgtttgtgaagccctggtttaaggcagtgtcaaattcttgcataagttgaactgcctttagttcagaaaatgcttaaaggacccctgacttataagggaacaccaggaatatcaaattatattcctttattatgaaagcattaatgtactctgggatgtttaacatttgagaattcaaagtagctttagtacaatatactcatttttaaaatagccccaaagtattctttctatccatacaatttttattactattagggaataatatactggtaatgtctggctaattaaatattaaaaaattaaattcatacactctaattactggattctagtaaattctctttaacttgattaaaactttctaatatgtgaaaaattggattagactccctattttttttcaaattgtgggaagtacatataaaaagcaacatggaatctgtaagttcatcagcaccttgcctttttttacagagtctatgttcgcaacatctgctttgtactctaaagaaacataacatagctgtatgtctactgatgtactatatgggattgtttttcttttcaaaatctgctgttccttgttttttgtttgtttgtttgtttttgagacagagtctcactctgtcacccaggctggagtgcaatggtgtgatctcggctcactgcaacctccgcctcgtggattcaagcagttttcctgcctcagcctcccaagtagctgggattacaggagcctgccaccacgcctggttaatgtttatttttgtatttttagtagccatgggatttcaccatgttggccaggctagtctcaaactcctgacctcaggtgatccacccacctcggcctcccaaagtgctaggattacaggcgtgagccactgatgctcaaatattctatgcaatcttttacacattactgtatatccaattgtaatatgcatgtaatatgtgtgcacagagaattctgtgtttgctatacctacttgtataacatgtctaaattcaatattggtatcaaagtccttaaaataaataaacatccattaacaaattaacatgctttaaaacataacatttatacactacatatgtatatacatcttaaacagagataaagtaatttgaaatttgtccagtgacgctgtcatcacatcatagtaatagaagtaatataagacagtatactcaagtggtcagtgtgctaaccattgattattctgattttgtgtagggacagcaatcagacctattgctttgagagctgtgacctccattgctcgtgctctgcctggatttcccattttggctactggtggaattgactctgctgaaagtggtcttcagtttctccatagtggtgcttccgtcctccaggtagtcattgtgtttgtctgtcccttttaaaaatctccatctcacaaatgcaatgtaagttatgtgacaaaaaaaaaatagattcgtttttgggcctcttgaaaaggaggccatttgggatcaaaatggcagcatgtattaagttcctctgacaagttatgaagagacctgaggtttatttcctgtcctgttgagggcttacgaacccactgtcttttcttaatacatttattcacccatgtgatcctgaaataaataagatcaggtaccaaaatgagtactgtcctcctggaaaaacaatacatgaggaaatctgagtaaaagtaaaatctcaattgaaaaacaaaatgaaatcaagggtatgaaaatctatgtcattaccaaatttgatcctgagattcctggcagccaaagaaataaattattagctttataacttttaaaatattaaaataaattgattgttcagcttcttgtggtacaaagctgagggaacttctttcttcccttgtcctcttaaagggatgctgtgagatgtagtgaattgtactcttaataatacccctaaaataataaaaattagaacattaaaaagtattcatatactttttaaaaataatgttgctcaacatgggcttagtactgtcagcacattttagcataagaatttctcattcaggttttgtagtctgaattgacctagggaccaagctttttatatgactagactgtgaactgtgaactctctggtaatactccattaataatgacttctcactacttagcattgatggtaattggaaagcagaaagtttggcatcacatattctctggcaaaagggtagagtgtaaatagttcatgttgctaacttgacaatcagaattaacattgttctatgaaatacctacaatctatggtggaaataatatgtattagaaagctaatggaggcagacttctgcttccaagaagatggaatagatttacttttctctgtgcctcccactgtatacagctaaaaacccttatatgtaaaactgatgatataagaagactgaaaggtgaagagaaggcagattggctagggatctcaagacccgagaaacaacacagtggtgagtttcctgcgatttttttcctcacatatctcatctcacacttggagccaaagaagctcaacagcccagaaacaacaataggcacagatgaaaagcctgctctctctagccaaagaaccaggaaaggggcagtctagcaagagagagaacttttagacataacttccctgctccacccaacaccacggataaatattccatccctacacccatccatgcaagcaaaggacaagtagggatcttagacgtccaccctcaccaagcagtctcacatccccactgggcaaaaatgagccctcacccccatcccatatcagaagcctggacttctaccctcacctgagagtaatgaggtgtccgtcctccccccttctgcagtagtagtagaggaggtctagtgcagagtcaggaccttcatcatcaccgtgtggtaataaggccactctcctttcctccttcttatggtgtcagtgaaggccaagtagggagcagcaacaaggcgtgcctgcatctcttagccagggatgtgtcagtgcaggcttactggagagccagaattctcacctcctcccagcagtaaccaggagccatgcccctcgggtgtccaagaaagccaagtaagatacctgggcttctatctggcattaaggaggtggcattctccacttcccctgccagactgacaccaaggaaagctagcagaaacaaagtttaaataaaatcaagagtctcttaatattataccaaaattgtcaagatttcaattaaaaattactcatgataccaagacccaggaaaacctcaggctggatcataaaaaagaattgatagatgcccacattaacatgacagagatactataattatctgtcagatattttaagcctccattataaaattgcattaacaagcaactacaagtatgattgaaacaaatgaaacaacagaaagtctcatcaaagaaatagaagatataaagatgaaaattttggacttaaaaatgcaatcacttaaatataaaactcagctgatgtgctcaatagtaaaataagagaacagaagaaaaaatcagtgaactagaagatagagcaatagaaattggcaatagaaattggccaatatgaaaaacagagagaaaaaaagactgaagaaaagaatgaaaacagccctcagggaactgtgggactataacaaaagatgtaacactaatgtcctcagagtcccagaggagaggtgaaaaaggcaggaatggaaaaaaaataatggctaaaaatattccaatttttgcaaaagacataaacctgtagattcaagaggtcaaggtagacttccaaagagggcagcttcaaagaaatccataccaaaatccatcatattcaaatttctgaaaactgaagaaaaagataaaacctcgataacagcaagaggaagatgacaccttacttattggggacaaacaattctaataacaggggatttctcatcacaagccatggagtctggaagaaagtgggacatttttcaaatgctaaaacaagaactgtcagctcaaaatcctgtatccttcagaaatgagccagaaatcaagacattctcggctgaagaaaaactaagagaatgtattgccaggaatccttaaccaaaagaatggctaaagaaagctttttcagaagaaagaaaatgataaaagaaggcaccttaggatatcaagaagaaaggaagaatatggagcagtgtcttcaaaaagaatctggaagataacagtatccaggcttgagtatcacctgaatttattttcatccacatgtagaaatacctgagctgaaggatacaatggagttatgagtgggtttcagaagagactcttgctcattgtcagatgtgaccatgggcaagtcacacatggaagtaaagattattgactgtctaccatgtgctggtagtaattgctgctacatatagtatttccacaacctacttgagagtgaaatttttaaatatttttttttattgacatcaactaaggcttggaggataaaagtgattgatatggcttggctctgtgtgagattacaattcaaatctcaccttgaattgtaataatccccatatgttgtgggagggacctggtgggaggtagttaaatcatgggggcaggtctttcctgtgctttcctgacagtgagtaagtctcactagatctggtggttttataaaggggagttcccctgcacatgctctcttgcctgccgccatgtaagacgagactttgctcaccatttgccttccacatgattgtgaggcttccccagccatgtggaactgtgagtcaattagacctctttcctttataaattacccagtcttaggtgtgtctttaatagcagtcacatgactagcaatggagccagaattcccatctagagtttcacagccacaaagcaaatactcttccaactgggcatattgcctgtcttccatcacaggacctgtaagacgggaatattagtaatacgcaagtcttccatgcccactcaaagcttacatgttcaggctatagcttacctcttagagtcaagtttctatgaagagaagaaaagtgaaatcatagaaaactaaacgagagttatgtgtcctgggtgtagatgtgtgctcagggtgcagatcctagtatgtaaatatacatagagtactatgtgtcctcatagaaatgaatggtgaaataattattcaaatgtcagtttctacttaggctcctcttagatggaaaatcagaaactcactgactatgcacatgaagcctattgtattctggacatgaaaggaccctggaactggaactgcaagaaccagtgggacagtcctggggcaagacctttgccatctctcttttgtgagccatgtgatttcttcttcagaagaaactaaatttctgtccactcttgttctctccatggcttactcttgcctcctctgaacttctatcacatggctgtcatgacccttagacccacgccacattgcagccttttagctctcatttctccatgaaatgtcccaatagcttactgtctattggcttggatttctttttttaaacttttattttaagttcagggtacgtgtgcaggtttgctacataggtaaacttttttcatgtggtttgttatagagattattttatcacccaagtattaagcctagtactcattatttttcttgatcctctccctcctcccatccttcaccctctcataggccccagtgtgtgtcattcccctctatgtgttcatgtgttctcataatttagtttccacttctaagtgagaacatgcagtatttggttgtccgttcctgtattaccttgctaaggataatggcctccagctccctccaggtccctgcaaatgacatgatctcattcctttttatggctgaatagtattccatggtgtacatgtaccacattttctttatccagtctatcattgatgggaatttaggttgattccatgtctttgctattgtgaatagtgctgcagtgaacatacatatgcatgtgtctttataatgggatgatttatattcctttgtgtacagctcagactgctaagagaggaaatctgtttgcctaaatttatctttttatgccaggccccatcataagctattggttaccccatgtattgactgcttggtgtgtaacagaaatatagtaaattttggttgaatgagtttgttaaatgaatgtgcttggttatgggttttttgttttgttttgtttttaccagaattgtgaagaggggatacaaggattcacatggtataaaagaaatcattatctctttagctctagctgggaatagcccagagactttctggctattaaaatattggttcccaaatgattttgttaaaaatgtaaagtttcacacataggtttttacttcagaaatgaagaggaaatcaagacaatttcagctaaaaaatacctaggagaatttattgcccagagagctggcaatctaatctgtagaaatttaaagattatttttcagctctgccattagcttgagtcagatttttaactcagccagaacatgtttttttaaccaatattagctaaagtatgaattaaaatcagtatatatatatatatatatatatatatatatatatatatatatacttaggatggtcataaggtgggaaatatttgaatttataattttagtttggtagttcagtggagggtagagaatatatatttccatctttcttccattctaactgaatttcacttcattccactccctaatcttgggttaacctaacctttcgttcagtatagttttaagctgttgaatattattagagaaattaatgtaactctgcaattgggcttactccaaatacatagtgtttaatgtctgctggggcttgggtactagtcagtatttctttttattcgtctttttttttttttacttcccatcaaattcttttttttttttcttttttttttttttttgagaaggagtctcgcactgttgcccaggctggagtgcagtgacgcaatctcagctcacagcaagctccgcctcccgggttcacaccattctcctgcctcagcctcccaagtagctgggaccacaggtgcccgccaccatgcccggctaatttttttgtgtgtgtatttttagtagagacagggtttcactatgttagccaggatggtctcaatctcctgacctcgtgatccgcccacctcggcctcccaaagtgctgggattacagacaggcatgagccaccgcacccagcctcaaattctttcttgcagttagttcgaatctttttcatacagctcaaagcccttagcctcttgatcatcatcctcccatttctctcatatcatcctttcattgcctctcattgcccaaccgaattctgttctctggttttacaatatttattaaatccacctttctaatgatttctattcacaagtgaaatgtgtaccaacaaaatgaattctttatagcaggtataaccagacaaatgaaattgatttaaatatctaggttatggtgctgatacactagagtatagaaatagaagtcctgtaatgggtgtagaaatagtaatataaataaatattttgattctgatttttctcatacactattcatcatgtgtatagactatgtagataagtgagtgccctactaaaattaagatttacactcaaattagtaatttcaaaatcttatgtaattaagtgagttcactgctaaaataaagatttacactcaaattagtaatttcaaaatctgttccaaatgaatctatgtttgtaaattaagccatatgactgacattaagaagagtaatgacatttcaagaatggaaagctaatttttttcataagttgcataagtgtgatagcgcataccttctttattgctttatatgcatcacagagaataattcattcattcattttttaataaatatgtattgagaccctactatatattcttagcattgttgtagaaatttagagtatttctgtgaattaaaaaaaaaaacaactaaagtctgttaccttattgggcttacattcttgtgagcagagacagaaaaatatacaataaatgttaaatgtaagtgtattatatttaacataagataagtgctgtgggaaaaaaacagacttcattgtaaagataatatttttattaaaaaatgatggttgtaaatcctagaaaatttttattgaagaaaaaacctaggttacagcatcatttgcttaaatttttgctaattgaggaattaaatgtaagttcacaaaatattgtatatcacctcacagtttatttttatttatttattttcatatgtataatcaaactgaaccttattatcacttgatataccaaaatacattttgcatctcaacatacttcggtatatagtgctaccttcagtggtcacatattatcccatattataaatgcactgaaatttatttataaaatccattatatgggttcttcttcactactagtttaagcagtgctgagaaaaccaaattgcatttatctctaattattttataatatattttagtataatgtaattgatcagtaaagggcatatactttttttaaacttcttaaaatttttgtgggtacatagtaggtgtacatatttataggttatgtgagctattttaatataagcatgcaatgcatagtaatcacatcagctaaatagggtccacctcacagttgataaactgaaatgtctcttagggtttcagattacattttattgggcaattattgcttttctttctttcttttttctttctttcttttttttttttttttttttttttttgagatagagtctcactctgttgccaggctggagcgcagtggccgtggcacgatctcggctcactgcaatctccacctcccagattcaagccattttcctgcctcagcctcccgagtagagctgggattacaagtgcgtgccaccacatccagctaatttttgtattttttgtaaagacggggtttcaacatgttggccaggatggtctcgatcttctgaccttgtgatccacccactcagcctcccaaaagactgggattaaaggagtgagccaccatgcccagcccaattattgcttttcatagcaaaatttgcttcaaaatttttgagcgaattttcttggaatgtatcatttctccgtggcactgtttatttctatgatcttattctgtaacatgctttgacaagatgtcaacatttcaatggtaaatcatccaatcatcttaccttaaaaaactcttcagtgattttttttatgaaaaatgccagtggaatgtttgtagggattctattgaatatttagattgctttggatagtatggatattttaacactattgattcttccagtccttgaacatagggtatcttatcacttacttgtgctttcttcaatttctttaattcatgttttataattttcagtatacaggtctttcacctccttggttaaatttatcgctaagtgtttatttttatgctactgtaagtgagattaactctttgatttcttttttggataattttttgttaatttatagaaacatcactaatttttgcatgtgaattttgtatcctgcagctttattgaatacatttattctaactgttctgttttttggtggaggcttccgagtttcctacatataatatggtatctacagagtctatttaactttttctttctgatttgggtgcttttatttctttttcttcctaattaatctggctagggcttccagtactatgtggagtaaaaatgaggagagtgggcatccttgtcttgttcttaatattagaagaaaagctttcaacttttcactattgactgtgatgttagctgcatgcttgtgatatatggcctttactgtactgaagtacattccctgtatatctaattttttgagagtttttattaagaaagatgttcaattttgtcggatgatttttctgcatctattaagattatcgtatggtttttgtgattcattctcttaatgtgttgttatatttattggtttgcataggtttaatcattctcacatctctaagatgactgctatttgatcatggtgaatgattcttttaatgtgctgttgaattcagtttgttattactttggtgaagatttttgcaaccatgtttatcagagatacggcctatactttttttcctatagtacccttttctgggtttggcttcagcgtaatactgggctcagctgaaactcaaactcaaaatgaattaaagacttaaacataagacctgaaatcataaaactcctggaagaaaacacaggggaaaagctcctagacattggccttggctatgattgtttgaataggacatcaaaggacatgcaacaaaagaaaaataaacaagtaggactacatcaaactgaaaacttctatacaaaaaaggaagcaatcaacaagatgaaaagacttcctatggatttggaaaaatattttcaaaccatatgtcttttaaggggttaatatttaaaatatataaggagctctcacaattcaaaagcaaaaaaaaaaaaaaaacaacctgatttcaaaattttttactcaggatctttgaagaaaaaaaatgtgaaatcatagaaaaatgaatgagagttatgtgtcttgagtgtagacgttaatattctttgaataaagaacccgagtaaatatctttgagtaaagaacctgagtaaataatggaccaaaggagacataaatggcacagatatttgaatagatgcttaacatcactgatcttcaggaaaatgcaaatcaaaactacaatgagatattatcttacacctgttagaataactattatcaaacaagataaaaatagcaaatgttgatgagggtgtaaagaaagggcaacttttgttcattgttggggaaaatgtaaattggtgcagccattatggaaaacaatatggaggttcctcaaaaaattaaaaacagaactacgatgtgacctagcgatccttcttctgggtaaatccccaaaggaaatgaaatcagcactacatatagatagatgatagacagatagatagatagatagatagatagatagatagatagatagatagatagatagacagacagacagatagttagatagatctgtactcccatattctgtgcagtattattcacaatagccaagatatggaagcaaccttaagtgtctatcaatagatgaatgatgaagaaattgcagcatatatacgcaatggagttttgttcagctgtaaaaaagatcctgccatttgtgtcaaaataaatgaacctagagaatactatgccaaatgaaataagccaaacacagaaaggaaaatgttgtatgatctctcttatatgtggaatctaaaaaaaaaaaaagttgactacttagagagtagaactgtagttatcatatgtgggtgcatgaagtaggaaggttacaaagagatgcagttcaaggatacaaaattgcagtcatgtcagatgagtaagtctggagatctaaagcacagcacaagtaatctagttaataatattgtattttatactagatatttgctaagagagtagattttagacactcttaccaccagaaaaaaaatgttgctgtgtaaaatgagagatgtgttaattggcttgactgtagtgatcatttgagtgtgtatatgtataacaaaacatcatgcagtacacttaaatctgtataattttaaaatggataaaatgcttcaatgaatcctgaatataaaaactaaggaattagctagagagtaatctgggtactccagatcattttcctagtacaactttggagtgaaaatgactattacaacagaaccagatgtaacaccgtggcctagaaataagattcaaaaccgattacaggcttgccttcctgggtaaatgctcttataagttcttcagtcaacccaactgacttctaatttatttaagtgaacttcagtgtctttgaaatccctgattttttaatcttatttgacaggatttcattagttagaatatgcaaattagaaatatgaaaaggacagatgaaaattatcagtaaatttcaggtactgatatttataaaaaccttcctgttaaattatattctcaaattattcataaactcttgaggtcttgaaatctttttgagggctactctgaaaaaaagaagtttgcttctgactgccaattatttcttcatgaagagaaaaataaataaataactagtaattcaccttcaaaacagtttgaagggagaactttaataaattaacattggcttttttaagttttgatttcactgttagtcccagatcttatcttcccaatgagtcctgtatcttctttctagtattcaagtactagactataatttctgttgaaaaactatttagggatttgtattacaaccaaagctcagactgagtcagttgctttcagtgataggtttcattataaaatgttcaccttcctctatagataaaaaatatacatactatatgacttttttcactgaatgactgtaggtttctataatttaatttaatttaatgatactgccattacaattcattaccttaaggactttgattcagaaagtcaaaacttatcagttaattcacaaacaattatgacctgtgccttcattgagattgtatggatgtgtgtgtgtttgtgtgtgtgtgtgtgtgtgtgtgtgtgtgtttaattctatcttttctgcgtgggtttgtcactaaagttaatagaaaatcctgaaatataacggaaagatgaagcatagtgggcatttgctgtggaaagtcatggtcacatgacggccactcgctgaactcagataaccaaatcaatttttaacaataatcaaagctgctctgatggagctagttcaagctaaatggaattttttaatgtgatcaggaaatgtattattttattaaaattagagaaaaagaagtaattgaagcagcacgatgacactgtttccacttgagtgcagatggatgcattacccatattatctcttggtcataatatacacagaggcttcattgcttcaactttactgacgggtgtctttaggtgataaaaattttgcaccctatattacaaattttcattgggtaggtggaaaatatttattcaataacttctaattttttatttcatcatcattcagtttcaggccagagggtaacaaatgtagtaaaaatacttgacagcattcaaaattattttaaatggaatcagaactatttcacataactggttaaaagagaaatattttttctttccattatgcaatttcttgtgtcctggctttaatgaatgtttcacttacaactttaagaataatatgtaagtagatatttttaaaaatggaaactcaatattctcacaataatatataagaaaaaaatgcttttagtttatccattcaatgatgttctaattgctgtgtcagttatcacattattttaaattactttaatgaaaggttattttcaagaggttttcatatttaaaaagcatcttgattctagtgcaacaaatgttgtttataagcaaagagaataaattaaatggaaacttattacgtctttgagtgactacacattctccacttgatagaaagattaacatctagattcaagagaaattaattgaaactcaagctaatatttttgaaagacagttttactatagaaaaaaataatagcattgcacaatgactatttcaagttagagaataatcatgagttagctaagatgtttgcaggcgtatagctacagaaaattcctcaccttatataaatgtccttgcctaaattttttcttgtccctgacaaatcctttctactgtccgttcctatttgaattgtatgcagagatgtgactaattaacggtctgacttctttttcaaagagtcttcatatgcttgaccaaagtcttaaactactatttttattcttcattttgaaagaaaatctcagttgtttagatattcttatttcacatattactttctaaacattgtatatctttgttcctttcctctatttctggtttatcagtgtcacttgaaatgagttgtgattggatgggtaactgattttttaataactgtgtcttgttcatccaaatgactattagaaatagttatttggggaggtaatgtagtaactactctttatatattgggaatggatttcattcccattttaaaaagctaaagagagccaagatgaatgaacaaagttggttgttgagtgaattaggtatccaaagtcatgagtcttttttctgttagttcataaattgattttaattaccagtttacagagaaatgttccaaaattgttctgagtagtgcgaacatcttcccaggtgattattttgaaaagaccacttcattttgatgtatacactttgatatttgttttaaaattttttcaatgttttatagactttggtactaagttagagatctagaaaacctggactgtactgggaatttagagagctcttagaccatagcaaaatatattataaagagtattaatgatctattgaatattatcttctattttttcaaaaagccttttccatatgttaatttatataattcttatgaagctgtgggtatatcaataagcatttttaaccccatttatagatttgcatattcacagtttgtaatttccttgggttcattttatcagttgactttccagtaggactaggaaccatgttacctgatttctattctataatttgtctctgcatcccccaccctccctgttactgtactcaagaaatgtgctagcaaaatgaaagaggaattcaaaataataaacgtgtgaaagcttgctctttcacttattaattgctgattcttcttagttcttgagctctatctgtgagtagtttgtttatacccaatcatataattttataagtgagatatttgtttttgtctttattaagtaatttatccctgacttcttcagtttccaaaattattttgaattctgaacattctttccacgtgctgagtaaagaaaactttgagatttctagaagactggctactctggggctcctgggctctacttgggggaagcacagaaatccatttgatcacatttttggataacatgaaatttggagtaaacttggggtaaagagtaaatcacaaagtagactcagaaaaatcagaagatgcatgtgtgattgatctaatatgagaagacacagttaattagtgacaaaagtaaggttctattcttgggtacaaaaacttaagtatacatctgaagtggagacaaccatggcaaagagaagattttgtggaaaaaccatagagggatataattgacagtaagataaacagtatagcttcttttaaaaagtttatcttagttacatttgaaatgtggtatctaggaaaatgaaaataatgtcctcaatgaactatcataaaatggcatctttatcactgaatgagccccactatatcccaggcagagctcaagcatcaaggatacaaggatattctcagacacctgagacctgccctcaggaagcttgcatgctagaagctccctcacaagagtgatgtcttagtccattttctgttacttagaatactcaaagctgggcaatttttaaagaaagggaatgtatttcttacagttatggatgctgagaggtccaaggttgaggggctgcatctggtgtgagttttcttgctggcagagactctctggagagtcctgaggtggggcaggacatcacatgatgaggggcctgtgcttgctaatgcgctagttcaggtctttctttctcttcgtataaagccatgaatcccactcccatgatagtgcattaatctgtgaatggaataatccattcataagggcagagctgtcatgatccaatcacctcttacagaccccacctctcaatactgccacattggagattgagtttcaacatgagttttggaggggacattcaaaccatagcaatgataaaataattgagccattcagagaccccgagagaagagtgtcctcctggccagagaaagagcaacagtataaatatcaaggcgtagttatacaagtgagcaaatatggcctatttcaggcatggcaagacatactgaacagaggtgagaatgataggaaatgaagagaaagacataggcagagatgaatcttgtggagtacttcaggtcatgataacgattttagatgttattctgcacttgaggagtgaagtgtctccaaagagtggcaaggtctttacattttcacaggccaacaccacaccagctgtcgctttcctcagatcctggagtgaatgctcagtaggccttttctactttgtacttccatggcatcttgttcatttttaaataatggtttttatccttcataattttaattctcctctcttctagggctactttttgcctccttcacccttggttagctgcttataaataatttttactactctcaagggtgacaggccccaaaaatgtgcctttatcaactcaaattcatcacttctagaggaaacgtgtctccaaagcacatgttctgttaatggtaggacatcatcattaactttctatacaagggaaaacattattaaatattaatgcaaaaatcagactaacacacatctctttccagaatcattcagttctatcatgtgcttaatatatttaaaaattttcccaagggttcagatgagaatagattttgccactctatttatcttgcaacaaaaaatgaaaatacagaccacaaaaatacatttcacagttggtccctcaaaagcatctacctctctaagagtttccattcatgacattcagttttgtaccccactgttttgctttgtgtgtactgtcccaattctttataacttttcttcattacattttctaaataacactgaattataagcttattataaaatgaaactcatgggttatggccactctcctttttaaaggacttctctctctacctgatgattactatctttcttctaaagggttcaaaacaaatttagatttttctgggcttttttcagactggtacctttaattttttaggcacctttgccttttcaaaaggcaatttctctttgcagtactaacaaaccaaactttaaaatctcttatcctcctaacacctacactcatgtttatataggcctatttacaattagtctcatgtttggtcaccatattttcaatgtgttcacaacaaactagaccctctgatgttatcttcttctcagaaagcccactcatcacttttgatttggcatatcattattttattcttgttttccttttttccttgtgttgatgtacttctgatttcttctgagtttattgcttatggagtagatttgaaaaggtcccattcctaaccatcgtccaagattagaaaatttgaggatttatttattgactttttgggtttgatctaggatgtctaaaggctgaggcagaacagaaaagaggaaaagggaggaagacaatgttagacagtagctagacgggaatgactccagctctagaccaaaaatataaccaagctctgagaacctctgtataaaggcggatgggtagctcttattagtgagatgaaattaaagctgaattgctctaccttatacctgtatatacctaataccaagtatgtttttggtcattttttgttttttcttcataaatcagtacattcagtttcctcattcttaatgcattcatttttttctttgtgtaaatttaaggattacaagtgcagttttgttacatggattcatagtgaactctggacttttaatgtatattgtaatgtaaccctgttgttagttttaacatttttcaaaaatctcagttcatcctaagcttgaagattctttacagtatttgtgtgctatcattatgtatacagatgtggttctgttgtcatgtatactatggtagttaagagaaggagctttgaagttttataatactttgctcaacatttactagctggataaatttgggctaattatttaacctctataaaccttggtttatttatctataaaatggaagttatagtacctatctcattggattgtaataagacagaaatgatatttaatatgataaagcgagtatcacaattcagagtctcagtcctccgagtatctccctcctgctccagccaccctggtgttgccccgcttttcattatccaacaatgattggcacatcagggagccatcagcactctggtccagccctaagactgcttgtaaaatgaatatcaactgtaattgtatctgtctctagttataaactgataaaagaaagagtaccagacttatataattctagccatgcggttgacagttattacttttttttttttttggtacagataatcatgacttaggaataaaaaataagcaaacaatttgggcacacatttattttgatggtatttaattgtgactagctgcaaataatgattgtaaaagaaattacagtaaaatatcaaagttcttacaggcctgaaaacacttagaaatcacaactatgtctcttatttagaaatacagaaaatcaatgataagcttaaagtttacaaatagtagtgaaggaaattactgtcagactatctctccatttcaggtgatttctagaccacagttcagaaaccagatttaggatgaatgacctctgtctaaacagggagcatgatcaagtacaacactgaaatacaaacgtgtgttaatttccaccagatagaataattattatcaattaacgtgttttttgtttttgtttgtttgttttttgagacagagtcttgctctgtcgccgaggctggagtgcagtggcatgatctcggctcactgcaacctccgcctcccgtgttcaagcgattctcctgcctcagcctcccaagtacttgggattacaggcacccaccaccatgtccagctaatttttgtgtttttagtagagacggagtttcaccatcttggtcaggctggtctcgaactcctgacctcaggtgatccactcacctcggcctcccaaagtgctgggattacaggcatgagccacggtgccagatcctcaattaaggttttgacacaaacatgagaaaatttaacattgtcaaaagtatgctgtgaagatgtgtataaatatttactcaattggaaatctgcatcctcttctcaaacacttttttgttgttgttgtttgagacgagtgtcgctctgtcacccaggctggggtgcagtggcgtgatctcaagtcactgcaacctctgcctcccaggttcaaacaattctcctgcctcagtcttctgagtaggtgggactacaggtgcccgccaccacatctggctataatttttgtatttttagtagatacgggtttcaccatgttggccaggctggtctcgaactcctgacctcaagtgatttgcctgcctcggcctcccaaagtactgggattacaggtgtgagccactgtgccccgcttctctcacacacttaaaaataaaaattatcttgtaataaaccgtttactcatattttaaaagtttgctcttggaaagaaaaacacgtcatcaatgttctccaagtaaaatgcttttaggggaaacttttgaatgttttactgcagactactcaacaaattgctattttggatagagggccaaatggatttctgttttatctgagtattaataaaaaaaaaattcgaaagcttggctctctcaaactatgtatctgtgcatcatatatgtggtttatggcatcaaagttacagttcagtagatttctaaaaggcttttgagacagagacatgaatttttacagattctaattacaagttagaagtcatctcactgtgggaaattaaaaatggagacaattagagaaaattccagttgaaagaaaaatgcattatggaaaaagcaataaaagcacacacaaaaaagcaggaaagtaaaaatcacttatcagtagcctctagtattcaattgtagatcaatagtgtgtagttagtgcattaccaggagaacattaatttgcaattaccgcaggtgatctgatcctctcttctgtccattgacacaaatgaccctttgttgaaagagagtctgtagtcattattttaaatagagcaacagaaaggcaaaaagaatgcttaggtcactttcagtcacaagtatcttataccacacaaaatgggaacgtttatattttagcgccagtcacgtgatggagtgtcatgggcctaagcatgggcgtgcctgtttgtgcgcaggaggaatgtggtatgcactatgtgatggtgggtaaaaatgattcaaggatgaaactacaagtgccctcagttaaatataaaataacgtagacctttcataaacctctactacaaggaaaggtatgagagattttagttgaactaagtgtgtgtttttcattgcctccttttgaacatacaatttgaatagcctgggaggtagagaatcagatgcctcaacaaccatacattcttgaaagaaagtggacttcggctctctagagacgctattgtaatcataaataatatggcaaggactcagatgaccttttccagaagctactggacaggtagtgatatcagtctcagaatcaccaaataagaacaggaagtcactgagaactccaccttattcatgaatgcttcaacccaaatgaaaatgcatcaaattgtttgggttgaaatcccagctctgttgctcattagctatatgaccttgggcttactagacgtgtgaacattttatacttcaattttgttatctgtaaagtggagataataatactacctacctcgtagtatggttgtgaggattcacaaccatatgcaaagcacctcatacagtatctgaagcaaagtatgtgtaccacagatgcaagctattaattatcatcatcagccatcatcatcatccagtctgctagtagttttatgcatttatgccaaattttaaaataaaatgtacagccctctattctagcttttgactagtatgtatcttagctcagggtggtagaaagcagaacccaaggaaagggtcaagtgttaatgttttgttgggagataaaattctagggtagcaagagtaaaagaagatggaaatgagacagagaaagatgagacttgaatacaaggtaatgcattactgagttagccactgcttcacaagcttcagtgagacaagacagccaactggccacgtggaacaactccagatagactagctagaaagcaatgccttggggtaatccatcacaggaaaaaatggagaggaaatgtatcttctattcccttctgccttctgtcatgcattggttgaagttcatccttctggagagtccactacccagtccttctggattttatcacctggtgaaagcttcttcaacaccctgtggtttggcccagtatggcacttaatccactatattactctcttctacacttgtgattatccaacgtggttgaatattcataaagttatacacaatttctgccttattttggaggatgtgccttcatatatcttttattcattggcctacttctttttaaaactagatagaatctatccatgctattttcatagaaacagagactttcagaaatggagaaaaccttgacaatccataaatagttgaatcttatattcatatgactatgagtggtacacaggtgagtgaaaatagtgtgcaattttataatagttttaccatatcataacctaaatcaagtcactcccaggatgcaatacagaaggctaagttggatggtctcaagtaaaatttggctgctgttagggaattctattggtacccccaaggcttgctggaacctggagaaattagtacagcagtgacctaagcatggagaagtgatccctgcttgttgctggaaacccaggagaagtgctctgaaatgctttcagtaatgtgctttaaaaactggcaagcatgcatgcaaaacatcttctaaagctattaatcagaaagggatttgacaagcagacggcacatgtgcctttctagaaaagtgtctaaaatgggcattttagtaactcgagagggggaatatcatccttttgccgtttctccatttattccttggtcaaagcagcagtgatccattaatcacccacgtagtcaagtgaaggaggaagaagacaaggaaacaaataaatgggataaagaaaacagaggacgaaggtccttatggtcaaacaattgacaattttgtaaaggaaaacagcttacctacagcagtttccttttttatccccatggacaggtacattttattagtaaaataaaccactggttcaatcattcattcaaagtcccgtatttgactgaagtagtctggcaggtcaatctgaccatttagaagttttaaccattctaattgtcatttaaaatctgtgatttgattttcacagtacctagcattctagtgcctggacattgtgataaccatcttaactatcttaagctgacatcatgtaaggaagcgatcattaagagaacataaacagcttcccaaagcctaactataatccacagccaggttaagtatgttgtcactttgcaaattatgataataaaaaaattatcatggttaacttgtatgtgaaatttactatgagacacaccttttgtaagctaaaagttgtaataatttatttatacctccagtaatcctgtgagatagttattgttatagattgaatgtttgtgtccccccaaaatgtatatgttggaatactaaccccaatctggtagtattaagagataggcctttggtaagtcaaaggtttgataggtcagagggtggtgcccttataaatgagattggtgcttttattcaagagactccagagagcccctattctttctgccacttgaaaacagcaaaaagatggccatctattaacctggaagcaagtcttcaccagacaccttgatcttggtcttcctagcctccaaaactgtgagaaatgaatgtttgttattgaagctacccagtctatggcatttttgttatagcatgttcaaacaggctaagacaggtgttattactgtcctcattctatagacaggaatgttaagttacaggatggcaagttgtgatatgaatttacacaatttggcccagaatctgttattttaaccggtacactatgttgacatttctgcccactaaaatggctagtatcaaaagacagataatacttaatgacggtgaggatgtggagaaactggaatcctcacacattgcttgttggaatataaaacggtgcaactgctttggaaaacagtttggcagtttcttataatgttacaaaaatgtaccatacaatccggaaattccactccacatcatctatctcagacaaataaatatatatatccagaaaaaaagacttgcatacagatggtcatagcagcattgtttctaataccccaaaactggacacagtctaaatccctagcaggttgatgaatggtaaacaaaatgtggtggtacatccatacaatgagatattattcagcaataaaatagactgacaccataatagcacagaatattttgacatgtataaaaacatgctaaatgaagataaaaagacacaaaatactaatatttgttattataaaattccatttttatgaaatgattggatgtgacaaaattatgaggacaacgaatcagtagtttcttgaagcttggggaggtggtgaacagtggctgctaaaggatgcaagaaaacttttgggtaattggaatatcgtaaaaccaggttgtggtgatgctgcacaactctataaatttacaaaaatatcattgccttgcacacgtatagtgggcgagttttatgctatgtaaattataccataataatgtttttaaaaacccacatacttaaagatagcttaaataatatgtgtaatgaagttattaaatactgaattttgaaatctgaattgggagcgattcatagtggagaaaaatctgtaggcaagtaagggggatttcactcatgcttaggagttctatttcttcaaagtcttacgggaaaatgacataatacctttatttaagatatgtatactattattagtatcagcaatgtaacaaaattaatgtttgtgaaccttgccaaatttaaaaataagcacgtttaaataagtctgcctaattaaggcatcctgggtaggaagcatttctatatttctcaagtgtgttccatgtattaaagtattaaaattagagtatttccttacaaataagcactaatcatactttgtataaatgtttatgaatgttgcaagttatttaaattttaaaactgtatattatttaagaaaagttaaatatatcaaggagagattggctttgaagctgtcaataactaatatctgctgagaaactcagtcataaggttcatattatcaaacagtgtattatgtagtggtcataatttctattcattcagcaaatagttactgagtgtctgatgggtaccaggcacattagtaagaaacagatatataagaaaaatgtcagatagtggtaagtactttacattaacttagaatttaaattagactgtgtgatagtgactgggaggataccttgtctggctggggagtcgtctctagagcagtgatgtttaagctgagaactgaatgagaagattcatccagctatgggaaagtatggagaaaggcattgcagaaagacagagcaaagctcctaaggcagaaataagcttgacatactgaaggaaggccaacgaggcaggaccagatcatgcagtactttgtagaaagtgttcccatttttgcaaagtgaggcaagacattgttggtcttatgcagtggcaaattatgatctaattaatatttttaaataatcatcttagctgtcgtgtagataattaatttaggagggtcaagagtgaataaagaaagtattgcagtgaggcaagtgagagaccatgattgattccagttgcaagaagctgtggttatggcaacaaatagattcacgatatatacttgaagtagtgctacaagatttgctgagagattgaatggttgtggacatgaaaagaaagggacagagatgatttctagactttggactggtggagtagtaggctgcagtgagtggaaaaactaggaatggtattctggctatagttaagatgcctaggaaacacctccgtgaaaatgtcagataggcactagtatctttttgtttctatcctactttctagacatgtctcaagcctgaaaatgcatgtacaagccaatgcagataaatgaatgtatgtcttatctcctagctaggatgtatgtgcattttcacttcttaagaatgcctcatagtaattgaaataatattaggcacaaagcagatatgtgcatacttgcttgtggacagatgctaaggggagagaggaatgccttactgtaagtctcgaccaatgaatgtttaaaaatggacaataagcaactgtgttttgaatagttcagaggccagtttcagtaagctcttgtcattctcagaaatatgttcctgaagctaaattttagaagattatgaatctttgaggaaagagtaaaagaaatgaaattcatatcaaatgtacattttaaaataaaataagtaaatggtctataaaacatttccctccaagggggagggaaaaaaacgctctacatttattagctttaaacacatgctcatccaattctataacttgccttctttgaatattcaggaaacattccttcttcattttgtttaactggtcagatttcctacacatttaatatttttgtggctcatcagtcttttgaaaacttttaaaccagattctcctggcctgaaatataaatgctccaagttaaacatttctcttcccctattctatggtcatgccccacataatcagaagaaagaacaatgtttgctcttagcttcgtttggcagatatgaaccaggaggaccttaacagtttgtggaattaaagatgtaggcatgcaaatataaactgccattatctccaaatcaacaattctgtgtttgtaagacgaaagaagataatatgtctaaagatcaaaatatcaaacctttgtttcagatagctggcttaatcccacagtgatagacctgtcagatattataatatttagcatatttcctcatgtggaaaatgatgggatttcagttgtcatgctttaagggcataagcaataatctcattatcatcttcctaaatcaatcagtacatcgtggatattaactctggatgacaccagatgtagcaatgaatatgaggtgagaggaaagtttcacgactcatcattgagcctaaaaacaatgacacaagcaaaaaatcagtttaatcactggtgaatttgtatggccaaatacatcacacattacacatgcctggtcttacacagctacagtaagaatactgttgcacatttataaggcctgatgtctctaaaacacaaaaaataaatgtgagtaatctggagggagtttaaaaaaagccaattctattgcatgtctgagcattatttaattaggtaatgttgattataagcagattcaaaatataagcaatggtttaaagtgtgacattttatagacaaaaatgaaatataaaacacataaaatccaacttacctgtatttatttaccttatttaccttttctttgacctaattcatattcaataattgatttaaaacctgtagtatattgatttatgggtaggcggtggtaatatgattctggtttatactctcaaagcataacaattgaaagtcaggtcatttccttgtctcaaaattcgatcttatatgtttatctgtgtgtgattaagttaattgtttacaacaaagatatgatcattttggtcctggagctcaatggagcaactcatcttagaaattagtcaatatggaacacacacacacacacctcagaagacaccagttgcacattcagatacaaaattcagaacttgaataattattcttacctctgaatcaaacgcattgtgtcacacctataccaacaagggaggccttcctagtaaacagtacttaataattcttatctcatttggtcctcacaacagctctgcatggaaagttcattctgacagaaaacaaacagcataacctcaggctgcttcagtcaacaattttgtttgataattgaatgtgaaaagaaaccggaagattagtccataaattaacatgtgctgaatgaaagaataaattaattagtaggtagtttttgagtaatagagaaagtttttgaagaaatgatgagtttgaatatagctcccttggcgaagtgcagtgtgtcacacctatagtcccaatccttgggaggctgaggcaggaggatcgcttaagcccaggagttcaagatcagcctgggcaacatagcaagaccctgtctctacaaaaaaattaagaaattagccaagcatggtggcatgcgcctgtagtcccagctacccaggaggctgaaggaggaggattgcatgtgcccaggagtttgagactgcagtgagctatgatcatgccactgcattcagcctaggcaacagagtgagaccctgtcaaaaaaaaaaaagaaagagagagagaaagaagaaagaaaaagaaagaaagaaagaaagagaaagaagaaagagaaagaaaagaaacaaagagaaagaagaaagaggaagaaaaaaaagtaaaagaaagaaagaaaagaaaagaaaaaagaaagagaggaaaaaaacaaaaacaattgctctcttctggtaaaaattcagaataatctattaaacactcctggctacattcccagcaaacagagagaaggcctttactgggcatgtgcagtggttttgcaggacctgtattagaggaagcaaatcatttacaatggcaataatatttgtacaaatttgctcaataatacattttatcatttactttgaactatttcaaagtaatttgatgaagtgttgaactttatgaacttgaaataattaaagatagagagggaattctttaaaatgaaaacattagtcctgacccaagaatgctggactgacctctattggtgcgtgatgcagaaacccaaaaaaattagataagagagtctagacacaaaacaagatagaagaccttttccttagcgtctctgggctctgttttatctgtcctttattagagttagaatccagattgctttaatatatatgtgtgaaaattagaacattgtatatattggatttgatagtgtgaattcagtcattgttaaatgagatcttttatagggttcttaattatacattccttcagttagtgttaaaggggactatcataagagaaaacataatcaaatgacaattgctgataagactcaggcatccagactgggaacaccagagatgcaaaaatctatacacaggctttgtccagtttgtctgtgacaaatagtactttgaatatgaagaaaaatgctgaagaagtagagttactccctgcatccttgaaatacattggcatatccaaagaagagttaagtaataatgcaaagatattaatgtataaatgatgcaatgagtgatatagagtgcagcaaaagttgagagaaaagtattctcttgtggattgatgtgagttcttaattatgatatattcgtataattggagagaaaaatgtattctggacagggaatgaaagggaattgtgtttgtcactgactgatactattacaatatttttattttgcttcatgtattcatccattgaataagtcatatgccaggcaaagatctttatgtggtaagtactgggtgtacaatggtaaccaaaagaaatatagtctctgccctttttgctgtgtctctgaaatctggtgaatgagatccaaatgatgatacctattgtgcagttatttaggcactgaagtagataattatgtatgttttatttgatataatacttacaagaaatctatactacatatacataggtatatatgtgtatatatgtgtctatgtataaatatatgtacatatattgtatatcatacatacaatattgtgtgtatatagatgcttgtgtgtatatgtatgtgtatgcataaacctaaaaacatatacacacatacatataaaacatacattaacataaacatataaacatgtatacgcacatatgcattataagcatatagattatatatatatatatatatatatatatatatatatatatatatatatataaaatctccctgttttcacatgaaagccagttgccttcgtagtagtggtcagaacagaaagcaggactgcactgtggttacaagaaaggatcctgtgggcaaactgagccagaattttaatctttgttctgccatttagtagctgtgtgatcttaatcaaggcctgtaatttctgaccccatatttacccatctgctaactgaagaaaataataatacttacccaaggtgctattgtgagtttcaatgtggtgctacatgtagacatattttgaacagggtttaaaacataataagtaacctaagtaaatttcaaaatgctgtaatcataagggaatttgggtaaagcataaagaaataagttacaaaaggacagaatattaagtttgttaaaatacaccaaacttttccacccttaaaggatatggattttgagtagctccttgcctcccctgtcccctttgagttttttttttaggctgaaagacccttggaggagtgtctggagaagacatggaagctccgtacccctccctcataccttgccctatgcatcttttctgtttggctgtttctgagttgtatcttttatcataaaagggttaaactgaagtccagtgggacagcagagcaagcccatgattacaggcaatgtccaccattcattccctgccaccccattcccattaagcgctggagatgccctgtgaggacccaattctagtgaaccacattgtgtgagagttcaacaagattcaagacaagtacaagtttccaggagatgcaagggttagaggaaagaaatgtaaagaacactgtggcaaagcagccagactccagcagtagggtttctacaacaggctggtgcaatgaaaaagaggctgtgccagataaaaggaaccttgaaggacagagcaactggatgcaacatgcagtcctggattgaacctaggcttggataaactagctataaaaatattatggaaattgtactatggatatcagattacactaaggaattatttattttattaactgttaaaatattatttggctatatagaaaaatggttttatattttaaaatatatgaagttcttactaaagttgaaaaaaactgtgataatttttcaataggtgaatggattctgttgctacagaacaacctggagcaaccttaaatgcatactgctaagtgaaataagtcaatctgaaaaagctacatatatgtgatttcaattatacgacatattggaaaaggcaaaactatggagacagtaaaaaagatcagtggttgccaggggatgggggaggtgagggtgagggggatgaatacgtacagcatagtagatttttagggcagtgaagctattctgtataaaactctaatgatgaatacatgtcattatacatttgtcaaaaaccatagaaaggtacaatgcaaagagtgaatcttaatataaactatgaattttaataatagcatatcaatattggtgctttaactgtaacagatgtaccatctaatgcaagatattaataatggggaaggtgccgagtttgggggtggtgtgggcgtatgaaactctatgtactatctgcccaattattctgtaaatctaaaagtgtactaaaaagcaaagtctattaattattttttttaaagttggaggccaaaagggaccctttaaatctaggattatctgggtcaataacaggatcaagtcgggtcctcttattggatcaagtcaggtctccaggattccaaatccccacctaagtaataaaagcctggtgaattagatccaatgttaatgctctgaggcctgcataagtatctgaaagaccagaatgttaaactaaaccaaaagtgacggagcattttggaatgcattccacagggacaagtgaaagtctccctccaatataaagacaggaatgaaaaaaaccctctgagtaagggaatcacagatcctagtggtacaggacaatcccagtttatactgctggtcctggtattttcactaatagtttcctgtttactctcaagtgtcacagtttggatggtaaattatatggtcatctctaagcatcctcctaaaaccctcagcctagaacttttactggtgtttgtaatctttcttcaggttgtcagagtcacaaatcataaaatatgtgcccttttagtgagaaggcataaataaaactacttctttggacattgcatttgtttgtctgtaaccatgttccagtagatccatcttttgtagctgaagaccaggcattttacttttaggttcttggccttcattaaaacaaaaagccaaaaaaaactagcatacaatttattttcctggtctttctgcaaaaccacaaactttgtgagcttttatttttccatatacacagtaaagggattaaaaatgagtttagtatttttaaaagttccttttaacaaatgcaaaccttattgctttgcttctctagccctcccataaatatgcaccgtgtttaccatatattaacttcaacattggtaaggttgttttgtttttcctataacgcttaactcttacatagtttattcactcttaatcaactgaactttaacttttgtgtcccagaatatattggcaactcagtcaaaattgttgactcactgataacagccaagttgtactctctcacaaatttgtgtttttatcaattatagattaactatcacaccaactactgaattgtgaatgctttcagaggtagtcaggactatttgagatgttattttcatgttaacaaatgtttctcattgtaggtgagttgttctttttttttttttttttttttttttggaatgtgaatgtctgcttagttattgagtgaccacataactttcatccatcttcagagttcagaaaaaaattccatgcgttaattttccctatagactttttctctttttttttttttggggggggggggtctgaactcatcctttattattttttttattttttttattatactttaagttttagggtacatgtgcttgtgcaggttagttacatatgtatacatgtgccatgctggtgcgctgcacccactaactcgtcatctagcattaggtatatctcccaatgctatcccgcccacctccccccaccccacaacagtccccagagtgtgatattccccttcctgaactttttctctctaggcattatgacttctcctctgtgatcaaactctatctggtattttagtgaatgatatgataaatcaagttttcccagctgtgttgactctgttgaaaaagaaagattgcctaaaattaaggatttgagtcttctgacagctattgtttggatgtttagtttccttttcttaccccacttttatcatgagaggtgctgagcatgcacaatgctacatgcaaacccttacaccaccacctgtgttactgcagagtaattgaaaattgctgtggtaactgatgcagcaccaaagcctgatggtgagaaacgatgttagtagaaaaatcctactgcctctgaagagcagtggccaagcttcctcaaactgcagccacagttcctaaccaaagaatgggctgcataggatcctggtgtgtagaagactccagttgttacctcagtcttttgagtcttgtatttatgcccgttgggaagcagagccatcaacagcaatatctttgaagagacagaacagtaatcaccattctttggccctacatgttgtacctgtctcacccattttatctctagtgtcacataaaaggcagacagaggtgctgtgtctctgtatggttcttattattatttcttggttgcagtcattattgagatctgagtccagttagagctcactttgtaaaggacagatacaaggaagggggcagggcagtctcgcctgcagggcacagccctttgactaatcagcgcaggccatcttcagtgaaactgtgtcatcaacaaagtgcaacagagaagatcagtctcacaaatgctcttctgaatagtagtcgagtgggtggcccatcatatgctgcctttgagaaaatacttggagaattgatgattatattctggctggcaaaatgtggtttggatctcagtataatataccttgaaaacatattattctcttcagtctgtctttagctgatcttgggttaagaaattaattaaagaatgaccacagagttacactgaaaaatagactttcaggctacataaagttccttcctaattggaggaaaagggggaaatttttatacttaaaatttatcagagaatttatcgtttcagaggataagtaatgtactgagaagaaatatatgatttacaaaataaatgactcctataccatttggactgatcaatgagtggcaattaaaaacaactttgaaaatatttaataagcagaactacttatccatttcggcaatttttctgaactgaacttttgaaaaacaacatctccggggctattcgtttgttgttctttttttcccaatcctatttgctgtggtcagaacatagacaactgaactcaaagccagatttcttagtagaatgacatttggacagctattttacttagtgatcctgtgcagtttcgtagcaaagctgaaataagccctctccttttgggggaaacaagatggtattctgctgaatgctggaattttatcactttgggaaaaaaaaaaaaaaagctgcttgagagacctaagaatataaaagcatttgagatctcagaaggagtttaaatcaatgcactgccacagttacagagcagatgagagagcctgctgtctcaattgccaggaaactacttagaaactctcactttgatttcttcacgtagtccgttacattactgctaaatgcaatatatagggacatcatgactttgatgttgtacagctccaacagatagaaactaatatgatagaacaactaagatttgtggttttatgtgaatatacaaatacatccccatctagttccctatttactatgtatctccaggggctgtcttttaacctatatttttataaaattataattttggtgttttattcatgaattccagtaagcaatgccatgtttatgtagtaccaaaagctcataggcggatattgttattctgaattcttaccttatctatatgtattgtacatccatttttaaagtacaatgtagttttatacatctgtttgttagtactggtcagaactcaattccgtgagtaattattgattccatgccttcagaaaatctgatttttttaatcagtaggtgtggacagatagaattagaaactgcataacatccgaaaacaggagaaatttagtttccagttaaagtaagaaattttaagtgggtcatccaaatattaaaaccttaaatgttaaaaatctgtggatttctgtcataataattaactaataaatgtgaaatcacttcgcttctttttatgaaaattatacatatatgcttgtttatatatgtaagactttcatctcatttaaggctttgaaatttatggaaataataataaaaagaaaagataaaaagctctgcagaggtcagaaattctgagtcttactgttggccctcccagttactaatcttgattttgggcactgcattcaatgtttggtttcaatttcctcacttactgaacaattcatagcaccttctctgtctttctcttagaactgctgtacgatgatattgacagacagtgttgtagcagaaagagcttcaaaccaggcgggtctgccagcactgcctccaactagctgtgtaccatgcacagatcatttagccagtctggactcctgatctctgaaatgaggaagctggtctgaaaaaaagtctaaattccctttaatcttgtttgtcaccatgctttgaaaactataaatcattgtatagatatttctttttgacagcatgctttgaaaactataaagtgctatataaaatattgcagatgttttgcatagtttaaacaaaatatgtgcttatcaaaataggttagtaagaagagataatataaccttctttttcctgagaaagctttaagaattggatgaacaacccttcttattcagtgtttcatatatgaaccacattcatgggaggcttcttgaacctcttccagatacataactcagttattaatgcaatttgtgatgtgataaccattgcagaagaatttccgtttttgcttaaatgtagtaattctccaatagaacttttactaatgaatttacagtaaatttgagacaactttagacttaaattgtaagcatatattttacttgcatataacctggaggcacatacttctaagtcctgaagtgtagtttatccacctgtatgataagaaatgaaaagggataattatggtcatgggtttatctgagttgtgtttaatagatcaagatctctatttttaaactttgttatattttaaaatagcatttgaaaaatgtgctatttgattacacaaaagcatgtgccagtctcagggtgttcctgcttttgtagaactcttctctgccaaattatttacctgggataaatatttttaatctaatttagattttatttgatagcttccttgtaaatttattttacttttcagatgaagtgagcttttttttaataggcaaaacttcccattttggcctctgccaggcacttgaaattctagattacgtgaaattctacaatacctatgaggtttagtaccattctgtctaagctttataatttccacagtacttccaccttcatggtataatttaatcttcacaacaataagatgttatcatcctcctttttcagatgtaaaggagggagaagggaatcaacaagctaaatgactagccctagttacacagctgccagatgacaagagttgggtctcagacctgagtcttctgacaacaaaaccaaagctttttttttttggagatcattatttaatgcaaataaaaataaggtccatgcctttcctctgcagtatttgaccaaaaatgtattacattaaaaaaattatatcctgcctaattcatgccctaatgatttattcatagtatgaaatttaattttggtgccaatgtagctgagtataagctactattttaagcacttaagtatgttgccttttagtttcctatgtgctaagtatttaatctccatttttaagtgaaaaaaatgctcatgattacacagctaagatgtaattggaactctattctgcttgacttctgtgtgcatgctctcagcctcttaacttaatatggcatagaaaccacaagattgactttaagaaacaggacttcaagtccaagctctttccattttacaagtaagaatattactccctctcctgactaagtcagctttgagtactgaaagaaataatgtatgtaaagaagattttgaagacgtaaatctccataaataggtaatttactgataatctagttaatctcattttatgagaaataatgagaaaagaatagctccccacaaccctctgttaccatccaggtatttgtacagttgttctgcacaggtcggcctctattaaatgcgtctgcacctaaagtaaaaattcagggcactgtgtcagacccctggaggaggctatttggtgctttatggaacacgtcaaatcacgctgcacgggggccaccacctactctgctcctgtgtagggctggtcctgctgagaatctaggggcctctctttaaaatagctcactatagggatattcacacatatagaaataattaatggtggcaacgatccttataatggcacctgatgccctgctgtgaagaaagataaaccagccttcaccataaagaacttacaaattatactaagcaaacatgttaacagctattaagagtcctaatcagagctgttaaacaaacaattaagagatgtcatataaaatgcacccatttaggcatagcagctacatgtttggagttttaacaagaacgatttacctttgagatagcgataaggccctcaatggagtatataagttaggcaaggacaaggcatctttctaagcaattccatttcctgagatcaaatccatgggcaaagctgttctcaatggtgcacttgcatcctaagttttatttttagtcttattagtatttaatcagcaaattattcttgtttcttcaaacatgacttcttattataagtagtgcattctttgaaaggctaggaaaatgttgatataatctaatagtaaaaattaagaagaaacctatttgtttagaagaaatttttttttgcagtcagcatttcagttgagatgagattcacccctgccagtgcttaagactttgctgttctaagtgtggtccagcagcagcagcagcatcccccgaaaatttggccaatgcaggatctcactccaggatcccactctaaagctacaaaaccagaatctgcattttaaaaagatccccacctgatttgtatgtgcaacaaaattttaaaagaaaatatcaatgtgcaaagttcctactatcaaaaattctatcaggaaaattagtaggtttaatcttattggaagtaaaaattaaactactcattttgtaaaggtacgtaagtggtgtgacatttgccatatgattaagtatatctgaagtggtcccctccagcactcgtgtctcatggtggattccagggcttccagcattgcacactatcccagtcttgctcagtaagtatcttgtagtctctccttcctcttaaggttttgtgttcagttcacattctcagtatagctcccaattatgtgaaacaccaaccctgtatgataaagagtctagaagtgggtgggaaagaggaagttttcttagccttgggacctaccatgttcttctacagttaaaagatcccaagtctacattctgatcactccactccttgtctgagtctactgtatacaaattgtgccatgtttgaggattgagataactcatagcttttgtatcttcttcctggaaacatcagggatgatttagattatactttactgttcatcccttgcagtgtatttctagattcattttagcagcaggattttacaataatcatgaaaatcccataaagtacatgacattatgtgattttcaaaatctgatttcttatgttcacatggtgaactattttaagactatagtaaagtatacccataagcatatactacaaaaaaatagaatctcagagtgagcaaagaggattaagtaaagcatcagttgacttttatagtcaaaagaaaaaaaatacccctgtggaggaaatgataatgatgttccttataattgttgtgagaaaaaaacaccaccaactctaagaaggttataacaggcctaattaatgttcaaattgttcctcctgagaaacagatttttttaatctgatgtaaatgggcttcctagaaaatgttcttgttcatatttagtagttattctatactcttttctacattgtactaacatgcagcacttcagaatagaaaatgaaggggtttttgtttctgctttttggttttggcttgttactattcttactcatactgtacaagtaagaaggtaaattgaaaacattgacaatttttgtctaaaagtgtggattttttcaaaaccagagctatatttcagttgaagataacttgattaaatttttaaaaacgtatgcatttggtccatgcaatagttgtaggaaagtatttgtagttatattaaaagtttttcctctgttaatgtctatatctaggtcatattctattgtatggccaggaattctggtgccaccactttctaaccatggggcctggagcaagtcatttaactttcctaagactcactttcctcacctgtaaaatggggctgaaaattaaacctatcttttagggttatcttgaggactaaagaagataatatatttaaaagtgctaacaaagtgcctggcccctaagaagagcccgcatcatgttagatattgcattgttttattctcatcgcataatcattcagccaattttgacagaaatctcatacacagaaatcagtctgtcctattctgaaatgtaaaataactgtatctccttaaaacataattattttcattctttaaaaaaataaaatgcaggccaagcatggtggtccatgcctgtaatcccagcatttgtgggaggccaggtgggcggattgcttgagctcaggagtttgagcaatatggcaaaacctcatctctataagaataaataaaaaaataaataaataaataccaaaaacaattacccaagcatggtggtgtgtgcctgtagtcctagctacttgggaagctgaggtgagaggattgcttgagctcaggaggttgaggctacactgagctatgattgtgccactgcactccagcctgggtgacagagcaagactctgtctcaaaaataaaagtaaaaagcaaaatgcaaaaccctataacctataaccccagctcgcctcttcctcttacaggagccaaacttcttagaaatgtgacctggctgcatatctttagttcatcatccctcatccattcctcaacctaccaaaaaaaccggcatctactccattgcagatctctcctataaaggcaaatgttatccggtatattgccgagtgttacatccagtcatcgcttccagctctgatattcctgacctttctgcagcgcctgacttaactctcttggatctcttctgctcggtgtccctcacgatcatcttccttagccttccttttaagtgctagcattcccagaatttcacacctggcatttttttaggtacacatcatggaatcactaccactgcttgctgagaactcctaggcatatatatatatatatatatatatatatatatatatatatatatatatatatatacacatacatatacacatacatatatatacacacacacacatatatatatatatatatatatatatgagagttctgtctctctctctctctctctctctctctctctctctctctccttatcccattccccattctggaacctcctagtatgttttcaataaattctctcaaccaacctagcaacaatgaggtatcaggtagcatgctaggcacgaggcttacaataaaatgtatttaatcaaagacccaaaaggctttaagagtctttgaaatagaatcttattattctgttttcaggcatttccttcattttctttttcattcatgcatgacatgatttttctttgttggctgccattgccagacaccctgatatactaggtattcaacatctgggaaaacaggatagaaatgagtttttctttgctcagttttgttttaatggttgtttcattgtttgaagttgaaatataaattgggaagtatgttgaattcatgttgtaaattttgaatttgatgtaatgttgggccatgttggtgaagaggttctacaggaagttgtaaatgactctctggagtctacatgtgatatcaaaattggagggatatctttggaaataagcaacctagaagcagtatctaaatccacattcttcaagctttaactcaaatcccagccacactcacagaatccccagggtttttttagtggaagaactttaatttctctgattcaaacttccttaactccagaattttttattttagttctcttttctttttaatcttttgtaatagtccattctcatgctgctaataaagatatacctgaggccgggcacagtgggtcacgcctgtaatcccagcactttgggaggctgaggcgggtggatcacaaagtcaagagattgaggccatcctagccagcatggtgaaaccccgttcctactaaaaatacaaaaattagctggacatggtggtgtgtccctgtagtcccagctactcgagaggcagaggcaggagaattgcttgaacccgggaggtggaggtcacagtgagccgagatcgcgctgctgcactccagcctggtgacagggtgagactccaaaaataaataaataaataaataaataaaaagatatacctgagactgggtaatttataaaggaaagaggtttgattgactcacagttcaacatttctgggggaggcctcgggaaacttacaatcatggcagaaggggaagcaggcatatccttcatcacatggtggtaggaaggagaagtgcaaaggaaaaggggaaaagccccttataaaaccatcagattgtgtgagagctcactcatcatcacgagaacagcatggagataaccatccccatgattcagttacccccaccaggtccctcctactgcacgtggggattatgggaactacaattcaagatgagatttgtgtggggacacagccaaaccatatcatcattattcattcatcttatatttgtggagagcagactaacagacaaacagtgtcctagtcactgcagataatatagtgaccaaaataaatgcagttcttcccttctgaaactttggtctaattgggaagtgagttgtcaactaaataataatgcaataattagaagttaaaaatgtctgattaaaagaaggccataacctattctgggctcctggaagcctccttgaagaagggacatttaccatgagcctgaggaatggttggtagttagccatgtgtggaaaagaaaggccttctagccagtgagaaggtcttgtgaaaagatcctaaggcaaagaaagactatggcattttttttgaggaagaaaggaaagacctgggtaactggatcatagttgacaacaaggagaacaatagcagatgaggagggagacagaggcaggggtaagtgatggttgagttaacgtaataaacagcactccaacctcagtttgaccactttcagacgtgagaactgcctgcaggcagcacatcccaatagagtgacaatgagaatttaaatgtcctttattatgttgtgccaaattcgactccttaagcctgacatataataaactgtagctatttaaactatacaacttaataagttttggaacatgtatatacctgtgacaccattaccattgcaagtttatgaaaaatgttcattgtccctggaaatttccttgtgttctttgcagtccattcctccccaccacccccatctccagacggctactgatccatcatgcctcaaacagtgcctggcacataaaataaatatttgttgactcaaagaaaagtgaatttgtttggagaattatctcttggtttgacacttggttgactgctctgtcttttctaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaaggtatgtgcttaaatctcctgtgttattcttgagaactcagccttggtttctatttcagatcttatttaccatctcacattctcactaacaaaggaaacacagtgcctcctggatgtgatttcttcagtggactctttctgaaggagacttgattacagccatatgatgggtctgtgagttacctttttataaaccaatacaacacaagattatataaaaggaaaagaccgatgtttgcagtgtaaagtgcctccaaattcttgcttactgtggtgatgactggcattcttcccagtgggagtctggagatttctttatgctttctggaaattataacattacctttctattttcaagacaatcaaatcactgtagtcttgaataatataaggaagtttttaaaattaaaatctaatcagtatcttttgtaactgcttctgctgtgtggttaaacccggtctcaaacggttatggtcccagctttctcactaactgctattttccaagaaatatacactacatttacgttttctataatacagtgattttagcaacactgctaaaacaacattcagcattttgcctttgtatttcctttgtattattctaaatagataaccattgtcagaagacatttcttgagccctcaatgaggggaggaaaaaattataattcttagtcttttcagcttgtcactacatcaataattaactttaaaaaaaagagaggcagtataaaaagattctttaaggaagcatttaataattcaaatgaatcttaacttgaagcaggtcacatgaaaaagaatggaaaacaaaagccctgggtactctgccttggatgactgggttagggactcagaaagaataagagaaacatcatataattgacttatatttggctagttttagtagaaaatatcactgtccctctcctaatagatagccaaaaaaaacccttcttcaagagtaatgtgtatggttgcaagtccagtaatgaaaaaagaaaaggaggaaagaaataaaatcttacaatgtgggttccaggaaaatgtcatgatgaatgactccatgagtggcaatcaaacagaaagactgtgacattaatatttataatattgtaattagcaagataatgcctaagcagcattattagtgtaactaatcatattatcataaactgactctgcagtatttagacagtgagtgttcttgcctttatcaatgactatcaatatcctaaggttgcttataactaaaaaaaattcacaaatgactttacaatcattcgatgtaaatatctcaaggaaattgtctctgacatgatagtttatgaccatctataaaatcattgtctcaaatttgggtggttgccatgtgagcggaaatggaagtagctgcattgcactgtcatgttttgtctttaaaggattttcacactcgtttcaaaacttacatattcaaataaaagatgggtaatgatgaagacaacttgtgtcaatgacataaatggaaactgatttggtaatagtttgaatcaagattcagactttattttgttaagctcagctttcatcaaaatcgtaagtgtaattttcagcattatcattcgtttaaaaaaaggaagatttttctatgtgattatattagtgattcatttctcaacactaacttgaggaataagcagatggtctggtaatagatttgtgcttctggattctcctgtgcaggctgacatgactaaaacaataggtgattatccctttagatttatatccccagtagtgaatcaaagtactctggatctagggtacaggtgatttcctaatcgttcttttttttggtcctataatttttttatttttctttttattatgtttatattttttattatactttaagttctagggtacatgtgcatcattctcagcaaactaatcattctttcttaatgttgctgctgcttttgtgtgtgtgtgtgtttgtatgtacgtgtgtatgtgtgtgtatgtgtgtgtgtgtctttgcatataactcacattgtcctatcattagccaaagaatagtatgctggtcctcacagtgtccgcatactataggaagatgagagaaaatgtagaccctttgtagaaagacactctagaagtatctggcttctttacacaggaaaattttgtttggaaagtacaatggctactctgatattcactcataggtcaggctagaataaaccagaatagatatttagaagaaacccattacagtgcagtgtttgacaatggagagaaaatgagacttgggctatggaaacaaggatttggccaagtatgtcatgttatctttcaagtaattagcatattaatatactttccttatgcttaccttacttattaactgatcaaactgcctaaccagcatttcttcaggtggctgttgaagggcaggtagttgggtgttagtacacttactgtgcaagccattaaaatctgtgcctgcaagaagagcaaattcctgagaagaacagtcatcagctttggcacaacacagagctgttgatgtcaaactcttggtgcttaaaaaccatgcagcatgcttgtgagaaatgtaggttcccaggccccactagcattgatcctgagtcagtgggtaagaggtgtgttgagaatctgcattttaacatcataattctcatggagggatccaaaaatctgcattgccaaaagggacaaaaaagagaatagcaatagaacagtgagagattgagaagtcagcaatgagcagaacacaagcttctcttgatggagaaagtaaacaataaataattttgagctgaaaaagaagtgaaataaaagaggcaggagaggaatgccagagaagcatcacattaggttccaaatggccagaggttggaaatacccaatgaagaaactgcatgtaggacagcagttattagcaaatagtaagactgctggatttatgtgaagcttccttgttagctagacaacttgggcaagttacttaatctctgtaaacctttttataaaactgtacaatgaaaataattacaatacagttccataatccctcattaacaattctgaaatccaaaacatactgaaaccaaatggttttacataattcattcagcagaaaacctggcctgaactgatgtgagacttgctataatctttattcctctcagagaacatcagattaacgtgtttgattccaggttgctaccccacaccttgctggggctggagagggagtgtttattaaaattaggtgtatgtaccattttacatttctaaaatccaaaagatatttctaaatccatacatctggctccaaaggttttaactatgggcttgtgaagattaccaaaatgaaaatataattgcaaatataacttcatccagaaattcatctatagagttggaggcaatgtatatattttagtgatttcagaaaagaaaacattactatttggcacttttaattatgggaaataagagttatgttgacattcttcgttaagaaacatgaaagaaattggacagtccgatatttgaacaacaaattttgcaactggaaaagcatgaaagaaaatgtcttcactttttggtgcttgggatgagaacaggactcctaaataccagtcatgaaagaaaaacagtagaggccaaaaactaatgatcacttgggatctgcatgcatttccacatgctgttcccgacatctggaatggccttccagttctcaagcatcactttttgagctattccctgacctttgctatagaattaatgtctccttcctttttgaaccttggctgtaaccagtatcacatcgcagttgtatttttgtaagtctgcttcctttactagaaaataacctcacttttcttacccatctttgtatctaagttctctagacatgcactgaacatggtaatgccttaataaatgttgactgaagaagtgaactgatgactaaatgaatgttgaaagaaaaaagcttattggtaacattaagaattagtaatcacttgacttaccaagccattactttttccattacatcagaaaagaaaagaatatgtaaagaaataacctttgaacttaaagttcctttttatgtgtgaattgagtttggtaaaaataacatggaaaaagccagaatagaaggagtgagatagacaggtgagcaacctttatgccttcttgacttggcaaaatatgcctagattataagcttcttgacggcctagaacacagactgtgtgccagtgcctaatgcaatgtctaccatgtaggagtaatggcatggtagctgaattgaacatactgatcaatcattaatatatttttagaatctatcttaaatgtcacttcttttgtgagtctgtctatgaccctcttccttggcctccaagaaagtcaaatcactcctttttattttattacagcccatggttcctacaactagtattgcaagtactgcattttctttaattgtatatcttcttgtccagtgctgcaggtcattacaagcattttgaaggaaagataatatcttattcatactggagtttgcaagcacctagcacaatgctacatgtttatagaattaaattgcacgaattatctgttgtgtccttatttaggaggaaaaaagaaagtcaatgtataattaaaattccagctagatccttttaagaacagcagcagtcattttagaagaaaacaataaacctgccaaattactgtactttcagtaggtttcaaaaatgatgaaatacatattggtgatattaataaatgaacataatctgtgctcattaaaaggctctcattaggataaaatcagaaattctgtcatggtggttgtacagcaactctgaaaacaaggatttgttttgataatagaaaccaaaattgtatccatatgaccagatacatcattctcagttattgataaaacaattctaaaattcatatgcaaccaaaaaagagtccaaatagccaaagcaaatttgacaaaaagttcaaagctggagtcatcacattacctgacctcaaattatacaattaggctgtggtaataaaaacagcatggtactggtacaaaaatagacacatggatcaatggaacagaataaagaacccagaaagaaagccacatatctacagtcaactgacctttgacaaagttgacaaaaagtatacactaggacaaggacacctttttcaataaatagtgctgggatgattggattgccatatgcataaaaattgaattatacttctacctctaaccatatttaaaaatcccctcaaaacccatcaaagacttaaatgtaagatctgaaactataaaagtactagaaaaaaatctaaggaaaactcttctggacatgagtctaggcaaaaataattatgacaaagacctcaaaaacaaatgcaacaaaaccaaaaatagacaaatgggacttaaaataaaaagcttctgcacagcaaatgaaataatcgagataacagaaggcctacagaataggagaaaatatattcaaactacgtatccaacagggactgtcacccagaatttacaaagaactcaaacaactcaacaacaacaacaaacaagtaacccctattaaaaagtacgcaaaggacgtgaacagacatttttcaaaagaagacaaaccccatcaagcatataaaaaactgttcaacatcactaatcatcagagaaatgtaaattaaaaccacaatgagatattatcttataccagtcagaatggctcttactaaaaagtcaaaaaataacagatgtaggtgaggatgtgggaaaaaaaagggaatgcttatacatttttggtgggaatgtaaatagttcaaaccctgtggaaaagagtatagagatttctcagagaactgaaaataaaactaccattcacctcagcaatcctactattgggtttatatccaaaggaaaagacatcattacatcaaaaaaatacattcatatgtttatggcagcactattcacgatagcaaagatatggaataaagctaaatgtactttgacagataataaagaaaatgtagaatactattcagccataaaaaaagaatgaaatcatgtattttatagcaacatcgatggatctggaagccattttcttttttatttttttaatttatttttatttatttatttgagacacagtcttgctctgtcacccaggctggagtgcagtggcacgttctcggctcactgcaaccctgcctctcagattcaagcgattctcatggctgagcctccccagtagctgggattacaggcgtctgccaccacgcccagctaatttttgtatttttagtagagacagcgttcctccatgttgtccaggctgttctcgaactcctcacctcaagtgatccacccacctcagcctcccagagttctgggcttacaagcatgagccactgtgccctctggaggccattattttaagtgaaacaactcagaaaaagaaagtcaaatactgcatgttcccacttgtgagtggaagttaattaatgtgtacacatgcacatagagtgtggaataatagtcattggagtctcaaaacggtgggagggtagaagcagggtgtaggatgaggaattgggtagaagcaggatatgggatgaggaattgcttaacgggtacaatgtacattactcgtgtgatggttacactaaaagctcaaacttcaccactatgcaatatatccatgtaacaaaactgcacttgtaccccttaattttatactaataaaaaaaactgaaataacacaatttcataaaactattgctatttggttgtggtaatattatatgtagatgtctaattatctatttttttcctttctggaaagttattcaacacagagaataaagcagtgtccaaagaaatgtgtaaatgtcaacagcaagacccttaccaaaagcataatgacagtttcaaaagaggatactataatttcctatttacaactttaaaagttttgtatcttctatgccacttattttcccttattgaaatataaattacttggaggaaaaatacagaggtcttaaatgaaccatttgacaagttgtgacaaacacatatatccgtgaaatcctcacctctgccaaagcatgcaacattgccaacaccttagaagctgccttgtgcacttttccagccattacatcttcctttaccaccaccagaagcaaacaccatctagcacctgccaccatagattagtttgttcatgttttttagcattcacataaatggaattctacagaatatgtatttttgtatgtgttgcaactttcactcactataatattacagagattttttcatattattgtaggtattagttcatttttgttggtaaataatactatattttattaaaataccacaatttatttactctaagttgtatttaggctgttttcacttttttggtgttataaatatttttgctataaacatacttgcataactccttttgtgaacatgttttcatttctcttggctagtacatagaagtataatttctcagtcataaggtggatgcataagttttacaagaaacttccaaacagagttccaaagtggctttactctttcacagtcctaccagctgtgggtgggtgtttggttcttctatgttccagccaccttttgatattctcagtctttttagtttcagctattctagtacatatgtgttgatatctcattgtgattttaattttcttctccctaataagaagatgttaactcttctttatgttcttattggccttccatgtatcttactctgtgaactgtctattcaaatattttgtccattttttaattttttaattgatttcttggagttcttaatcattctagttataagtccttagatcagcaaaagcatttgacaaaatccaacatccaatcataataatggccttcagcaattcattaatagaaggaaacgtctacaaaaatcctatacctagtatcatacttaatgttgaaaggataaattattttctcttaagatcaagagctgggcaagaatgtccattctttctacttctattcaatattgtactggaagtcctaaccagcgcaataaggtcataaaaataaataaatgatatttacattggaaaaaaatgggcttgcactgtctttatttgcagatggtaagattgtgtgcatagaaaatcctaaagaacctataaatacactattaaaataataagtgaatttaacaaagtttcataatacaaaaacaatgtacaataatagttctgtttctacatgaacaattggaacaatgaactggaaattaaaattttaaaatgtcatttacaatggcatgtaaaaactataaaatacttaggaacaaattaaaatatatgtagtatctgcactgaaagaattgctttcacagcgacgtggatacatgcagccaacaagcgtatgaaaaaaagctcagtgtcactgatcattagagaaatgcaaataaaagcacactaaaataccatctctcaccaatcagaatggttattaataaaaactcaaaaaataatagatgctggtgaggttgcagagaaaacagaatgcttgtacactgtcaatggaagtgcaaattagttcaaccattgtggaaagcagtgtgttgattcctcaaagagcaaaaaaaagaactgctattctacccagcaatcccattgccaaatatatacccaaaggaacataaatcattctaccatgaagacacatgaacacatatgtttattgcagcactattcacaatagcaaagacattaaatcaacctaaatggccatcagtgacagattggataaagaaaatgtggtacatatacactatggaatactatgcaaccataaaaaggaacgagatgtgtcttttatggaaacatggatggagctggaggccattatttttagcaaactaatgcaggaacagaaaactaaacactccattttgtcactcataagtgggagctaaataatgagaatacaaggacacaaaatagggaacaacaaacactggggcctacttgaggatggaaggtgcaaggagggagaggatcaggaaaaaaataactactgggcactatgcttaatacctgagtgacaaaataacctgtataatgaacccccatgacacgagtttacctttattacaaacctgcatatgtacccttgcatctaaaataaaagttaagaagaactgctgaagaaaaattaaagaagacttaaaataatggtaagatatattaagatgttatttctccctggattgatctgtatatacatcataatcccaatcaaactcccaacatgtgttttttagaagttggcaagctatgctaaaatttacactggaattcagacaaactagaatagccaaaacaatcttgaaaaaggagaacaaagtgggaagtgggagaatttgtactatctgccttcaagattttctataaatctgcagtaatcaagcaagtgtgtttgggtgtcagggtagacaaatagatcaatgtaatggatagaaagtccagaaatagacccacacatatacactcaattgatttttgacaggggtgcaaaagcaatccaatggagaaaagaaagccctttcaacaaatagtactggaattattggatacctatattaaaaaataaacctcatgtctacctcacacaggacaaaaaagtaattttaaatatgtgatataaaaaagtaaacagtaaggtaagactataagactttctttttagagttttagattcacagcaaaattgaacagaaggcatatactccttgccttcaaactgtacatttttaaaagcaaacattaagtaaatatctttataaccttggggaaaggaaaaatgtcttggacaggataccaaaaaaacactaaccatacaagaaaaaatagatgaattatgcttcatcgcaattaacatactcatcaaaagatacaattaagaaaataaaaactcaagtcacagattgggagaaaatattcctatacttgtatctcatgaagaacttgtgcccagaataaatgtatataatattttcaaaatgtaaactgtaataattagaaaatttaattttattgatgagtatatagaatcttaaaatggaaaatctataataaggacctgctggtaggctcttgcagcttactcctgtccatctatgataacatttttgggggacttttttatactgtaatgaccattcttggagctaacccagaaaagaggagaagggaagggaatgaaagccatttttcttcaagttcattgtatggccctgtacttcttgtccatgttatcttctcccattacagctttgtccccacagttattctccctgggactgccagacagttacattatgttgttagaaaagttccagatgatatttgcatttctatcagtcacttgggtaatgattgatataaaatatattattgaggtcactttctatgattgtagtcagatcacatgaggctaaatattttttattgttttagttcatttcatagggcatgaggaaggaaaataaaaaacaaaacaccagtccctgaaagttcaaaggttcaaaattatcagatcagaatgtactgcataaatgttatgaagacttaatctacatctgaatatcgtcagatggtttgagtgatatcttaagtagaatgctggagtgtcaagtatcctgtaaaaataagacagacacctgttttataaattgtgattattcctccttagaagcaaaaaatgttggataaaatttgttagccccatcttgttctgagcttctgatcatctcatcagtgtgtgatgatcccacaaataagtcaatgtgctgtagtcaaaagcttaccacagaagagagagtgcttgaaacccagaaggtctgagtttaaatccaggcatgatgccttactactgggtgagcttggaacagctacatggatcccacaatcctccatttatgtaaaggcaaactgagatgatgatagctattttgcagtactttgtaaagattagaaatcatatatgtacacagaagtcttctgtgataaaaaagagaaatcctctatctaaagtgtatagcatgtagttgtaagcaatcaatacatggtggttgttattataactattcgtaacatggagaggcatagatagataggcaatttgggataatactgaatatgtgatatatccatttccaaaatatatgggtaatattggggtagatagaaacatttgagcaatactttatgagttgattccttctctgctttgtgcagatttttcagatggtacttacaaattgtttttagaagttaccttaacctattgacaccatgattttactagcttagttttgtttgatctggtcaaaagctagcatctttgtcttttgaagcacctcctatcccaaaaagcttctaaataattgagaagtgttcactttccaggtaaaatggagataaattaattaacttcaagtttgggcagtaaattgtcatgagtagtccatcattcttcctaaaataggcagaagggaggtgtctactgctgttgccaaaagttaacatctgaatttaacgtgaaccattaggggaggggctgataagagtccctcaagttatgggaagaggtagttttgcattgcttgtaaccagagtagtttgtgaagtcctgtaagcctccccaacttggtttctctcatcccagaggtaagttggttcattttacaaggcaactctaatcatttggtagtacctgctgggagccctgtatagaggaagctcgtgattcaaagcctagcccagcagaggtgtgtgatcaattgtcagtgcctgcatggacattgagatataggatgagatagtacagaacatggatttccacttccatgtctgagtgtggagtaccaacaggtcaccaattctaggaatttgggcagcaatgtgctttttgaatctgtagctgctacaactgccttatcacaatccaccattgcatgcctgaaataaaatgtaaactatactacattttcattgtgttgtcattctcccataagttcctttctcttgtccatcgtgcttatacagattatgattccccatttctccttactacatcaaattgccaaacacaaatgcagttacttcttttgtcacattcatgggagtggttaagtataattcctcatacttcatcaaatataactaatcagaatgcaccttatttaattatatacttaaaacttgtataataatgcttttcatattcaacacaagttgtccagattaattctgatgttgcttttaaaccatgaaaaaaaatgaggattgttcttgttctgggtggagattgaggatttaaaatgaaatcattactatatccatgtaagttaaaacttgaattcaaattctagccttgaattcatgccctacctttccttctatgatctctacacaatcagtggacatttatagcaaaccagttagctttgttcccaatcctcattttatggagtaaagaaaatacctctctgcaattttgagctatgcccctgatactcttcctgagaaaaacatgtatttgttatatctcccgttaagcccatctgctcacttgaataaagggaatattagtttgaagatacaattttctggtaattataggagacaaaggagtcattttgataatgtaaagagtcaacagaaattataattatattgagctttatgccaatttgtcctcatctaagatttcaggggaaaaaattgaaatgtctgctgtttggaataataaaagggggatttaatttaccaaaaaaaaaagtcaaacaaaacaaaccataattaaatttatttttagcttcaagatgatatggatattgaacagcgttaccaaaaccctgggagcttaggaaggataggtgaggatatcttcagttgccctgaataattggcagtctcacacttaaccaaatcagtttagacattcagatgaaatatccatctcctttccttttcttcttagaaacctggttactctgtttggttacccatattgatctagttaaccacctaattatcaaatatccactctattttatgctgtataatcttaaaaagcaatgttattggtagctcaaatccatgccctataatagttctgtgcttcatagtcacaggtgacccctcgaaatgtgtctgagaagatgtgactacaatgcgcacagaaaatgtgactaatgctgcactgagaagcctttgatttgcagcttcaggcactgtttatgaagtgccttatagactggaagtgccctgaagccttcactcccagccccttacaccatgctggccagtctgctgtggattgtttcactgtcaagaccatgccttttgaagatttgttgccatacatctttaaagcatttcgtttgtcttccctacttatcaattttataccatttcatctcaaactatagagccttttctaggtcctgtgctggctgttagtctcttcatttgctcagcccagcccagctgagctgaagaatgtcacccacccatcatcaggctatcaatctgggcacctttcaaaccctaaatgttaccaagtctttatttccacttaatgtaggtcccaagtgaaacaaacaaaagcaaacacatagcatttgtggtaatccagtcctcctaggaaaataaaattattcctgtgctactgtatataatctttattgagatacagagtaaggctggaatgccatctgactttgcgtgcttttggcatttgtggtagatattgctagtgctcgctaatattttctattctttgtcccctctggttttataagaggcaaacctccctgccccttggatgttccatatgagtgagcgacttactttagtcaatgaaatgtgagcaaagtgtggtgtatgactcttttggctggaagcgtttaagcactagcactcaattctccctactccctttctctgccacgatgaacactgaagtctcatgctgagatagtggcaacataaaatggatggcctagatggtcagataccacgtattagcacagctagagacacagcagactttttctgagtaagaaaggaacttttattttgttaagccactaagatttaagggtctattattaccacagtacaaccagcctatgaggattaatatagaattccagataacttgtaactgtttccaaaggggtagctggctctttagccctgtgaaaaattatgaaatggaaaagttcatttatatggttagattttgtgcccccacccaaatctcatcttgaattgtaatccccaaaatccctatgtgtcaagggtggaacctggtgagaggtgactggatcatgggggcagtttcctctgtgctgtcctcatgagaatgagtgagttctcacgagatctgatagtttcataaggggctcttccctcttcactcatctcttgcctgccaccatgtaaggtatgcctttgcttccctctcgccttttgccacgattgtaagtttcctgagccctcctcagcagtgcagaattgtgagtcaactaaacctcttttgtaaattacccagtctctgttatgtctttatagcagtctgagaatggactaatacactcattttttgtgttcttcacttccttttctgcactccttcccatctgcaagtagctagtgctgtagtgcagtttcccattatatcactccactagtagtctgacctctcctgtcagagtgctccaggctaccacatagcctttctttccataacatacagctaagatgtttatttccccattgtgcctatgctatggtctgaatgtttgtgtcccttcaaaattcatatgttaaaatcttaactgccaaggtgatgctattaggaggtggggcctttggaaggcaataaaattagcgtccttataaaagggaccccagagagatcccttgccccttccaccatgtgaagatacagtgagaagttgccatctgtatggaagcaggccgcccccagataccaaatctcccagcgtctcaatcttgaacttcccagcgtccagaatggtgagaaataaatgtatgttgtttataagccaccaagtttatggtattttattatagcagcctgaacagactaagacagcctgactttaaataagttaggaggatatccagcaattggcctcctccaactgtggaaccaagaagagtgtgcaccttactcatggtttctgtcttgtaagcagtaagccttggacaatatacatactttctcttagcccctatttcctgatccaaaaagttaggatatatatatcttataggaatgtcaaaaaaaaaaaaaaagaaagaaagaatggtctgaatttctttatcccttcacagttcaggttctagaaaatgtcatccgtactcactgcccttcgtttcttacttgcttttctgtcttcagctactcaaggttagatttctacccactggcaacctccaaaatcactaaacatgctctcactaaagttgagttatttactactgatcactcaatccagtagatacttcccagtctttattttgcaaaatctgtgtgacattcaacaactgactactccttcatacttgaaatgtattctttgacttttaaacacatttttctcatatttctctattatttctttcaaggaaacaaccgttcgtacctagtatttgctggtcattatagatgcaaacattaacagtaatataattgtgcccttaaaaggatcacagactgtgtggaaatagaacgcttaaacagttattaataatatagtgtgataattgcaattatagagatatacacagacaacaggggatgagtttcagaatgttttcctagataacctgaaacaaagtctagtaggagtgggaaaaatactctaggataaggcataaagcgtggcaaaggcctggagataaacaatatttctgtgtgtgaagagaaacttcttagagttaatcttttaggacaccccccctacacacacacacacacacacacacacacatttttttgtcccttgaatactggtattcccttgttccatctctggctctcatattgttgtatggtcatttgacccctgaagccaatattcctctctttattgttatcttccaaatctgtactctcaccaaagacctccctgtggaccctacacattcctatattcagctttctggtggactttgatacccaacatcccagttcagtgctttttctgcaacctcagaataaaacaacagtagtgattatccctgacaattatataagcactttataatttagaaagcactttggcatacattatctcaccagctgcttccttaatgtaatagcagcagtgggcaaaaaaccgtgtcactcccgacagctcttttctgaccttggtctcccagccccacctactaaaaacatgagagcatctggatgagagctgattagagcctggaagctgaccttgtgtggggaccaggggagcatgacagcagtagttgccacctccacaccttctccatctccataggggcaatagagcaagccagagatttcatggcagaatgcaggaggctacacagagcagcaaggcttctcatggcctgcctaagcagaggctgatgatggcaggcatcagcttgtgggaggttaagcacttatccactctccccccacttttctgatttctcatttcttccatgcattaactaccactttgaaagtttcagtgggttaattaaattcttctagtgttgatgctaagaaagctgaaacattttcaactgagattgacactactcaagacataggcttcactgatgtttgttcagtaacactccaatatgtcacaggattgccgagagaacatctgagagctataatgagctaaaagtcaagtacaggggaaaatgtgttccagactgctgcagatgttctcaaatcaaatcttatttctgtgaaatgccatatagaatattcagctgttgaaagatgcaacacgaaaggacagttcaattgatttgcactgtatttaaaaattttatgtagcctaaattatatgaaatggtttttcccacttttgaatcaattaataagagatgcacttgattctaatgagcttcaaggatgattttttggactaagaggtatgcattaggtggtttaggtaggagctaaggcttatagaacgtggcagttgaataagggaaataaggtatagttgagaaacagacattctctagacccactcccttgcccttattcttcctttatcgctttggcaccaaaatggagaagacttctgttgaatgaattcaccaagattctgataagtctatctgtgatactatgttgatagtgaatcattctgcccctcctgagaaacccaaaggaagcttacaggaggagatcaaggaaatgttttggcagatgcatctgttgtcataatcaacttatatgtcatcacacaggtgaccttgcacatcaccataattttggtagtctgtcctttgattgggaatagtattctcttacataaaggaaagcactgaacaagaactgacaacctaggtaaaagagagaaaaatgcttaggtgagattagaaagtacagtagaacactacaatgagatattacttcacaccccctagaatagctaatgttcaaaatactgaaaacataaatgttggcaaagatattgagcagcttgaaaattcatacattgctaatgagtatataaaatggtacaactactttggaaaactctccagcaatttcttgtaagacccaacaattctacttctaggtatctttccaggagaaatgaaagcacatatccataaggttttgaggtaattgaatctcacaaacatataaggaaaagaaaccagacacaaaagagcagttaccaaatgatttcatttatgtggagtttaaaatgggagtaacaaatccatattatttgaaatcaagacagaaattttctccagtaatatttttatcctatatctcaactggggtggtagttttgtgaatgtgtatatttgtctaaagtgtaactgtatacttaaaatgtgtgtatattataaatcctacatattataaatacattgttaatttttttaagaaatgcaaactcactctgaaagaaactataggataagcatttggtaatatttctatgacaaaataagatatatcatataagaaatactaaagacattttttatgcccaaattacttttaatcaggtagcctttgggaactaaaaaccttatgaagttaaccactggaaaagaatagctggtacctagataaaaatcttggctggaaaccagcttaaagaaaatgaatggctaggggcataaacaaatgcatttcactctgccaacttgccagcagctgggtgtggagttggaagacttccggcctttcacatcagggaggctggctaggacttagaaacagagaaggggcacatctgctccttgaggagtggagtaggtagtggatgtggtgtcacaactcaaaggagaagctgcttcttaaagatggaaaatttgattaggtcttttggtaggccttccatgtgctttgctttgtaggatcagccagtgcctgcagcctccgttaacaaaagctggccttgcctgaggccaaagcttccagaacagaaccttaaattgattgccgataggatattacatgcagggctggactcttttgccctaacgtcctacctacccttatacaaacaaacccagtgggaaatttgtctggaaactttaaatcaaatacatttctagtgttttaatatatgcattgacattttgtcttgtaatagcattattattaatggataataaaattataacatttatagaactgaaaacaaaacacttgaggttgaatttccattcactctgggtacactttgtgcattttgtagggcattagtattgcaaattggaaaagagtcaaaactgtactttcattctgctatttttgcattcaggatttctgcctttgtacttcctattatctaggatgcctctcctagaaaattgtgactggaaacaagtatcgcacatcttttctgaactcacataattctgacagattttgatttttggtactaattagaatttattttacatatccctgcctcagaaactttagtgtttggattttaatcatttaaataaacatctatgcatttaacatatattgagtattccatgccaggcactgcagtagttaattgagattgagtgattaataagataaactctttatcattgatgatcaattgttaaaaaaaaaatagtaataaactctaaatacttcacataattgtatataccttttgtgtgtgtattttatatatgcgtgtatatatatacacattatgtgtgtatatatatactcattttacatatatatgtacgtatatacacacatatatgtacgtacgtatatacacacatatatgtacgtatatacacacatatatgtatatatgtacatatatgtgtgcatatatacacatatatgtgtatatatgtgtgcatatatatgtacatatgtgtacatatatgtgtgcatatatatgtacatatgtgtgcatatatgtacatatatgtgtgcgcatatatgtacgtatatgtgtatatatgtacacatatatacacatatatatgtatacatgtgtacatatatacgtacatatgtgtatatatactcattttacaaaggtgaaaactgaggttaaagaggtttagatatttattagtggaagccggacgcaaacccaattctgtttattacaaacattgtgcccgtaaccattcaattaccactcctcaacataactgctattatgctatcggagttatggaattagaaggaaacaagtgtccatctcaacctagggcatcaggagcagttgggaggcaacagatgaactgagtcttgagggatgaaaacactgtaaggtttatgtaaatgtcctcattaattccattctataggcaatggctggctctggctaaatgatcatttgtgaaaattgctacatttttatttatagtagagaaagagttacaaatctgttggataattaattccttctcccgatagggcacaggcttcattcttagtttgtgcttttgggtgtcgttgtcatttagcataaatcctatcaaatctttgtgagtttcgcttttacatttccttcatctgtgacgagaagattctattagcaaccctggcaccttccattaaagtctacaacttccaactgccaggaagggataatgaagtgataaatttaatttgataccaaaatatggaaggcagagatatctaagtgaatttatagcattagctatgtctttcttcttagcattaacaaaagttttatggcaggttatcaaaatcagtgcaataaaaacaaattcatatgaattcccatacacagaaatcagatctatactttgtatcaaatcatgtctttccctcctcttagcatttttgggctcgtcagaacctaatatgagttttaagtattttattacttgaaggatgacaaaaaatactgttgatcagcttatgaagcattttttactcattaatgtatgtgtcctggagtttataaaatcgaaatctccttctccccactggctagagaccagagagcctacgaagaaagataacaccatcaccgatgcctacagttgtgacaatgagggcggttcaaattctgtgggatggaaaacccactttcacctggatttcttaactgtttgtatcatggtcgtaaacacaaaaattctttttgctcatttgcgtccttatactttgtctaaatactaacatttccacatcaagatccctttgttttagtgagctttatcttacacctttatctttatctttccatatgttagcattacaattaatattgctattctagttgcaggtgatgcctataaactgcacccatgaaatgcacagccaggctaagttctgctttttccatgcaatgatgtatgtgttcatcctataaaacagacacaactgttagaatcagtttatgagtacaaggttatttgcccaaggaaaagtagaattgataatcatgataatgacaatacaaattaaaaaccttcaatggttgttatttaacattttgagggctttttgtgttatctactttaatcttacaatgatttatgtaaggtatgaattattattctctatcctgttgagaaaaggaaggcttggagggattaggaagttgtcctaggtcccatgctggaaagagcagaggcagcattctggtcctggtctgtgtgctcacaaaacctccgcacttgcctactacattctaccacctctacttgttatcctgtccagagagaatcattgtttttaatgcttgggatttgattctgagttggcagagagcagattaagattttgctaatctgtgggcaagattgttgaacgttttacctctttcccagtgacctgtggcagtcagttgtagtagaaataatacaatacttactcacctgtattcagtgaacttaggataaattattgcttttgcaggcatgccaccttctttcctcaacctttcatcattggcatcaagccacattgccatcgtgggctgatccttaccatggaccttccgtttattggcaaagatcacaggtccaactcttcctccttctattctgcccatgtatgttatattacttgacttttagcttttctacaacaaatccaacttgggttatgactccatgtatttatttacatgcatatattttccctaccaatgccttaattaaactagtttttctagtctgttgattatgtctttgaaagtatttaagataggccatgcacggtggctcatgcctgtaatcccagcactctgggaggccgaggtttgtggatcatgaggtcaggagctcgaaccagcctgaccaacatggtgaaaccccatctctactaaaaatacaaaaattaactgggtgtggtggcttgagcctgtaatcccagctactcaggaggctgaggcaggagaatagcttgaacccaggaggcggaggttgcagtgagccaagatcacgccactgcactccagcctgggtgacagagcgggactctatctcaaaaaaaaaaaaaagaaatggaaagaagaaagtatttaagatagagacagccagagaataatgaagaagagaagaccttcagggaatggggagaaacctgatcctgaggtctgcatagatccctgcaaattgccttgttctccccagctttgggccttcccttcatcagctgcattgcctatgtagatgtgtatggttgcctggctgcatgcccagcaaactgttgatgtgaacattgccttctgtgtctcttcagtcgtgtcaatttcatataaaatcagctatctaggcagtaactgagtactcgaatgggcttcagattcccctgtggtaagcaaccttcaattggcttataattcttattactgtccagggtaccaggcaatgactgatttacacttaatagcaaggaaaaccctagatatacctgccaaggaccttagagtgtcctcatcacaactgcaggtgaagtttccattcatacagtccttactcaagcattgtaatgtatgcagttctgcagaggaccaagagaaaacttatgagggccatctgaaagtattctagatctgtatgtgggttatttcccctgcctttgtgatgctaatatattttctgtatgtatgcctgcatatttctccctggaagttccctagaggatacctagcctcatactcttgcaccaaagaagaattcccaggataatgatctaaatatttatctattccttagttatttattgagtgtcacaaggtataaataccatggttggggtgaagtgagatgaggcagtagaagggatgcaggtggagatggagagctccaaggatgtttctgagtgattccagtgtcatgagcatagaatgtcaacaatccaaggcagagcataagtgtgcatacagcaagagttacactaccagtcatcaacagggaggatttttgaagttttcatttattatgctaaatatgtatagaatgcagattaaaacaacatggctagttcagtagtgattaaatgtgacaggttgctagtagagtctattaaaagaggaaagtgtggaagtatttttgcagtgagctgagatcgcaccattgcactccaccctgggcaacaagagcaaaactccataacaaataaaataaaataaaataaaataaaataaaataaaaattaacccaatatatcaaaaaaatctaatcaattatcataggcatctggaagcacatcttcctactaagggcattttctctcaagtatttcgccttggaaagaaatgctccttctaagacaaaatgtaaagagaatgccaatttgtaaacatttggagttggaaagaaaagaatacattatggattactgatatcatcagtaaatattgactttttagaacactctgaagaaaatggtaatgattagaccattccatagagaagtaaatgtaaaactgtaaaatgtttataggtaacacaaagtaggtagaactattaatatttcaccaagaagaatcatcagtttgattattcttcttgagcaaaacagaatcactgctgggtgtagtggctcatgcctgtaatcccaacactttgagaggctgaggtgggtggatcacttgaggtcaggagttcgagactagcctggccagcatggtgaaaccccatctctacaaaaaaatacaaaaattaactgggcatggtggtgggtgcctgtaatcccagctacccaagagactgaggcaggagaattgcttgaacctgtgaggtggaggttgcagtgagctgcgatcatgccaatgcactgcagcctgggtgacagagtgagactctgtctcaaaaaaaaaaaaaaaattactaagtgggaattgaagccccttctctatatgagcaagcatagtcaggtgtagtgcctaatcacgttaaattcatttttatcaaagggtgaaaatgtgaattctgaaaatttctgaatattaaagttcaatttggtcatctagaatatatctaaactcattggttaaaaaaatctaaataaggaaaagtagcagtgttcctctggaagcaagatttgtctaaagcaatgtatgtgaatagggatagggagaatgaaaattcaatgagaataactcataccagatgaacatactgtcctcttttaatatgtttccaggcaatggataacaattttcacccaactcttactaaatattaataccttgcagtgggctttacttcagttacctcatttaaccctcagagcaatctgtgaagtaggtcttcctgatacctgtgctttaactgatgataaaacaagtggctcagctgagatttgaacccagacaacaggaaatgaaagcccaaattccaaaccattctacatccctcaatagagtgaagagctgctgccagcaaggcatatcttgctttctggaaggcatttgacagctgagtatgatagcctgttacacattgtggagaagattgttacttggatcacagagctagaaagcctcataatattctgatttccctaagaaaagcttaacttgtttggagaatatcacgcttaaaaaaagattttatgttcttagagttcctcagatttataattagaatctgtgaatatatgactggaataaaaactttaggtttatcatccactatagaaatctgtcatccaaactagaaaacattactccatcaggatatgttattttattaaaaataatgtacttatgactattaaatgagagtagttgacctctgaaagaaaggtctagaagttttcccaagattggtaataaagagctacaaacttgtgaattttagaaataactactttaaaatgcaggctctttactctttctaggctataatatacctttatgctatcagacaaaaagccctactttactaagtgaattattaatataaacacatttcaagaaattgtttaacctacttaagataattaacagctttcaagtacgctatcaaaactcacatgaaaatcaacaatgaatatgctgttttaaatgaatgtttgttagcaattcttcccattggatgtacctgaaaaaaatgcatttctttcccaataatctgtaattcagtcttttcaccaattcaaaatgactcttcacacaattcatccacgttagtgcatttttgctgtagacttttgtagaatatagaaagcatcctactccctgtggatataatttgatctcagttatatagtcattttctcattctgtctgcctctaccaggaatttttcattagttgcttactgatcttactctagagactcaaagtaattatgtccaagaattgtacagtgtcaagaagtggtaactttcaggaaaaggagtgatatgtgctttaatttttaaatctaatgccagcacactaaataaaatcgagagagtatatgaatatgaggtagctattccatggaagtatatattgtgctcttcctatgtccaaaataattttaaactacactaaaacttttgaaaaatgtacacttttaatgggatatcttctgaaaggctttgaaagaacaagatttcccaccaggaaaactgaaatataaatctattcatgaagaatctcttctaaagcagaatctcatattttttataaatctaaactttggctataaaaaaaattcctatttctgaatttagcattaatatactctctgaagtgattaacaacattagtggtaatacaaactattgaaaataaaataaaaatattttccaaaatgctcaaataatatggtactttgataatattcctgtatctgcattaaattctgcttttttaaactttgaaatataagtatagggccatctggcaagtttggcaattcttgcttatgtctggagaactcataacataaaatataatttctggcacataaaagcatttatacctctgaattaagagaaggggaagtgtggaaggaataggtagctgtgtcggtcagctgccaagggctgaagggaaggtaaagataaaccattagttgtcttaaggaaatcttaaaagaaaagttaatttttcccatttgtatgacacctaagctttactgtacagtgttacttttttcatgttaatgtttttaaaacttttattttagtacatgtgcaggtttgtcatataggtaaactcatgtcatgggggccccttttacagattattttgtcacacaggtactagtcctagtacccaatagttattttttctgattatctgttttctcccacccctcactctcagtaggtcccagtgtgtctgttcccttctttgtgttcctgtgttctcattctttagctcccacttatgagtgagaacatgcagtgtttagttttctaaagataacggcctccagctccatccatgttcctgcacaggacatgatctcattctttgttatggctacatagtattccatggtgtatatgtaccatattttctttatctaatctgccattgatgggcatttaggttgatttaatgactttgctattgtaaatagtgttgtaatgaacataccttatgtggacacgtatctttatggtaggtagaataatttatattcttttgggtataaacccagtaatgggattgctgggttgaatggtagttcttttttaagccctttgaagaatttccacattgctttccacaatggttaaactaattgacactcacaccaacagtgtataagtgttctcttttctctgcaacttggccagtgtctgctattttttttttaactttttaatagtagtcattctgactgatgtgagatggtttctcaatgtggttttgatttgcatttatctaatgatcagaaatattgagctttgttttcatatacttgttggccacatgtgtgtcttcttttgtgaagtgtttgttcatgtattttgcccacttattaaggggttgttacttctttcttgtaatttgtttaagttccttattgattcaggatattagatctttgttcgatacatagtttgcaaatattttctcccattctgtaggttttctgtttactctgttgacattctctttttctgtgcagaagctcttaagtttaattagttcccatttgtcagttcttgcttttgttgcaattgcttttggaagcttcgtcatgaaatctttgcccattcctgtatctagaatggtgttgtctaggttgtcatccagcgtttttatagagttttacatttaagtcttcaatccatcttaagttgatttttgtatatggtaaggaaggggtccaattttaatcttctgcatatggctagccatttatctcagcatcatttatcgaacagggagtcttttccccattgcttgtttttgtcagctttgttgatgattagttggttgtaggtgtgcagccttatttctgggcttatattccattttattggtctgtgtgtctgtttttgtaccagtaccatgctgttttggttactgtagcccctgtagtatagtttagagtcaggtaacttgatgcttccagctttgttctttttgcttaggattgccttggctaattgggctctttttcagttccatatgaactttgaaatagttttctctagttctgtgaagaatatcattgataatttaataggaatagcattgaatctgtacattgtggctgggcgcagtggctcacacctgtaatcccagcactttgggaggcctaggcaggtggatcacgaggtcagcagatcgagaccatcctggctaacatggtgaaaccgcatctctactaaaaatacaaaaaaaaaaaaagaatctgtacgttgttttgggcacttggtcattttaataacattgattcctcctgtccacgagcatggaatgttttcccgtttgtttgtgtcatctctgatttatttgagcagtgttttataatcctcattgtagcgatctttcacgtccatggttagctattcctaggtattttattctttttgtgacaattgtgaatgggattgccttcctgatatggctcttggcttggctgttgttggtgtgtaggaatgcttgtgatttttgtgcattaattttgtattccaaaactttgcagaagaggtttatcagctgaaggaacttttggggcaagactatgaggttttctagatatagaatcatgtcatctgcaaacagtgatagtttcacttcctctcttcccatctgggtgcccagtatttctttctcttgcctaattgctctggccgggtattccagtaccatgttgaataggagtggtgagagggggcatccttgacttgtgctggttttcaaggggaatgctgtcagcttttgccctttcagtatgatattggctgtgggtttgtcatatatggatcttattattttgagctgtgttccttcaatacctagtttattgagagttttaaacataaagggaagtagaattttatcaaagaccttttctgcatctattgagataatcatgtggtttttatctttagttctgtttatgtgatgaatcacatttattgatttacatatgttgaaacaaccttgcaccccagggataaagcctacttggtcatggtgaattaacttcttgatgcacttctgaatttggtttgccagtattttgttgaagaatttagcatcagtgttcatcaaggatattggcctgaagttttctttattttttactacacaacttttcaacttgccatttttccttaatgattgaactctatgaaccaaaaataagtgaataccagaaagttgtctctcaatcttgtttctaaaagagggtgctgtggtttgaatgaccacatcccctgtaaaactgatgtcaaaacttaatccccagagcatcagtagtaagagatgtggtctttggaaggtaattaagtcatgagggctccaaactcatgaatgagattagcacccttatgaaagggtttgagggtgaagggaacactttcttgcccttctgacccttccacaaagtgaggacagagcattcatttctctggaggatgcagcaacaaggcgctatctagaaagcagaaaccaaactcccaataccaaacctgccagcactttgatcttggacttcacagcctccagaactgagacaaaaacattctgttgtttagaaattacccagtctgtaccattttttatagcagcacaaatggactaagacagaggatcatcctattagtttctgatattgttcacaggaaactatgtgttgatttgggtagtagattgttttctttccatttggaaaagcacctcaactacatatagtttaaacttcatgttgaaaagtgtctgttcatgtccttcacccactttttgatggggttgtttgtttttttcttgtaaatttgttggagttcattgtagattctggatattagccctttgtcagataagtaggttgcgaaaattttctcccattttgtaggtcgcctgtttactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagagatccagtttcagctttctacatatggctagccagttttcccagcaccatttattaaatagggaatcctttccccattgcttgtttttctcaggtttgtcaaagatcagatagttgtagatatgtggcgttatttctgagggttctgttctgttccattgatctatatctctgttttggtaccagtaccatgctgttttggttactgtagccttgtactatagtttgaagtcaggtagcatgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggcagtatggccattttcatgatactaattcttcctacccatgagcatggaatgttcttccatctctttgtatcctcttttatttcattgagcagtggtttgtagttctccttgaagaggtccttcacgtcccttgtaagttggattcctaggtatttttttctctttgaagcaattgtgaatgggagttcactcatgatttggctctctgtttgtctgttattggtgtataagaatgcatcagagaaatgcaaatcaaaaccacaatgagataccatctcacaccagttagaatggcaatcattaaaaagtcagtaaacaacaggtgctggagaggatgtggacaaataggaacacttttacactgttggtgggactgtaaactagttcaaccactgtggaagtcagtgtggcgattcctcagggacctagaactagaaataccatttgacccagccatcccattactgggtatatacccaaaggactataaatcatgctgctataaagacacatgcacacgtatgtttattgcggctctattcacaatagcaaagacttggaaccaacccaaatgtccaacaatgatagactggattaaaaaaatgtggcacatatacaccatggaatactatgtagccataaaaaatggtgagttcatgtcctttgtagggacatggatgaaattggaaatcatcattctcagtaaactatcgcaaggacaaaaaaccaaacaccccatgttctcactcataggtgggaattgaacaatgagaacacatggacacaggaaggggaacatcacactctggggactgttgtggggtggggggaggggggagggatagcattaggagatatacctaatgctaaatgacaagttaatgggtgcagcacaccagcatggcacatgtatacatatgtaactaacctgtacattgtgcacatgtaccctaaaacttaaagtataataataataaaattaaattaaatttaaaaaagacttcatgttgaattaaaagtgaagtaggataatgtctctgtatattccaagtatatttatggctgtttgttgattggcttagaaatacccacagctccgttatgattgctgatgcttttagacggtgagaactctttataaagggtcctaatgtattagaacattgatattgttgttttacttgtatcagtatggtagaatgatgggttgcattgccccacagagtttccaggctgttttctgtgacagagcttttaacattaaaaatgaaaacattcaacaatagtggtatatatagtcaggctgtttgagacattccctgtaactgtgtaagacactttatttaagggaaaaatccttgaagaaattaattggtatgagccagaagttgtttggccgatttaatcgctaatctgctgttgtttctaaattgaatgagatccagaaggaagtctgcctgcttccaaatcagccaattcaagatatgtgtgcaggatggagttagaccactgtatgctaaaacgccggctcaaaattaagcaggctttgctatggttggggatgagggagtgattagccaagttttaaacatgctaattcacttttcagggcattttgccaagttaactaaggctatcctgaaactacttgaaaaattaactcaagaataaatagtgaccaggcctgaatttctgttttcaaaatttgttaagaactgaactttgaaaaataaatcagtaagtaaagtaaggcttttattcagatatcacattatggaatcccagtcatagtacagtctcttgtggatgaagtaaacaatttaggttgtacactttctgctccccactgactagttctatgtgtaaggctgtcctgttctctttgaaattcaatctatgtgacaataagagaaattttaagtaccaatgaaattgtaattgattttaaaccctgggaactagaggggggctaatagcagagggtaaatctcttacaatccttctattcaaagagttgcttatctctcatcatcgaacacccccttacttggccttcaaaattctgctggactctctaatctcacatttttcaggtagtatattaacgagttgttcattttcaattttcttatcagtactacagaaaagatacagtgttagtttagttaaggatggtataaccaacattctattatggagagcttaggggaaaatattccatcttgcatttcaagtgtagcttcccattctactgaaatattctgaaaggataagaaagaaaagttgtctttgttgttgtttttctttttcacctatttttataaaataattttctgctttaattccatgtcctttaaataagaattgttctaaaattatcttggaaggcccaccacaacactatatagaaattgttggtgaattagttgaatatataacactgtaaatataaaactattggttattacaatgactcttgacccaaacagtaaaacactatgtcttcctaatgatgattgtatcctaatgataatagtatcagtaagaaagattttatccttcatctttctctacgataaaagaaaagaaggacaggagagagggaaggagggagagaagaagacaaggaaggagggagataagggaggaagatgaaatcataggatttatttagcggcatagtaactgaataatcatatgtctgttttgttatttaatggataaatttattcctttaatattcctatttaacattctaataataagattaaaaggaacagaatgtatttctaattaatttttgttattttcccattttttcatatctccttagctacagttttctacaaacataccacaaattcagtctcaaaattgccccctgaatagtttctgcaacttacttcctacatattattaaaatgttagaaacctttatttatctaccttaagcttctgtgggtttcttaaactggtaaatgtatggtttgtgggtttatttttttaccaagtttaggaaatatttagtcattatttctctaaatagtttttctgtttcattctttcttcctcttttctgagactccaaatgaatatatattagaacttcaaagattgttccacaagtcccagatgttcttttaatttttttaatagtttctctgtttttcagattggacaatttctatttatccatgttcaagttcactgagtctttcctctcataccatctccattatgctgttaagcctacctaatgaactttttattttagtatcacatcttttaaatctagaatttctttttgcttcatttttctcatttattactttgccatatttattatctcatcattcattatcagagtattttactttatattctgagcacagttataataactgacttaaaatccttgacctctaattctaatatctggatcatctcaggactgatccctgttgattgcccttcattttgagagcagtcaaaatgctctttcctatgtctgacaattttatattgtatctggactgtgtaaatgatacattatacagagactctggactctccacacctaagagtcccgatttttgtttgctttagcagacaattaacttatcttaatgcaaaccccaaaactctgccccttctgcagttagcaactgactgaaatatctgtacagttatttcaatcttagctgtgctgcttggcatctgccaagcacatgcatagctcagatgtcagccagtgatttgggtagaatacatatgcagaatctggtgctccctctctgtagctttctttcttggatatctccccagtttctagatgttttgatggccccaactctgatttctcagccagttagaagacgaatttctctctgaattttaacctccctgcttggtaccaccccctgagcctgttctcaggcaaaaagaatagtgtcattcccttcttccaggtgccaattcccctttagtttctgccctcttttggacattcttcagtgcatttggatagagtgtgtgtgtgtgtgtgtgtgtgtgtgtgtgtgtgtgtgtgtgtgtgtgtgtctggtgagttatctgcaggagaagcccaaaggaggtattctgccattaccagaagttgaaatcttcaaaaatcatctatcataaataaaaatatgaagaatccttctagaaagagcattcacctagatataaaactttttcatattgcaaactagtaaaatttgaagacttaaatgttttttgctgttgtttttaaattcccatcctgtgtactgccatcgctaaatcagagtaatgaattcactggttgtgagcaacttgacatgatttgtagaagcacaaaaagccctggggaattggacttggtactgctcacttttaagctaataaagagaaaaccctacaatcaaatgcagtgaagggtataattggtgcaatactacttgctatcagtgtacttttcagggtcatttttgttaactgaggaatgaagtaaaacatttttaagcacccagtacttcaacaagaatatatatggttaccctaagcagtcaagtccaaatatgtgatgcctgattattatagaagtacctattcagcattgctcattgtaaagaatcttattctttagttgcagatatatatcacctgaaatcaagccacatctggaaaatatatcacttttagctccatgtaccattaagggtgaataaaagtgtcaaaagtaaaggagagcttatacacatattacaggtatgggaatgtcggtacaacttgaaaatatatccatcaagagttgtattccacagaaattgaaatatttcagaagcaatactctattgtgtgccatggaatacatatttcctgagtctagagaaatttcaagcctccttttttctgtcgcatatgttctggctgatgccttataatcattgcttccccattcagtcaccatggaaatgagaaggactttgttgtcttggatagagaactgacttaataataggaaactccatatagggataactgggcatttgtgttcctcaggggtcggtaataaaacccatcttatttgaggaataaaatcccacataagtagataagtcttcccaataagaaaaaggcaagatgatggtaatacactgaaaagggatctctaaaactgtgtgcatgggcagaaaaggtgatgtgtgtatgagtgtgtgcaaacactaggtgatataacttattaccaagaaggggtttttttaattttattttattattattatactttaagttttagggtacatgtgcacaatgtgcaggttagttacatatgtatacatgtgccatgctggtgtgctgcacccattaactcgtcatttagcattaggtatatctcctaatgctatcctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacatttttttaatccagtctatcattgttggacatttgggttggttccaagtctttgctattgtgaatagagccacaataaacatacgtgtgcatgtgtctttatagcagcatgatttatagtcctttgggtatatacccagtaatgggatggctgggtcaaatggtatttctagttctaggtccctgaggaatagccacactgacttccacagtggttgaactagtttacagtcccaccaacagtgtaaaagtgtacctatttgtccacatcctctccagcacctgttgtttactgactttttaatgattgccattctaactggtgtgggatggtatctcattgtggttttgatttgcatttctccgatggccagtgatggtgagcattttttcatgtgctttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgtttactctgatggtagtttctttaaagaatgcagtttgtatttttctatcagaatggaaccctggaggctaaagaagggaaaatcaagctcctgtctccttcttaggtattattaaagtgagattctctaatccaaggtaaaaaaaatttattcatttcaaataactacagatttaaaaattttccatcactaaaaatataaacattttatttaaaacattatttgaaatcaatcaagttatttatttgtaccaactggaattatctagatcaatgctactcacaacatggtacccaaaccagcaacatcagcatcatcaccagaggttgttgaaaaatgcagaatctcaggcccaactccacagctatggaatcacaatctgcattttaaaaagatccccaggtgattgatatgtaggtttaagtttgagaagtactagaacagataatacaataaaataaaatctcaatgtaagaagcatctcatctgtcttatttagtgagaccgttggaaagtgagatcaaaagaacactaaggaaatttgtagttggctataatttgggaactactttcaattctcagaaaaaagataactagcacaaaagaatctaaagaggttacaaagaagaaagaagaaatgaaatgaaacttgggtaaatgtaagatatgaatctgtgaaataataatatcaaataaggcatttaatagacacaatttagaaagcagtattatcaggagacctagggctgggatgaaagtgaagaacaaattatagtaaaatcaggctttcagtgtattaggataataaaaacaactaatgcaatttggggcttcctatccagagacaaatcatggaagagtcagataatagttcttttttaatgactcgagtgaaaattcagagagaatatttggacacaaaagcagaagagctctggtttcatacagaatccagggaacaacaggttataacatttgatagatgaaaagaactatgaatagtgtaaatgatgattccaaagtcagacttatgacaacacttggaaatatgaaatgtgaaaagcctttgattttaggaggcatgaaatttgaagtatagtagtgaaatcaaatagaaaaaatatgtcctgaatattaacacacattccacatatttaatagcagcaagcccaagtctgtctgctcaactattcaggccacatatacgttccctgcaaagaggaaataaccagttgtaactgactcctcaccccaccaccgggtcttgagaaaagttcagacagcctttatagctctaccttgcttcatttttgcaatgacacaagtaaaacacattaacttacttagggtgagtacacctatcatgtatgctacctagacacgtgtttttgtttttatttttaatttattttttatttcaataggttttgggaggacaggtggtgtttggttacaagaataagttctttagtggtgatttctgagatgttggtgtgtccatcacccaagcagtgtacacttaccaatgtgtacccaacgtgtagtcatttatccctcacccccctctcaccccttcccctaagcccacattatatcaatcttttttttttttttttgagatggagtctcactttgttgcccaggagggcagtggcgcaatctttgctgactgcaacatcaacccctcagtagctgggactacaggagtgcgctactatgcctggctaataacatggctaatggtttcgcctgttgaccaggctggtcttcaaccctggcctccagtaatgtacccacctcaacctcccaaagtgctgggattacagtcgtgagccactgtgcctggccccactgtatcattcttattcctttgcatcatcatagcttagcccccaattatcagtgagaacataagatgtttggttttccattcctgaattatttcacttagaataatagtcagttccatctggcttgctacaaatgccattatttcattcctttttatggctgagtagtattccatgatgtatatttaccacgttttctttatccactcattgattgatgggcatttgggctggctctgtatttttgcaattgcaaattctgctgctataaacatggttgtgcaagtatctttttcgtatgatgacttcttttcttctgggtagatacccattagtgggattgctggatcaaatggtagatctacttttagttctttaaggaatctacacactgttttccatagtcgttgtactagtttacattcctaccaacagtgcaaaagtgttcccttttcatcacatcacgatatccacgccaacatcttttttttttttttttgatcatggccattcttgcaggagtgaggtggttttgtgttatggttttgatttgcatttccctgataattaatgatgctgagcatttttccatatgcttgttggccatttgttttcagaattgtcttttcatgtccttagcccacttttggatgggattgtttatttttttcttgatgatttgtttcagttctttgtagcttctggacattagtccttcgttggatgtatagatcatgaagattttctcccattctgtgggttgtctgttaactctgctgattatttcttttgctatacaggaagtttttagtctaattaagtctcatctattatctttgtttttgttgcatttgcttttgggtgcttggtcatgaagtctttgcctaagccaatgtctagaaggttttttttaatgtcaccttctagaacttatatggcttcaggtcttagatttaagtctttgatccatcttgagttgatttttgtgtaaggtgagagatgaagatccagtttccttcttctacatgtggcttgccaattatcccagcaccatttgttgaataggatagacacgtttttaatactgtcctcgccatgttctcctggggctatagagccagacctaaagttgcacgtcatgccaggtcatcatattgctcatgaacaagatcatgtggaagggagtgtggatgcagctgttattctctttttccccatctgaacctaaatcctgttcctttggatagcaattcagctcattaggttctagactagtttcagtatagtagtaatggaaaaaagtatgatgttatcagctatactcatattaagctacagagaatactgcagttttgccttgaccaaagaatgcctctactagatgaaaatcagaacttaaagtacaagtaaataaataggtgattacaaaagactcttacattttagaaggcttctccatagagccccttttaaaaaaatgaactcctctagtgtttttaagtgttttacagaccattaactacatggcagaggggcaatgagaagggatttctaaatttaatgaactaggacacactcaaattgaggacagataaaaataagacaagttatatttaaaattctactttatcagtgggaaaacgcaaccatgaaaaccatctaaacataaacttgaaaagtattcagttctcaggtatgctatacctgagagagtgacaacttgatgaaaacattgatgatgataatattgtataaatatgataattatatatatcaatatattagtctacagaatatatacagcaatatctacatgtgtgccttgcatatatatgttatatacaatagatataagtactatatatggtatattttaaaaattattaaatatgggtatctgtgtatttttacgtgacattaatattataatttaatagatatatttatagatattaactatatctgcatgtatttgtgtatatattcaatgtgtttatgtaagtgtgtgtgtgtgtgtgtgtgtgtgtgtgtgtatgtgattcagccatcacctaacaaagtggaggcatcattcaaacttcgcacctttgcattttacacctagatttaatactgacattgactgcaaatctcactccacagaatacaaaataacccaattgtccattcattcccagctcttgaactcttaaatctcgtttagatatggtttaaaccaggaaataaattagccacatccgtagaaactttggctataattgcctagtgtatttttccactagtagtgtttgaaatgcttcctatgaagtaaatgctttacaaaggtagcagaaggagattcctgaaaatagtagtgtaaatggccttgactgcattttgataggaaacttcaagccatgttgattaatacattatccataaaattaaaccagcctagaaaaggttaatttttaaataactgtaatgttaatgtaatacttatttttgatgaggacaggctgaagagagcttaataaaatatactagacaaattcagataatatactacttcaaaactgttccatgaataactttccatttttaaattcttctatggaatagtagagtatgaccattagtatgtttttaatttaaaatgcattttggaacatattaacagtaaaattgaaagaacagggatttgaagatttggattctgtctgtattaatagctgattgcatagtaccagataatctttctttttctcttcttttctttcattttttaatttttttatttttttatttttttatttttgagacagactttcactcttgtagcccaggctggagtgcaatggcacaatctcggctcactgcaaattccgcctcccaggttcaatcgattgtcctgcctcagcctgccgagtagctgggattacaggcgcccaccaccatgcctggctaatttttgtatttttagtagagacggggatttcaccatgttgaccaggttggtctcgaactcctgacctcaggtgatctgcctgcctcggcctcccaaagtgctgggattacaggcatgagccactgcacccagccccactgcacccagccccagataatctttctgattcttgattttctcatctagagactggagataattcagtcttcccagttgacttcacagcactgttgtaaagaatcaaaagagctcatatatatgtacgattatatctgtataatctctatatatgttctcaaatacagtaaggtatatgtaaatatatgtaaagtattttaatgtttctacagttttaatgttttaaaaggaacacatttcatagaagaatgttacgagaaggtaatgatttctcattttgaacataagatagctggatttgatatcagtattaatttttattgggtattgacttagctttgcttatcttataacaagaggccataatccaagcatagtttattccattgactttattactttatcaaagctagtaattacacttctggtgtttccagaccaacaacaaaaacaattgaacataatgcaatgaatattgcaatgaaaaacatttgtcattataatgtactagaattccaggaagatgcaatatattctatttgtgtgtagtttcttataaacagccttagttctatttgaagctaaagaagaacaggatggttagtttcaatatgttaacagctccttctctttaagtaaaatagaaaatggaaaagagaaggacctagaaagaagcatgtctcactccatccagaagtcatgaaagcagatgatgcagtgatgtacctagctctgaggtcctcttttgtataagagaaataaatattcatatatacagtatatctgagaagagggcttcttcagaggagaacccagagagagcccagtgcccacaagaaaatgcctgggtgagcttattatagttctggttgcccaagcaaattatattttacctacgtgaaaataatagtaatagtgagaaaaatgttcttgaacatttgaatggtgctttcattcattcatttattcatccatccagcaaatgtttattaagcacctactgtgaagtaggcaatgtgctaaacattgtcatactgtagcgaagaagagagactggtccttgttctcttggagattacaagctaatcatggacagaaactattttagttttttttttttaagatacagtgtgtactaaacatttgcaggaggaaaaggcatgcttagaagaaaaatagagaatgtggagctactttaatttgggtatcagggaagcgttctgtgagaaagagatatttggaatgatatgtgaaggatgaggagccagggaacagcgttccactggtgagagtagcatttgtgaaggtgtgcaaaaacctgaaggacggcctttgtggcacaagttagagaaaaaaagaggaagtaacgccacatggtattagaaaggttgacaatggccacattatgtggaggctcgttgaccatgacaaagaatttggattttattaaatgtgcaaagggaaactgccaaatggttttacacagaaatggtgaaaatatacaaatacatcgtaatgttactatgtgaaaatatataggaaatgtgatgcaatgaagttacagacatcattatgaggtggttagcagaattggctttgtgggtatgcaatctgtgccatagcacaaagcttccctctcagaaggtcctgctcttggattaatgctctgacaactccatcttgaaattcataataatttttaaactgggaggcttggatttttacttttcattgggtccccaaattatgtagctaatactgtctactatagaaatcgagttgcaagatgatgttataaactaggataatgacactggagaaagacaaaagttatcagctggacgcggtgagtcaggcttgtaatcctagcactttgggaggctgagatgggcagatcacctgaggtcaggagtttgaggccagcctggccaacatggtgaaaccctgtctctactaaaaatacaaaaattagctgggcgtggcagtgcatgcctgtaatcccagctacttgggatgttgaggcaggagaatccacttgaacccaggaggcagagtttgcagtgagccaagatcatgccactgcactccagcgtgggtgacagagcgagactctgttacaaaaaaataaaaaaagttatctctatttcacaagtgaaacacagctataattctgtatcagattgccagtaatatgggctttcaatttggtccaagtagagcattttaattgtttactcaatcctaacttatgataatcaacacatattacatccatttagtaaatactagttttcaaaagattgctaatttttgtcatcttctgttagtgcatctgcatgttatgtatgtacaatagagattaattccaaagggcgtgaaacatttacctttacctttccatttcattaatatctatcaagcccaaagcgtacaaaagactctgttgtaaacttagagtgatgcaggtattttctattaagagcttataactgagttgaaagttaagatctaaatagctataatacaagaaaggatatacttgtaaaggagatacaaacaatgaactgtaagatttttcgtttctttagaagaatcattagaagttttatcaagtgtttctgcttatttaatcacaggagttcaaagatgtttgtcgtgacaccagaatgtgggatgacattattatgacatttcattttaattaaaactagatattgccagggattccatagtaggtatctcccaatatgtagtaatccataagattgtcatggtatgtatgaaaatcccatttagaagataaatattattgaggtctttaaagaaaaaaacttcaaaatgcctctccttatttcctgcagaatgaaatagatctataattaaaataattcttagtattcatcatcagagttgaaaaataaaatcagacttttgattcctagatggaaatctattaagagataaatgaaaatattgtggttgctgcacaagacatctgtcttcagtttaagctgcacaaactgcaagcaaatgtggatgttttctctatagtatggaactttcatcagggaaaagcctagtttgatgatgaaatttcaaagcagatatcccaaaagaacacacacaccccccccacacacacacacacaccctacacatacaccaaacagaagaacacatgggcaatggagggatataccagtgccccagagacagagacctctggcactaaagagctgttcttgtcatgcatgacagcttaaggctccagacatttcatcccaggacatttgttacagttgcaggcttccataattcaggctgtgggcagagtttctagcttatatctcccgagacctactcagggatctggtttgccttgcacttatctcccttctcaaacctgtgcctctacaataaagtagtcatgtatctatccaaagtgcacacactttgtaacttagggtaaaagaaaatgcttaccaacttaggctataccaagttgtataaaccaatattgcactcaccctcttgattctacccattctcaaagtacagtaaaagagagctattactcgctccacaatcactgagcctgacatgatgcacagaagagtttaacatgaaaataagatggactgatgggctaaggacgtagaggacattgagaagattttatacaacttgagaaatatgtgtaagtcttacagttgggatatttaggaaaaggaaggagcattttggatagtcttatctttatctcaaatatcaatatcctggtttaggcttttaggaccactcttctgcgctataactgtagactttcttctcccagcttctccttctccagaccctttacatatcactgccagtttattttttccaaagcttattttctgattcagagcattcagtgatacttcttgaccaacaaatgtaagggattctttcatctggcattcaaggctgtttgtgatctccctgcaacctattttgccagttttttgtttgtttgttcgtttgtttgtttgtttgttttttgagacagagtctcactctgtcaccaggctggagtcagtggcgcgatctcagctcactgcaatctctgcctcctgagttcaggcgattcttctcctgcctcagcctcctgagtagctgggactacgagcatgcccccatgcccagctaatttttgtagtttcagaagagacagcgtttcaccatgttggccaggatggtctccatctcttgacctcatggtccactggcctcggcctcccaaagtgctgggattacaggcgtgagccactgcacctggcctattttgtcagtcttacttttgttacttccttccatgtaaattatctttcagtaaagtggttttcaaacatgctctcctccttcctataacagcctcaatacattggctcatggcatgcagttcttctgactctttattttccttgccattgaaattctactaattctcacctaccccaggaagctttgtttatttttcccactggatatatttatctcctctaaactaagaaagcatctattttatacatatattcatatttaccatccaaatccacatttatttgagtaattgtacttggttttacccatctttctactgcagccccaattataaataccatatggaccatacttttatatgtctctgtctcacatcatgcctcctgatcacacacacaaaaaaggttccgtaaggtttaaaaaatggctagaaaagaatggaagagtattctccgtattcttagatttaacaatcattttatttccatccagaccttatggaaagtccattggctgaaaacagaacagacaaacaaacaaacaaataaccctgaatgtttcatagagactgcccagaataacaggatgtattgtatggcctttggacatggtgtgcttcctttacatttgccaattcaagagcttatggttgggatgatcatataggccagtttgtctctgacagtcttgctttttgtgcctgtaattatcgataatatcttcccttcactctcaaaagagttctggtttagatgagaaagtatatggtcactctccctaaggaccatttttatgggcaagtgaaaatactctctctacttgtcaacattgtattagttttcttatacaaactattaatattatagaactgggatagattagcatctcacccatttcttcccaaagctttaggttcatctaaaaagcaaataaatcaacagacagacaaaaaagcaaaaataaacaaacagaaaaacaaacaacaaaacaagtcccaaaggctaagccatttgaagtagaaaaggataaaacataaggcttaggatcattgggagagatatttttttctcctcctttttcccttttctctcccaggaattcttcagtagactcaattgaagccttgagtttgaggttttgtattctcagatggtaagcacacctattaaaaaagcaatgtattcatgttaactccctggcaccagcagggcctgtgtattcactgctagcagtggacaccatgccaggagaacctgactcctggtgcaaaaggattaggaaaaaaaaaaaagtcaaacaatgccaaaaaaaaaaaaaaaaacccacacaattcttttctgtactctgtggtttgttttacttaggaaaacggcctggttataccctgcagcacgcattcattacagtgatctttgactggcagatgcagagtaataggatgcatattttagtgcttattataataccctgtccaaaaacaacttgacaaatttgtgatttcgacaatatctcattttgctggctgcagtgctctgtgattgtctggcccacgtggcttccagattatgcataccaccaatacttctcattaaaatggccacagttcaccagtttcggtagcttggaacgaacttggaatgaattattatacaacaaagaggctgctgtcatgcagaacaaaagacaagcaaaagagagctttggcttaatgaggctaagtgagtgtctcccctgcatcacagctacttgacggcctttgagcatggattttttttctccacaggccaaaacctttggtctattattttgtgtttatgcaccttgaggctaatatacattttaatatgctgcacatggagaaaaaaaatcaaccattagattagaacatgtgcactccctgttaaattaatgacaaccgaacatagagataaatttaggttttcatatttaattatagcacactgcagtacgtttagcaaggataaattgcactattattatgcttcattttttttgacatcttctcctattagtagtgcacacttgccccagcaccaccaccaccatcaccctgtggccatgctaacatctctgcatatcttccttttctccacatcacacaatctcagccaccacgttgaaaggtatactgttttatttgcaagatttagtgagagaactgatgccattttggcagttctgtgtgcataagaaagtgatttgtaagaaaaaaataaatcagctaagaataattgttatcactcttccttgctgcatcagattatagtgatgggatcaagttcactgcttttctgatcaaccaaaagcacaaagcacagcatgtgactctgaatagttggtgtttcattatgactcagatgacctgtgtataaagaaggagtcataacaatcccaagaaaaattccaacaaccctgtcactttttgaagcttttctctgttgattttaatctatttattgtagaaatgggaacacttcaagtagtgaaagttacagggtaataaagatggtctttggggaaaaaatttagcaaagttgatagtagagattatgaatattgctgttcattctttccagaccaccaaagcaggaacagattgttaatataactgaaatgtcaaaatgaacttttcgtgtagaatgaccagagaacttgtagttctttccatttggggactgtaattttaccttccattaattgagtatatttgtttcatgttacatctgagcttatagtttagcttgcttcatacaccaattaatagagttccagatggttgcccagaatgtaagagattcttcttctatctttgcgtaaagctgaaagaaaggcatttgcctatgtctctgcattaaggaagcgtacccatttgttgtctttttgctttaaaaagtcacttgaatcagcaaatgtcttaaaatcagagaatactttttcaggatctgagcattgaaatccagttctggggttttcctgagacttatcctttatttgatatttgtttcatggtgatgcatagcagggtttgatgaccagagaatcatggcaagaataataatttccttgttcggaaggtctgtaactggggataaagagtcagaagagtcagttaccattggctggtgaacaactcttcttgatgacacataaaagcagccgttacaaatgtattaagaataattctctttgcccaaattctggtcaaatgaaatttgaaagatgagatataagaaatggccttacgaagatgggctgtaaaatccattttcaaaatgcttttttgtttaaagttgactcacctcagacactaaaagtgtgaggtaataaatagctaagtagcctggcaatatggcaatttcttgtgactcagagctattttttatagtgtttgccaaacttaaattctaagaaactcctgtgtgaaaagaggtgaggattatatttactattttatagaggttgacactgagtctgtaggtagaagggtctatctaattggtacagtcactgggtaatactaaatttccttactcaggaatctagattcacttatcttggaggctctttccacctgtggacaagtggtttcgatatctcaatcagcattagatagtggttatcaagtcatttttgtgggttaattcacttagaagttcaaataatttgctctgagtggtcagatgttctcagtcctaaatactcttgccattgaacatttcagtgtgcctaaagcagatgtcaagatgccctacaggattccaatatagccattctagcaagaaggaattccaaaacacaccttgttccaaacatccctggtagaatgaaagtgacttattttcaaaataatcataataatattaaaaatagtatattatggcccttagaaatgctcatgttattaagttaaaaaaacaagaaaccttgctatatctaaatataattcctgtttttgttatttaaaaaaagcatgcatttgtggacaggaaaaaaaagctatgataatacccatatattaccagacatttctgaaagcagaaattcttggtaatttttctttctttttcttttctatatttcctcagttttctttaaggaacatgtattttatactgagaaaaactaaaaatgaaagcaatagcttttgaaagttttctataagtctctaaagaattattgatcaaatatttcatcaaaatatttcatcaaatttcatcagaaaatcttagaagaaccaaatttaaaagaatcaagactattcaagtgccaagcaggaaagtcaggaagggcataaagagctggcattatttagcttacagaataaattaaattagtttagccaacaaagaatggctgaggaggaattgctatttttctgtaaaaaaaaataacagattattatgtaaagttttataaagagagtaacagtgttttaagtctactactgatgaaggaaagtgaaacaagtatgaagaatgaaatctgacggagatatgctttccaaagaatgagctgtttgaaagagactgacaacatctctggaatcttttgtttcttttttcttgtttttcttttcatttctcttctttggtccttgagaaaaagagagattcgcatgtatttataattctatatgtgtagtagaaccatatgaaggaaactagtttctttttcttttctaatgttacatgaagttttctataaaatatatttgtcagaattttcaagttggcttttcacatttaaaagcagaaatgcttgccaaagtctaactgaagatagatttacttatccctaatgtacaatatgattatttgcaccataaaaggcccaatactctttgagtgcaagttgacttgaagaactatctagattgattctgttaatttattttaatttttactagggtttacatttctattctctctgcattctatggggataaagctcaaagtataaaccttgagtgcttccaaatctaattagtacatcctactccaaacagcctaacaaagagtcaatcaaaggagttctttgacctgctacttgatttgagagttcctaagcagttttcgtgtgtggttctagaatacccagaatgctgattttggtaggaggctgtggatatgtactgcggctacttggcaaaggagtcagtaactcctcccctgaccccggagggttctgtaatgcctcaaatggaatccagttaacacgacacagaggcctctgggcatctattgccatccattcattcagctaagatgactgaaattcctaccatgtgtcagccactgttctagacacttgggatttatccatttaaaaaaggaacctacccttgtagaacttatatttaagtaaaagagataaaaatgaacaaacagtaaagataataaatgatagtatattcggtgataagggctatgtaaacaggaagggtggagaaggcaagggagctcaaaagtatggaagtcaggagacaggttgcattttaaaggttagacagcagtgagtatggaccttttagagaaagtctcatatgagcaaaatgtgaaggaaatgagaaataagcctcgtggatgtctgtgagaagagatttccaggcagaaggaatagcgagtaaaaaagccttaaggatcagccaagagtagggtgtctggagtagagtagatagggggagtaataagagacaaagtcagggaggtaagtaaggtagagtagaggaatagtggccatgctcatgctctaacttagttcccttctaattcaagaacctgttagtcaccttctatgcacctcgtgcctcgcttggtcttcccagcttcccagttcggtctggcatacacttattaagcttccattatatgccagggactgtgttagaaaatgcaagcacaatcctacatgaagcgagatcactatacatcttcagtacttcccattccattttggatcactatgacaaggtttgcagatgtgatatgtactcagaagtgaactttccctacctcctcatgtttacagatctattagacgtatgatccactcagctcacacttacatttggcttcatgtcatcacacaaaaattaattacttgattattgggaaaaaacagtattatagtgtaccaaatgagctgcactttcaaaacaagccagaaacatctttattctcttaaaacccactaagctcctcttcttggctatggataaaatcccagagtttttctgatcacttccagacattagaacaccctcagataataaagagtccagccaggaaacttgtggctctcctcttatttaaacaatctctgctttaacctgcactaggccctatagcatcagtagagaaaaggccggatgcttaggtcgtctgtgattatcttctgcctccctctcccatccttcttctccacttctccatgtcacctgtgattcctccattgtgctgggaaaggatgaagcatatgaggctaaaagatgattgtgtagtgctcttatggcatggttgtgatattgatgcaatcagggcaggtgccaactctttttcttaaaggatacctctgtgggatcttcagagcctcccattctgtctccctggtgataccttctgctctgcccattatgatttcctatgcttcggcatttcacccctgaagtctctttctactgggattacctctccttggcagggctttcaatgtagttatattgcagcagctttccagagtgtccccaaaaaaaactcctgtctctgtcatcataagcaaacacctctactggccctactatcagggaaccctcacaaccaacctctgacatacaggcctttctcagcagtagtcagacaccagcctccttactttaaccctccacagctacccacccaagcacccaggggcatgtccatgttcaggttgctaagactggtatcactacagtcagcaagtgtcccataaaggcagattttttccaagtagcaaataggtagcccagagtaaaaaaaaaaaaaaatgtcagttgcctctttgggcaagtaccccactcttgattgtatttagagtgtcttctgtcacttggcttgaggtagcggaaacagaacattctacaggagagagcagagaaaattacagcactttttctgggctatcaatacataatcttttctccagtgtcttctctgcctctccttagagctatgggtgacagggaaagatcccagacctacagagtaaatttgaatcacatctcaccaagtcctgcctgatccacctttagaaagaaggagatttgccaacattcctttcatagttggggcctcatctaagactgagaaacatcttatgacatcctattacaataatgctgcctttgcctttaatctgttgttcgtaaacataaaaaatcttttcagtctagaaatatctggtagtgtggtaatgacgtttaaaaccaaggatgtaatgatacttcagttggttaaactcaagttttgtaaagacaggtccaagattttttaaatccatgaatagaacccagtcttggggtttaatactgtttcattttcttttgcatatctaaacttatgagtgttattaggtttttcataatgttttgatttttctttaaaagattcatcttgtgaagccattttcagaatacataaatttttttttatttttataacttgtttctcagaagaacaaaaaacactttgcagttttctaaaaatcccactggcgtgatccaattataattagagaaatccagctacagcatcagaaatgagatggaaggaatctgaggcaccatgactgacttgttcatcaccgatgaaccgaatctggcatcgatcagaataggatcaacagaattgtagaattcttaatttggagctattataggaaattaatttacattttggataagatttactaatccaaaaacttaaaaaagaaatatccaattctggcagacttctttttcgaaaggaccaaactcaatgacaaaattttagaattcctgaaaagagttaactggaattaccttggtgttttatttgataggtaatatttactacccacaagcctttgttatgagggtggaatacatctacccaagtcagtcatgtgactggaatcagtgaaagctcgtcactggtgctgcacagtaactcataagcagacagaaagccagaggagagctcttccttctccaaatccctggaaaatgcattgccttaattagcaaacactatcttgagtgactcctctagagactcccaattaactaagcttctagactaacatgaattcttctctcttattagttcatatttatgttttttaaatcaacaaaatttcccaacactttgtcaccctagaacccaacctttatgaacattttttgcgagaaaaatgcaaaagaatgaaactaatgcagtttattaagcaaataatcttaaaagcagcccacaacacaactgctcaccagctcgcaagctcaccggattatatttcctgctgttttcagttacttctatttatacttctaaccggatgaactcaccatgccccctactgcttaagagcaatactaccacagtgtagcacaacacagcacatcctagtattctccagagatttccttctggccatatggtagctttcagaatgcttgttgaacaacattgtttgtctccccttggtcaccaatgccaggataaatctgtggagtcatgctggcagaagaaatggcctccaatcagcaacaacaaacaagttctttattactgaccccaccatctgtccctgtttccacatgccattctcatatagaaacaggtttccgccaggccaggttcagtgtgcatccagcatctaccattaggtcagcttgaatatccagattacaactgtgcttatcctcttacctagctaacatcctttatccagaatggaaagtggttggtggacactgaaaaaagcctgtgaaagccgtactgctgataagagatatgtttgctaacgtcttggattagggatgtgtacttagtggagatatcagcctcggtgtgacaaaagcaagatgtaagtattacttcctttatgttaaggtgtgcacccaccaagaccactctgcttataaacagtgaatatggaaggagtgttccctggtactttaattatcagcccatttttacaattgtgtagccagagatgttcccaagatgaagttgtttcctaaaggctcatttcagagaggtagatcatcctacatgctttgccattgtagtttcaatataaatactttaggcctgcttgcagcgcatcttgagtgctcaaaatatcacatttagtgacaaggataaaaaagacagtgctctcaaaccagcaatattaaagtaagtgtgccaagagcacattatgaaaaaactgatggagatacagagccgacagaatgtctgcagagaagcgcaatgagagaaattgtctttccctgttaataccattatgagaaagctcatggaaagttattttattaagtgtttgtgttattaaaacctattcccctgtctgaaatttaatgctacacaatgtactaaatagtcaggtttcaagagagatgataaacctggaagaattacattactacccaaagtattggtcattgtacagggatttaaaatttaacaaccacattaaacaccaagccaaatcaatagtaatattttcagtctctccgaggcagatgactgaatatgctgaaagcattgtggggttgtgtggcactgtgttagctggtccatgcatcattgaggcccgtgtctggtgtaatcagctctgggaagacactgtattcttagcattcccggaaggcctgctgttccacagcaacaaaagacacaagcacggcacagtaccacagcaccagccgatgaacaataaacctggttcagattgaactatttacttggcatttgctatatccttaggctccactggaaaaattaataggtggtcagctttagcaaatatcacagtgatggaataaggagatttgttagccaacaatttctgatttgtgtcacttgtaaatatgatggttttagttgtccattttaacgattctttctagtcgacaaatacctagctgactactctttaccagtgtcaaggatggcattgaaaaaaacaaaaaagatctagctgattttggctcagaagttctttcttcttgtcataaatttgcgttcttgccttctttaaaggtgtcatttaatggcagcaccttatttttactgacagtgtttttggggaagttcagactattcgttcgtgattcatccaaatacgtgattctcccttggattccagcacaatttgtgaccttctaatactgaagcactaaatatcattcctgctttgatggcaggaagtttccagggaaaaacctaggtgggtaggaattgagaattccatgagagagatactaagataccccagtctggcatgggaaaaaaaatctcattacgtgtccaaaaggaaaaacacacacatgtgtatacatgactggattcgcgaggcagtccacacagtgtaggagagtgccactgaatcccagtgctaaacatgagacatgcctctcattttctcgtctttaaaacaggaataataacagtactgacctcatagggtgattgcgaagactatatggaaaaaagaaacatgtttagcacaaagcatagcacaatgagtgctcaggattttatttgtgtaatgattcctagcatttttaaagcttagagttttatgaatggagactctgatttaggatcatgctggatttccaacctttaaaattatgcaagtcattcttgtgtggaagcagaaagtgaataaatggattggcatcaaacaacatcagactggcaacagggaggcctaaatttcagtcttaacgttatattgactcagctcgctacttctgggaatgatagtaactcctcgggccttggtttcctcatttgaactgagggaactggactctatcaaagtcctttctgatttaaagaacggtgatcctggctgtgttcttccttgcatgcagaaaatggccatagtccattgtagaggaattttgaaaaataacagaaacactctctcagcctagtatttccactattagtccatcattttttaacaaggtccatcattaaaaatcctgtctagacatctgcttttaaaagacagctatcaatcaatcaatttagctattgagtacccatgtggggtgagtatagaggatagaaaacaagaaatcctgttctaccataaaaccttgaaatctacttggaaagaaaaaagacactattttttaaaaattaatatttagtaagggtcaaatgaggaacacaggcaacaactattccactcatgttcctacatgtcttttaaagtagtttaccaatttaaaacattaaaggtaataaaatttttaaaatttaagacacagcagaaattatttagaaagcaagaagtgcttgtatgggaaacaaaagataagctatattattaaaacaggacatcatgttttgctgtaaacttattggtagccaagaaactaaagaaattcatgagttttatagctctcatggtctgataaaaggggatgtctaggtttgtcttaagagacaacactttgctcctggcagtaaatattgggaaaattttgttacatggatccatatttaatgaacacttaataatttactgtacaatgcctatagccggggttttgtgaaaaatacaaaagtgtctttcaaatacctataccatatcaatttttagtgaaagctaaggattagctaaatcaactcaaaagaagtatgctcgagtgaacctaagctaataaaatctaagaacgttgcttcttggtgaccaaacttaatgcttagggaaactcagaaaaatggtggattaagctgtcttttaggctgattttttaaaatatcaattatctccaaaacactttttaaataaaaaaaatatatatatataagaccccacctggaaagagtaacccactaggtactgttcacctttgcgtaaattattttatcagatctttttctatttaaactcccaacactgaggtactttcaaatccataccttggtttcactgagaggaggttaagtgtcaaaggcaacgttaacttacttcatcattatgccgagggctactaataagaagcaacatctcacgtggccctgcagagctgcgctgaacctttaaaagtatgtagtaaaaattctctgctaactgggccaccaccaacttcagaaagtcgtgtcaaaatagaacattcaaatagtgaaaatctactgatattttaagatttaaccaaatggtcaccctctttaaggaagcctttgttgacacgtttcctcctcttcctccccaaacttggtaaaatggcataaatgttaattcaattcatttaattcttatcacaactgcaagaaatcatgactattattaccatcctgtcacgtatgaggaaagtagcatacaaaggtggtatataatttgccaaactatccagcctgtcggtagcagaccagagagctagactcaggcaatctgtttcagaactcatgctcatacatacgatgtgagaataccaaattctggcttattttaatctgatcatttttcagaggaaagcaaatatttatactcaggtttaatagggttattttcgctatggaaatacattaataactcaatttaaatgttgaaagtgatgttcttcccattttttgaaaacttatggtcagcctagagccagctatataaaaccctagcttggccataagtctttacctaaaagataaagacattattatcagcttattattgctgctcacacttacaccttaacagtctctacctaatataattagaatatatatatatatatatatatatatatatatatatatatatatatatatatatttttttttttttttttgaaacagagtctggctctgtgacccaggctggagtacagtggcgtgatctcagctcactgcaacctccacctcccgggtttcagcgattcccccacctcagcctcctgagtagctgggactacaggcgcatgccgtaacacctggctaattttttgtatttttagtagagacgggatttcaccatgttggccaggctggtctcgaactcctgacttcaagtgatctgcccacctcagcttcccaaagtgctgagattacaggtgtgaaccaccgcaccaggcctacaatataattttaaataaaaaatgtaacctaataggtcaatgtgtatcatagaagttttcatacaacaatgggaaaggattttttaaattgcagtgtgctctgtgatatggtatagcaattacagaagaaaaagatcaaaagtgtctcataccatataccaaaacaaatttcaaaggattagatagttagatataaaaacaaaccaaagtacatgtagaagaaaataaaactgaatatttaccaagcttctataggtaatcaatttttaaaagcaacaaaaaggaaaaagacactaacaagcagattcccctgcataagttagagaaaaaagttattttttcaaataaaaaaagtagaataaaataaagctatgataccattgtatgttatcactatcagaaagcaattaaaaaaggagaagaccaaaaatatatttatctgctttaataaattgtaaaatttatgtatgtaatatataacccaaatccaaaaaggctagcaacagatttcgggaaaaatataataagtgtggcagaattaatgcttttattttataaaaggctaagctaaatttttttaaaaaatatcttagtactctatagtcagtttacaaaacaagaaatacatctaaaaaagaacctagaaaatgttcaagctaactagttttttaaaaaattgaaaggaaaactaaggccttactttttcatcacataccaacggagcaaaaaaaataatattcatgttatattaagaaatatcaagtattggtttgaaactgttgatgtcataaatattgatgactttagaaataggttcagctctttggaaaagaaattctttaaagtatttgaattaactctaagtaaataatccaaaatatattttaatgtgcatatagaagttctcttcatcattgcttactaatgaaatagtagtcattataaaaacttgggagcaatatagaaaataattgattaaattacagtaaatttattggatcaggtgttttaatgataaaatgcaaaatgatcaaacatatgcaagtcatttttcatcttgatgatttgcacatgaaaaagatggaagaaggacctataagaatgatagaatttatgatagaatttttagagtgctaaatttatgtagtagttgttgtttacatttctccatttgtcaaatgttctatagttattattgttatatttgaaaaatataaagacaaaatgtttatgcacaattcctattttatattagaaatatggagctgtgaagatttcctccatctgattcatttcctaacccaatacactgtaccgtagctatgttaatgaatgtggggtagaatagattagtgataagatacaacattgtatttatctgtagaggcatttgtatatcacttgaggaaaaaattcttagtatataaaattttattattagtaacagttcttacactgaagtattaacgccaggaacgatgttcctgttggtgaaagctttagcgatgatttgactgactgacctaaagaatgctgagatgtaggaaagtctgatgaggatcataaaggaattacattgtgtatgtgtgtttttaaaaatatgtttgtggtttgtttttgctttttcaaaatcaacattttcctaggcttctttctgcatattcttcaaatttttagttgtgtttacttttaatagctcagtaattgggactgccacagaaaccttttcagacatattttaaattgtaggcaccctggcaaccatttgtcttcatttcaaaatcatttaagtaaaggaaaataagtgacaaaaaagtttttgttatgtgaaaaatacaaaaaaaggtaaccctagaaactaaaattattccattttgaatgatctttttttcttcattgctggttttgttcatggattttcttcctgttaggacctggatgccttggcgtattgcactcttcattcttcggagtctctactttgaactcctcagtaggagcaccttgatttcacctctgtattgagtcatatgtgatcaggtcatgaagactgacgtttgtgctcaggtttcttcagatcctataaacattcacacacacacacaaatagttatctcttcagcttccactgctcttgaccttctcagtgtatttcagttgtcttgctctgacatatagcagggaccagcaatgcatgctctttgatcttcttcttgtgcacatcccatagcactaacctttctcaggtggaggtaagagagatattaatggcctttttgtgactgctatctagcaaagttagctgatatagtggtgcctgggtattattacatgcatgaaaagtaccattctctttcagatattctgtatgaggattatagcagggaaaaataccacacattacctcactttttacctcaagttagggaatataactcactaagaatagatgaaagccaataaggatgagtaccatattgttgtgctcaactttgaccaaaagccaatttaggttatttcaaatgactagttacctctgacctgtagcgttccttttttttttctttttgatatattttagtgctttgaaattttgggaatccaatcaggaaattcttgagcatcttctatgtgtaaagtgctgcctttacaggaaatagaacttactagcatattcatttattcccaaacactgttcatacttaaaacttgtcataatgattttcagtaattaagtaataactgggcatgcagaagttagatagatagatagatagatagagagagagaaagagggagggagggagtgagggagggagggaggaaagaaggaaggaaggaaggaaggaaggaaggaaggaaggaaggaaggaaggagaaagaagaaagaaaggaagaaagaaagaaagagggagagagggaaggagggaaggaaaggaaggaaggaaggaaggaaggaagggagaaagaagaaagaaaggaagaaagaaagaaagagagagggagagagggaaggagggaaggaaaggaaggaaggaaggaaaaaagaaaaggatagaggagaggaaaggaaaggaaaagatcagatggtaggaattagagtgaaaaagataaaatggagatggaatagagttagtatctatgtgtatgtaagtcataagctaaatattatcagtagtagggatgatatccctaataaagggagtttaaaaataatactctgagcagcctagtaactaatgcaaaaagtggagcaatcacatatagatcacatgcagaccacaggacctacaggtataaaccaatagaagaggtaaagagcatctccttctggtaggattccctcaagaaatgtctgatgtgtccatacaaagaagatactttgttctagaaccacatctctgatacaaatgcaacaacaggttccataatgtagcattttatactttcttttctcactcgtaaccatggaaagaattttgcaaaggactctccagctaaccagatctctaaagatctagcttaaatttagaacacctagaaataaaatttagagaattcagaaaagtggatccttcaaagtattctccttaaatattttattttcacatctatgtttgctcaagactcggtggtggacaacatgagagtagcagtgaaattttcctgtattgctatttaaaggcagtgagtgcctttttattttaccttctaatagaatatcaacaggaaaggctggacatttagaaatgtcagggtatggaccaggagaatcctcgtgagcaaaaccaacattctgtgtaaagataatcctgagtctatttaaaacacactgtgaaatgggtaacggagatgttgaagatgacatgaagatgcagtttacagtcactgggtgcaaacaggagttaaaactgcaaagtataataaaaagcagaataaaaatgctacaataggatgcaatgacagtagactttctaaaagaaataaccatcttgtggtggcatgttagagggtaatttgagtgaggaagcctagcattaaaagagactgactaagaaactattggaataggccatgtgagatcagttcaagggcctgaaacctgcggaagagccacggaaatgaaggggaagagtgagtgagagagatgggagaggaaaatgactgtgcttggtgaccaactaggggcaacagcaaagaagtcagaggtcacacgaagctttctagtctctgcagctgtgttactatatatcaatgatcgtgacaaggaagaccaagatggaatatatgaggcaactgaaaatttgaatctagcactcagcaaatgaccattttaagaatacagcaggaccgggtgtggtggctcacacctgtaatcccagcactttgggaggccaaggcaggaggatcacctgaggttaggagttcgagaccagcctggccaacatggtgaaaccctgtctatactaaaaaatacaaaaaattagctgggtgtggtggcacgtgcctgtagtcccagctacttgcaaggctgaggcaggagaatctcttgaactgggaggtggaggttgcagtgatccaaaatcatgccattgcactccatcctgggtgacagagcaagactccataaaaaaaaaaaaaaaagaatacagcaggaccttttagaatgagtatttgcatgtttccaagaataactacagataagctctgtaaggaacaatgttgcaagctccggcttggacaaagtttgggtgggcttcagtgggagaggacagaaaaatggtattttttgtcactcctccatccacactctacttttctctccttccctccatctcagttgatactatcctacaacatacagtattcaaatattgtttcaggaaatatttactttaatctttaggagagaaaaaagcaaaaaacaaaaataccctaatagcatcaaagttagcatagcacaattccagacttctgctcattgttgaaatagaagggcttctgttcagtctgcaagagtcttgatatactgcagtgttcctgctacacaggcaggcagcaatccctccccgagtcccgtaagagcattttacattttcttcccatctttcagctcataaacatgtttctcttcagaacacacaccatatgccattggaaaagggctgtaaagttttatagatatatttgaaagtattataagggtatactaaagcaaaactaatgcaaaggaattggaattattgaacaatggaattaaaatattaggcacggataactctaaccacactcagcttgtttgtttgtataagtcataaaaacccggaactcttgtttagttcaaagacatgaagcctttgagtcaggcttaaaaaaaaatcagcaatggctatactttattgaaagcatatatgccaggcatcagtaaatgagaactcaagaatatgtatgtttctgtaatagcctaaataatatatatgatgctctacatattttggggtgagaaaacttattgcattgcatcttgtttgcaattccttgggatttttctgcaggcatcctttttctgaagggattaatgcattcatttaatcagaattatttagtgcctgtttcagtgagagtgttcaaggatacagaatagaaatactaatacttgatactgaggaacctgcactccagcatgaaccaacacttattcattcacacatttattaagcactcaacaaatttattgagtgccgactgctatgtacttggtctgtgcaagattagcaatacatacatggtttgttattgcagtacatggaaccgtgtgtggaagataatggcctctgtttaatatactcttcccataatccaagaagatgctcagtggagtttagccatgagttggtgtttcaaaaaagaaacaatacaggagctgtaagacaaggaaatggctccagaaatggaaatgttgatgtcaaaggtctcaaaataactaaaaaaatatataatctgtagcaagtaaattagtactggaaagatgccagtaggggactactgcagaaactaattgttgggattttgagcctgatgtaagtaatagagcttaatgaggatgggggaaaatgagttgatgaatacctttctagcaaccttcaagttggaatttctagaattatttagaatgtcataaaataataggaaaaggaggtggaatgggatacgaggggtttctgtagcttcatagaaaaaggagttaggtacagaaatgctgcgtaggaagatgaagcaagagtcagccaatgagagatgtacaactctgcacagaagcttttactagtctcctttgcctacaaaaatgtaacttccaagaccctcccctacctggaccaacccaggctcccttttcaacataccatcagcattgctacccttcttcataaacactgaggtccagtcaggctttgatctgtagtttccatgttctgttttcctctttgtcacaaacatcatctcacggcttggaatgtcttttctctttatgctgtaatgtccagactttgcatatgctgtcaggccttgttcgtgtccaagaaggcctgccttatcctccaattgaatgtgtcacttcccttgtatgaagcttgccatttgctacgtttatacttgtcttcccttttcaattagactgtaagccctttgtgagcaacatccaagtactatttatctttgggttccttagaaaaccttgtaaagtactttgtacataaacacaactcaaaaatatttgttgaatgaataaaggactgcccaggcagagcaaggtacaaaagtcctaaagaaaatataaaatttgagaaaatttcaagatgctgttcccagggaattttaagaaaaactgaaatgtggaaatcatgtgcaaaagacacgctaaagagaaaatgaagttttagctaccattcacctgttcatttactcaacgaatgtatttgaacagttgtctgtgacagacagcatgctattaatattacaagattctgtcctaggcctgagggaaagtcaggtactcagtatagtgtagtaaatactaagaatgagttaatctcagatgtgatagaagtgagtgtcatcagggagtgcttcctggagaaggccatatcaaggtgggacctaggacatagtaaggattcacctattagattatgttggaggaagggtatatgagacccagcatgcacgtgcatagactgaggggcatgatatgtaatggaacattaggggcctgcaaggaatttgatttggtacaagcttgagtgtgaacaagtggagaaaggggccagggaggcaaatccaagcaagtgcttgctttgttaagatccagagctttcaataaaacatgtatataaaaatgccttataatctataggtaattaaaaaacaagtaggatgggaacaagtgtcagatacatctagaagttctacttgagcaaatttatcaaatactcatgtgtggaggttggattcaccactgaataccacatccataagaatgagggccaaaagagcagttctggaaagagcctcacacgcacagcaaatctcacttgtttttaaaaattgggaatttctgacaagtcagacaagagcatggctgaagtttatcattgtactattaatctcaaaagttttacttttgaaattactttttgtacttagccagtaatgatctcaaaagaaaggaatgatataaattatttctaaactaaaccgaattaaccattttaaactatcttaaaagtacctattcatataaaaataattttttgcttagtagtttagactgctatgtcaaaatattataaatcaggcttataaaccacagaaatttattccaaaatataggtgctagcaggtttggtgtctggtgagggcctattatctggttcctaaacagccatcttttcactataacttcacatggtagaaagaggaaggggtctttctaagatcttttttatgaaggcattaatttcagtttttaggacttcaccctcatgacctaatcacttcccaaagtccctacctcctactaccatcactttggaggttggggtttcaatatatgaattgggggaggacacagtcagaccatagcaattgcttctctggcttattctggcctgttgagtaaactgagtctcattctccaggcctttgcaagtattcagcatagttacaataattataagtactagaaagtcataaaactggaatttcttttttatacctttttactcaaatctacttaattttctataacaaatgagatgttggatatgagtgagaaaaaatgcatcagaacatctatggtgtaatactttttctgtttttttgttgagaaaaacgatctcatgtgatcaagatagtcttttgaaaacaagattcatccacataaataggagacatgttatacatgttgagtctccattcacaagcaaacagtcttatcttagtcaaaaatgggggattattttaaaatatttcttcttttctgaaaatccagttgccactgcaaggtcctgaaaccactgataacttcccaaaagaagtggcttatttcttccccacttgttagtttatctaaaaagaatcctttaagccttttaaaaaggtttcaaaattaaattaacattctaaaaaaagagttttgaagttgcagttttactgtattaattcagtccctccagatgctattcagggtgaacctagagtttttctttcatacccactaggaaaagtacgtactctctaacttcccatgttagagcccacaggtttttagagaatatttatgaacctcttggttagcagataaaaagaagtaagtgactttcttaaattcataaagcaaaggtaatccagaaaatcactatgaggagatcagataaactattcactgtgtggatgcacaaatatttggggtgggatagatcatccggggtgtgcaaagatgcaggaaaattttagtagcatctaactttcctcagtggacttatatccactgaacccaaacattttgtgcctagtagctggccaaataggaaggttaaattccaagtggacaatggagtctatattctttcatcctttgtagacactaaagcatgttaaaagaaataatggaaaatacaaagcacagattattatgtggacactgacctactgaacctgtgcttggaataaatctagtccttttgtttccttgaactgtttttttgggtaactgtagctctccatgtttttaaaattactcagaaaagttactaaagtcataatgttgaagcattgcagctcagttagcatgtctttctgccttatctcacaacaaagtattaagaaataaataacctaagagttaggagaattattttattagggactaaaatctgtctggtcaaactaatgacacattaaaataccagaaatctgtgctatttagagcagggcgggggtggagggcatttgctttggtaaaatcaggaagaagtccattaggaaattttcctctggttcctacagatcaggccttgcatcatttcaaaccataaattcaccagttaatcagtgactttcacgcaaaaattgagagtgcaaaatactccttccaaagttgtttaatgaagcaaaatccatggaaaagtgaaatgcaaaaaaccatcatgatttaaaatgcagagagatagaacttcacaatggcagaccatatttggcagggacccagattcattattgcacattgacctgaatcacccaggctactctgtatgctgcagggctcagaacctgcacagtcctctgataactcaataaaggtgtctgccgaaacacagcagcaactatagaggaaattggatatttcagatgttgtaatgaagctaacaacaacaacaaaaaatctgttaaagattagatagactataaaataaatttgggaaagataaatgagagaattaaaaccaaaagtaaatgttgatatgcattcatatatatgtgtccatgtatattttcttacttaataaatgttctcatccattttttaagcatctagattgtggattttcttacattcaaaggaccaataaagaaaaattttgtaaataagctagtgtataaatgtgatgccaaggagcatatatatttttcttcatatatttactttgtttatcagattcaaaagtaagtgagtcctctgggctattgaaggtactatatttcaaaccctactcagatgaatttttactgtttttcttatatttatttgatagcataataccaatttcagaggacaataaagaacaaagtctcaatgaactagttaaatttaaccttaatgttagaagcagagtttattagaaaaaaataaattttgtctacaggaagtgtggtaaactgtttgtgtgtatatcttagtactgaccgacatatagagtaaatatgtttcttctatgtaaagatacccaatttttggaattcaaatgagaacctacaatgttatggttagcattaggattttcagcctatgtttcatcagctgaaaactgaggtttttcctttaaaactgaaataaatgtgtcagcatcatgttttactattccctggccacatggtagttaacctttactttaaagataatagaggatggtctgatctaacgagatccaagtatagaagaaaaatatctgagagtataggcaaccttatatttaatttgactaatcagagcagtgcaattgagaactaaaaagtcaattgcataaaagagtcaagaaatgatcatccactagtctctccagtagtcacattcttctcaggtccacatacagttttattgtcaatattcaggaaaaaaaaataaagatagcaaggagtaaagagaagagtttctttttttaactgaagggatagagtaagtgatataaggaaagattaaagcaacatttttttaaagaacagtagacttgcttagtatcatcaggcatgtaacaggctgacttttcgcaatgccatgtggtaattatctgcgtacatatatgaggaaataagatgaaattggttataattaagttaaagagatttcatttgaagaattcttaaccattcagattaagaatactagaaagaataaggagcaaaattgcaaagtctctgatgggaagtctttgaaatgtaagtgtatgactctttattctagaatattctacatttactgctttacagttataagttggatagattccatagttcttaagctttatagcctagtacttctaaatacttatttacttgactaagcatatttatccctagccccatcactgccacaaaaccaaaatagagcatccttcctacagcacaggcttctgaatgaagtctgtctcctctttaagagctattcctggttacccaataaaataatacaacatgtaaaacccagcctctatatgatagtcacctatctttctagaattatctctcttttcatccgtactccagcaaacatctacaaaggaagtaggctacatgaggctaattgctactcctcaaatgcattctgcttcccttaacagcattctcattgccttgaatgccatttatctcatctctggtactgaaaacatttccatccttcaagattcaagaatcttggacaaaccctccttgatttcccatgataatacattccatgccctgctctagactgaaacatgtatgtaaacttccctagatcataatctacttgcagacccaggccaggatgttgtctgtcttacagtgccaagcatggtacctatgctataatggccctcattgaattactttgcttacagcatgctggactaatagctgaagccttttttcgagcccaaaccaactaggtttattttttatttcagccacacataagtcccaggatctgactctgtttataagcccacctttgggctaattccttaccctggatttggagtttggctccttctcccgtaccaagttcagctcttgtagagttcaaaagcaccctgaaagcaagaggtggttttctttccaacagagttgttacatgcatcaacctatataatgcagccattcctgcacccaagaaacaactggccagaagtgacctcatgataattctttgggaaacatgtttttgagcacctgcagtatgttaaaaacagtcccataccctgaggattatttagtaaacagcagtatacttacatatcattggaatggggatagataataaaataagtaaattataaagtgatattgaaagtcagaagtgccaagaggggaaaaagtcatggaagggatatagtgaaggccaatgagtggcaggaggcagggaagaattttaatgtcaatgggatgattaggaaagttcccactgagaatgtgatatttgaataaaggcttgaagaaacaatttcttgacacaagattcctactggaaaggtagcaggtcctcacctgctcaggggctccacccctctgcatctccaccatggcactagtgcagtgtggtgtggagttgacctcattctcctgtggcagcatcattcccagagtaaattaagtttctatccctggcttattctagagttgtgaaatacagagagaaaagagtaaaaccagagttattttatgatcccctgacagaaaacacagtgttatttattacttagaactctccccagagattaatcaagatttaatatccctagttgactaatatgctcaggcatcaccattaatacatacttagacacttggcattccattttagtagtttcacaaacatctttagcaaagctaactaacactgtggtcccagattattttctcgctaaagaccctccatatttcttcaacttgctgagctcacaccatttgcaaaagaagctttgtacttacaggaaaacatggagggcttagtatgtgccccatggtttttacagccatactactaaaaacgtggttgggggtgcagaggagagactcagagcattttcacattttcctattgacacaaattggctgttttgacaaggtaaagtcgtggcataggattttttagataaattaacagaatgaaagtgctaaattaaaattgcaacattgatttcctttttagctcagctgtgcattatataaaagggtcaggagaaggatttattactggcgatgaggctctgtcgtccgctaagagactggtatataaaataaagttgtccatttcagacaccctttgtcttcaaggaaagctgtctaggtggcccatgggtggcaaaggcgctgaaaggaaatggaaattgataatcggtcctgttaggctgattctctgcatgttcaattcatatccttttgaaaagaagagattaagatgaaacctcattgaggaatacacattttgaagaaaatagaaacaaaggttctgcaaggctatttcagttggtgtcaaatgtgagaacaaggcgacacaaacttatatgaagaaagggcattaacaaaatccccagacaaagaaggagctaatagcaaatatatgcagccgtctttgtggatgctcacaggagaagtggtacaacttgatttacaaagggcctggataattatttgttacttggagccaaccctgcctctccctctgcagagggcaggcactgaccatctgcgggtcttcgtttagcttttgtgtggatgagaattagccacatttctgcatctggtaagctttgcatgaagagatgtttgaagcactggctttgttttgttttaaatctttaaactgctccctcagcttcagtcagaggattactgcacatctaaccacgaataaattgaaatatcagctgaagagagcgcatgttgcttgctggtggaataatggatggcaggtggtagagggttttgttttcagaaaagcacaggaggctagaagtgacaagagtgattttgtgagagggctgaaactgtcaggatgaagtcagaggggtcagtagttcctgagctgacctttttaaacaaatcctgagaagaccttttactggatcctcacagcagttgcacattcatgccagaaaggttgcccctccttctagatattgagaatcctaacaaaaagcatattttctatgatagggcccatgttcacccacgtggtagcctgacactccctctcctgtcagcccatgacacacaatcctaactgctcacctgctccaccacacacacacaccagcatttgagctgtcccttaacacttttctgcagtctttgatatcatcttcctgtcaaatcacagaaatcaagggactgggctgcaaagcgggacactcgtgtgctaatttccatgtcattgctttgaatggttttctagcatggagagctgttacctgacttctggagacatactaaagtgctgagacccattgtagatggcctaaaaattcacttctcaatgttcataagccagaattatagaatgcactgccatatggcttttttttcaaataaatattgttctgtttgagctctgttatgtcactggaagtcacaataaatcacacacttagtatgctttctaatgaatgcttgttgttcaaaattcccaatacctgaaggaaagaaccttctgtccccaaagtctgtgaaaaaaaatgagggattttctcccgttgtcactaaatattattatattattgtatcctcttccattattttttttctttcctgtttgcaactggcacagtaatttactcattcaacatcaatcctcagatgatatgcgctaaaccaccaaaatgtgagttattaaagacaaacaaacaagttttttgaaagttttgaagcaaataaatgtgattataaaacttagaatatttttcttccatttggttctatgtagttatctaaacttctgagtcgacagtaaaagggaaatttggtgactgattccttagataagagttaatttttgaatctggcagaaaaaatatttaaaacaaagccctagaacctgaatctccttattgagtattgattccacgttcagtactcttcaatgggcactgctgtttccaggcacttaaacagcaatgcagcttatattgttgaaccatgtttttttgatgccctcctcagttcctgccccatgcagaagccaggaagcatggaatctactttatagttatctcttgctttctacctgtgtgtttttaaatggctttgtatgttggaaaagtttctggcttagaaaaaaaaatgttaaaaagaaagagaaatggaaagagagtttaagcagaaggttaacgacagggtgggaaacaaaagggggaaaaagaaggtgttatcacaataaaatctgaagattatcaagagagctcagggtgcccagagtctgggtggaagacccgcctggactgggagacgatgtgctggcctctaagggatgtcacttcccccttgcatcagcaaggtcagtcttaggaagaaccgaaagaaaaggaaaaataaaacaaaaggtgacatttgaaaagaaaagatcaatagatatatacaattacaatgaaatctcaagcaaaaaggaagcaaaaatgtattctataagaatgaaaacagaatcctttaattctctactgttacctcaaacgcaggagagaattaaatagtgaaaaggtgttatatataattatttggtcagaaaatctagagagaggagtaatttcttgtcaaataaaaactactaaaattgattatgtagtcaataatcatccatagaattggaagcaaattttaaaatttattattaaaaagatatcaggcacaagtgatttcacatctgactagctaattgttttatcagagtttctatgttatttcaacaattacaacttatagaaaggtacagaaaactccctaataaatttatgaaccttgaccaactttaatactaaatcctgacaatagtacaacccagaaaattgtagaccaaaattatagaccattttcacttatgaataaagatgcaaaagttctaaagaaagtatgataaattgcatcttcgacattctagcgacactaaaagtttcttgcaatatgtatacaatggattgtctttctcctaattgtctctgtattaactttatagaatgaatgtgggtaaaccttaggaaataggttgaattagtacataagaaacatgataagagtgcttgacccagcttcctgtaaatgtcctctgcagttatatagcaataaaaaagctttgctttagcatatggttctgaaacgatcttctagtgaagattgttcaggaagtctttcttcatccatacgttcacatatagttgaaagcagcagataaatgagcgacacttgataattacaaggcattcagtcaatcaatcaataaagattttattttggaaactttgtagtgttagcacattcaacctgtcatatgcttttattccaggggtctggagttgcattttttttttatggagtcctgctctgttgtccaggctggaatgcagtggtgtgatctctgctcactgcaacctctgcctccagggttcaagcgattctcttacctcagcctcctgagtagctgggattacagatacacaccactatgcctggctaattttttttttttttttttttgtatttttagtagacatggggtttcgccatgttggctaggctggtctcgaactcctgacctcaggtgatccacccacctcggcctcccgaagtgctagaattacaggtgtgagtcactggcctggagttgcctttttgagcattttctgaggtagatatctaaagacaactcaaatttatctgtatataaaacactgcagaaaggagattgtgtacaaaaattaatcctgtgagaaaaactacccatttccatagtaaatccatgatttgtcattttatttgtatatttatatatttgtatcttttatttatttatttattttgagacagggtcttcctctgctgcccaggctggggtgcagtgacacaatcctggctccctgcagccttgacctcctgggctcaagcaatccttccacctcagccttccgagtagctggaactacaggtgcatgccaccacacccagctaagttttgtattttttgtagagacaggtttcaccatgttgcccaggctggttttcaactcctgggctcaagtaatctgccttccttggccccccgaagttctgggactataggtgtgtgccactgtgcatgaccaatttgtcattttacatcagctatagtttatatctggacctcctaagcttgtgtcttggtaagatgcactatagcccccccgttaaaaggcagtcgtggtgcaggcagtttgggtgtgctcattgaatagggagccagctagagggatcaatacctaaaaaattgtaggtgctcagcaaacattggtttaagttaaatgtttaacttatttgggaagacaaacttttaatctgtgtttttgtatataaatattctcatatgtatatcctcctaaatgtatttcttctttgagagctgcaaatagaaaagaactcactctaataaaagctaacattatagttttaattcttggaaagttagcatcacagtttaattcttggaggatattaatttgccaacaccccatatagacctaaaatgtaggagtttcatattctcaggaataaaaaaaatctatatcctcaaacatatgcagtgctttgctgaactgaatgagcatttcttacttattatgtatttaaccatattttagaagtgggcctcaggtctacttatcatatttccatctgtgtagtcattacatatgcatcctcccacagcatacatttctttgatatctaccattctaaattacgatttgagattcatattttaaaaacatataaggtaacaattgtgaccataataatgattgtaattttcttcctgcataggtttttataaccatttctgttagtgtgacttttaagacaatacttttaagaacattttcctcattataaaagtagtgtgtgctcactgtagaaaattaggaaaatacataagtataataaaaactatattaggatcatactgtatgtgctgctgtaatcctgctttctctttcacttaaaaatatattatggaagcattttacatgcaccttttaattcttctaaacgtgcttctctttgaaatggccacgtaggattttcaggagtaaataccaattttgtcaatttgctattttagaactttcaaacaataaaatcagaatccatgttgatgacaaactgaagaactcatgggggccaatgctggtagtcaaggacttttctctcaaacacaaaatgttgcaataccataagaaacaagtcaaagcaagggaagaccccaaattcagcacccaccctttattctgtgtgttgacacaaaacattgatgaaagcaagtgaagagtgagcctcctcatattgtcctctgtgtaatagaacccacaccattgtataagcagtaatgacttctttggccgtaacttaaagacatcctatttacactatggtccttttttcagttgtgaatagagtgcatttaaattacaaacttggaaggaagaggtaaaaggattaccaagtgtgagagatgaatgacaaaaagcagtaaatcctatgcgatcagaaggataagtctcacagttcatctgacataagagatggattacaatggctctgaagtggaagacagtttacttagaaatttagcagtaatttgcatttaaggaatgcattagtgtattcacatatacagtttcatcattggatggttaacaggaatatatggtatttgtttgtgattttattgaatatgatgggttttttttcatcattcagggaaaatctgctttcctcagactattggctgccataaccaccatcagccattaaatgacgtagtgatgctgtattgacactgtcctgtgtatctttctctttgtggctcattctgccctagaaaaatatctctaaggggcagtgccagaattaacccctgcacactgatcaacagaaacttcttctagaaataactaagtctgtcaacctttcaaatatttaactcatgcaaagacattcatggagaaatacaagagggaaatcattctcttataaaatggttaggacatcctgagtttctttgaaggaacaaatattgcttatgctattttctccttgaattcacattagaagacacaaatacaaatatataatgtacatagtctttaacctaaaaaattctttagcaccacatacctctagaagagtagaagagatatggataggaaaatggagtcaagaaacaataaagacacctgtctcagaagttttcaggtatggacttaacccgactcaagaacatacggtaatgtccaccctcacctctctttctttgtgatagtcactcatcgttttctgggataatgctggaagtagaacaaggtttattctttgcttttctatgatggcaaattttgaagttttataatccaaaatgtggactttcattcataaatagggttttaggaatgatgatgtaatttccatgtagcatcgccctaggagtaatgagatgccattactgtattatggctactaacaatgatgagaaggagacttagaactgagccagtaagtatttagaaaacacaatgcattttaccaaatctaagacatgcattttttcatttttaatacctctgaatcagtttgtcttacaattgattatatcgtcaagttaccagatgctgaatgtgaaaaagttttagtaatattttaaacaacatattttccttatattttcttgtttattgtattaataaacaatgtatgatagcatcttaaatgtgatgaaatatagagctgtgcttttaatttgtaataaatgaaggtaaaattattcactgttttggtagtacttataactgatattcaaatatatcaacatataccatctccaaaactcccctagacaaagaaaacacattgtcttggaaagacgttccacaaaatgaaattgaaaatctcatcctgattctgtttagaaacttactttctcaaatctaactaatggggtattgggccaggtagattagtgaattccacacataatccccccaaactcaatttattcattaaattcacttcttcttcctctacgaaatggattcctaaggctagaggactaaccagctagatcaatttattaccttttcttacctttcctttctgatagtcaataatgaaagaaatgcacaagtcagaaagaagcagtaacacaagggcccagattatccctaaatggaaaaaccatccctagataacagagagcccgctgtagctttaaatctttctataggattcagttcaaaatattggggtagaatatagataccatatatgtattatggatatgcattgtatgtatatgtgtgtatatgcacagtaggcacacacatatttaattacacagtcacatgtgttaaaaaggctttgaccacaatgttctgaaaaccactcttaagaagcaagaatgtgcatgttaaagttactttctgggttaacagagatgaggagaaaagttattggggtttgcgaatttattttaaatacattccttaaaaatacccactgacctacatttattgaaagaaaaacagtcaactacaaatgtaattgttatcctgtcaagaatttattaatagacaggctgatgtcatctttgtttaaatgctctaagttgaccgaatttcatttacattaatggatggaaagtccttttcttacttgtccaacaaactggagacaaagtgcctgccaatgttttaatttctttttcatgttctagttagagagtgagaagaatgctttcactccacagtgtcatgaatatgataatctatggaaatcacgggaaagcaggtacttaacttaagcatatactgtactacaggaatccctgatgaattcaagtctcttctgtttagagaagatgttgttgcctgtgaagtgacacactgccagatgttcgtgaagtagcatggtagcaggctcagatcttagcatcttccctaacccccacagatgacagcatctagtttaggctacagaatggtcttgctttcattctttaagcactagtgtttacatttacttgtcaactatcaaatcttcattttcttaattttacttatttaaacatgtggagcacaaaattacataactgtatgagcaatcctgactttatacagtgtatgcagtctaaatgtgaaataagcagttctccatcacgtacaacatgcttaatccattgacttcccttataaatgctggagaaatggtttgctgaagggatgggaaatgtttactatatcgtaatattaagcacaaggcaaaatattttaaaagcacatttttaaaaaataaatacattaatatagtgtcactgtgtacataagtaattcacaaagttaataaaaagctatgagacattgctagaatttctataataaaaataatgttgatgataagaatttctataatgatggcaaagaggcctattaagtgcctattgtgtatgaagctctggcttcactctatacaatttatataaattatataatctttacaaccttataaaatattattcccattttatgagtgaggaaactgagatcttacaaaagttaagtaaaacacgactaagtcaaaaacctagtaaaaatggagccagaattggaagccaagctaagttcaagactgtactgtgtataaatgtacaattacccagtaccttcattcattcaagagtgtgcaatgagccaggcattgctcaaggttctggaaattagtaaataagattagtgaacattttaatctagtaccttttagaggggttggagatttttaaaagtaagcaaataaacgatgtgaatatttttaaaaaggagatgtgaagagtgtgatttgaaaggcctactctagattgggtggtccgagagtgcctctctgaggaggtgacattttatctgagtcctaaaacatgtgaaggatccaactatgcaaagatctggatgcagaccaaaaaaaaaaacccagtaaatgtaaaggccctaaggtcatatgatcttataagacttgtcaagaatagcaagaacaatatggctggagtgtagtgaataaaggggacagtggttaaaatatattgaagaggtgggcaggggccagataaacctacagtcatggtgatgttttccaattttattctaagagcaatgaaatcattgaaggattttaagcagaggaatcatctgtcatagtttctatttaagacaacttctcaggctactataaggaggatacgttataccaagtcaaaagagaaagcaggtagattggttaggaggctattgcagtagcccaaggatgaggcaattgagccttggactagagccatatcaatggaaatggtgaaaagtagagagatttggggtgtatgtactacccagcaaaggagacacttagaagtgacgtaggatgaaaaacagaatagtgggggttttgtttattttttttaaatagagatggggtctctctatgttgcccaggctggtctcaaacccctaggctcaagttatcctcccgcctcagcctatgaagtgctgggattacaggaataaatcactgtgcccagccataggatagtgttttaagaaagaaagaagggtcaactaagtttaatgatgctgagagataaagttagatgagcacaaacaaaaatgtggccacaggatttgcacaataaagattgttgttagcttcattatggaagcatttcaattgtttggaatggaggacaaattcctgaaaaggatatgttgaggagtgaataggaggtgaaggtgtgaagacagacactattaaaaatgcttaaaagaagtttgaagggaagtaaattaatgatgcctgaaagtggctgtagggtcacagaaattgttttgttatgcttagcatatttgtttttaggatgacagacgctaaagtatatctgtgtgctaatgaaaataatgtaaaaatgagggtgaattgttgaatagtcaaagataaaaatgacagaagcaaattccttcagatgatcacagggtacgtgaggtggagtccatgagtggagtcttttaaaggacataggatacctctcttagtagtggaagagaagacagagggtgaaagtgcaggtgagtgggattgtttatgtttaattctattgcactaaaagtgattacatattccctgaggaaggagatcatatctgttttattctccattatgtcttcaatggtcagcgcatagcatgtactagacaaattgtaaatactcaacaaatacatctgaaagaaggagtctttcccaaggatgtagtttattaggtccttccctcagtatcttttcctaaaacaccaaaaactttaagtattgttgggcaaaacagtagcccaaaaacttcaggaagttcatggccaatgtagagggagtggcactaggcttggagttgggagacctagatttgagatgaattctgatttatggatgtttgttactgtattctgtagctgcatggagaagctattatttgtggagcactctgccaaatgtataaaatatattttcccatgtttaatatttcatacatgtatgctaattaattatattagaaagatattttttatattaaaaaacttatacttccttttattttctttccaatataaatctgctgcttagcatagaactactaaaaattgactttcaaaatgatgatcatttcattccagtatgctctgaactgtaactctaaatagggttttagatggatcaaaatgtaatattttatgtcctgtgctgtaaaagggattaaaacaggtgtttctgcataggaggatattaggtatcatattgcataaatatggaagaaaattgattaacctagtcttgctccaaatatagcctgaatcctgtatgcttttttactccatatttatagcagtcccattttcctcatcacctcatttttctgttttcctttgcttccattccattgtgtaaggcaatttttattccattttccctcattggtttttgcccttgacattctatgcaacatttagccatgaaagcagtagcattttgaaggtgggtttcaaaagcaaattatttcatccaagtactcctaaggcactggaaggactgttgctgagaaaatctttctttatgtattgttaatactctgtgacatttttataattcagagcactcacatctttacattatttattatattgtgcataaatgagatttatgcacaatgtaataatactttggttctataatgctttagagttttcaaaatagtaacagctgtctgtattttaatcatctattaatgcttttcctattttaaatagttgtggtgaagaacaaatgggcaaggtgatcattgttatttctgttttatacagatgaaaattgaggcttacagagggcaagtggcttgccccaggtcattcagctagtttctgcgttctaagatcaatgatcattctgcatattgcattgctttagtagaaggttctattttttctcccaaatcctaaaactctaatatgtaccaaatgcatccacatgtgtatctatattttattcttacctctttagtaatttcatgcctgttatcatttatattcacttctaatatttgtggttgattttctatagagtgtgtctcagatgagtttgtaactagacatcaaactttgtcaagataattacagtgtaatgttagttatgaactgtatgaatttcccaattcatacagatttataatagctttcattaaaaaaatatttttagttctattaattttctatacagatttcattatttagtaatgaggtaaaatagctacaatatctttagttttaccttttactaatgaagtctaaaacagtttatgaacccatccaaccttggaagtttgataaacatgatccatgatatccatatgttatagcctaatagactcagaatgttctatagttaagtaggatggaaagagttataatttatgactcaatctgatgtttcattcacagacaatgtgatgccacctaggcataaaccctaaggaattctaattgtgaatttgaaaacaaaacagatcatatcactgggagggacctcatagatcatgtagtcaaaccccctcatgttaccggtgagaaaactgagacacagagggagtcatcaggctgccataggtcacaaaaccagctgacagcaaagtgaagatcagagccccatctcctaattcccaagtgagtgctgtttccaatatgccacattacctcccccagcaagatgcctcccatggggcattgcttcttgaagatgaagtatattaaattcacatttggctgctaatcgttttctcagcagctctatggtatttcattaacttctgcatgtaacaccctggcctttcacctgtattaacttgagctcattaaacttgaggccagtaataaacaggaccaaactaattcagatattttgcttggtatgtgttcagcattttttttaatggtttctactgtgtgaaacattttcccttcaaaatttgtggaataagtaaaacaggaagcatagatttcaaggaatggagtatgtaggtagtatgcttctttaaataaataaagagcatattaaacacctaccttatacaaaactttgtgaggactacaaagaagtatgagtggcaggatagcacagagtctatcaggcagacttggatttgaattaattgtagcaagttacttagtctttatgcccctcagtgttgttgtgtataaatggacactagaatacccaactcatggatattctttatcttctttgcaataaggaagagataatgtactcatgtgctttgcaaagtgtctggtatatagccatgatcagttaataagctgatatattcgtgaaggtgatgatgatggtgcagttccttccctctcccttgttaaatttataatcccctctcagccatttttgaggaaattgattttccccatgtcacctcccctacctcatcatctctacaaaatataagcaaaggtcctttagaatgcaaggaaagtaaaactaagtcattttacccttcccaggttgtccaccaacattgctttatgttccttttgactaagaagtaagtctttggcagctcatagactatgcaggccccagttaacaaagttcctatgtaattttaaaagtcaagaatctgattgagcaggggatggtgataaaggaggggtcatctgcagaaagatgaccaacaaagaggtggaaatagaagtctgtcaggaagaatgacagcatgcaggagtttcaaggcagaagccattgtgagtcagggtgaggcagtcagcaggcagtgtgggagtgaagatcaatattggagccttggtgtggggacaggtagtcagtgttggttctctgtttcccgaatactacgtgtattagagttctccagagaaacagagccaatttaacatattagattccctcttatatatccatacataactaataggttatatattcaattccctcatatatctatatgcagccaattggttatattattatagccaacaggttataggttatatctgtatgtaacccattggttatatataggtatgtaaaagggaatttaatatgggaattggctcacgttgttatagaggccaggaagtcccatgacgtgccatctgcaagctggagaacaaggaaagcttgtagtgtaattcagcctgactctgaaggcctaaaaactgggggagccaatggcatacttaactctatgcctgaatctgcaggcctcaggactgggagatgaggggggcagcagatggtggaggagatggctgggcgagtgctataaggcctacagtccaaaggcccaagaacctagagctctgatatccaagagcatgcgaagatggatgtcctagctctcactccagaagaaagaataatttgcctttcctccacctttctgttctatgcagtccatcaaccaattgggggatgcccgcccacattctctttactcagggcgtattttctttacttggtctactgatccaaatgctaactgcttctggaaacactctgacaaacacacccacaaataatgttttaccagctccctgggcatcatctcttaacccagtcaagatgatatataaaattaaccgttacaccatagaacccttttttaattttctactataacagctttgaaaataatgatgaccttagaactcatctagttcactttcctaccactaccagaatcccatctccaacattctggatgattctccctttttgctaccgccatcatcctacagtccacccttccttctgccactatgaggatctggtcacacattttcaaatatctggtgttcccatacaccctaaagaataaaatccaaacactttgcccagaattcagagccctatctatagatattccagcttcatcccccactatctccctgacatttagtatattttagccatataaggataagctcatcctgtagttccttcacttcatttccttacttctcttctcctcctacaactaggcactgctttcccctttcagaatttttcagcatagtttaaattcctccttcactgtaaagattgtattaacctctgagttggaattaattgctcattggatctgggttacatcagattgtttgtgcatgtcgtcctctacttatttctccttacaatgacgtatgtaagccacatgtcagctgactttacccagtcctgtccttctggaaattgctaccaaatccccagagattctgttctctaggttgcttctggctataaattccagctgtcattgaattctgaatctccctcaaacctccctcctgttggtttctattcttttcagctatatgccaacccaaccatgaaactcaaccctgtttccctgattttcctccaaatgtctcaccaagacatgtaagtgtgtagcagatgttcttagataaagactatggaggaggatttagattggagcaatgcaaacatcttaaaattaaatagtggctctccctgtttataaaagtccttcagcctcataccaacaggctgtgctccttctctcttgccctctcttttcacacttccttttaccctctcctctcttttctattccccctctccttcaaaattctacatttctccatgcataatgcttggaccatctctttgttctggtttctcctaaaacatgccatcaataccacatttcctaaatcccaacctagaggtatttcttcaaaaatacttactttaaaaaatgacagtttttaaagagagacctgatatgagttatttaaattgtttcaatatgaaaataataatgttcttatctgagttcctttgaatatgactcaatcctcttcataaggctataaactgcttttggaaggaacagcctcctggtcctctttgtggcctgggccccagcacctgcacagcacttagcagaaagcaagtcttatttccatcatcctttgctggcattccatgaatgttagactttcttctcttgattgacattattcctaattcatgatccgacttcatcacttcacaacaaaatgtgttctgcctgcttttcacaggtgaagtgcctcaccctcttgtagcttatgaacgatggaacagagggttagcagtccattggctccccggtgccttttccaaattgtcacccttctccctctgctgtttattccacctggaggattctcttcacctttcctgacctcacgcctccactgcaccacttgccatcctaccttcaccttatccttcagagtttagctcggatgacacctcttctagaaaatctctgacccctcagcctgcgttagatacacattgtcactgctcatataacagtttgtgtcacttctgccacagcccacagggtattgcaattgttattaatatagtctctttaaggtcacacactatcctttctatataaatttcaagtgtctggctccttataaatgttttctgaatgtatgaatcacagcttttctgtaagtacgattttttacttcatgtcatatttgaaaacctatttatatactttaatttgtttctgaaagtaattgtttgggattgtttgacaattcaaacaaccagaaagattttgtaaatatattcaagatattcattcattcatttattcattcattcattaagctttgaaaaattatattcagcacctattatgtgctggatcaaagttacctgtctaggatctcaagctgggcagatggacacataagctaatgatgataaggcagtgcagtaggcacagagattaaaatatgcccaggatattctaaaccactgggcagggagggtaatcggtaaaggagattacttaggtgttatgaagactgagctgaaactaaatagcctaattggcatgtaccaggtgaaaaagacaagatggggtattctggcagaggggatgcatgagcaaacatggaaacacagagcacagtacacaatgcaatagaagcagttaaggcttatgggaataaattggcaggcatgcattttgcaaatattattccatttaatgcttataccaacatcgtgagtttgatactgtcattctcatttcattgataaggaaaattagtagcagaatagtaaagtaattggctcatagtcacacagctaatgagtgcaaaactgattttaatgcaaatttgacttctaaattatttccctcatcactatgtgaatgttgactttctactttcactatgaaacatgaactatctctgcttttgaccaatttagatatcacatatttgatcaaaagttgtagcttacatttatcaggttaaactaatactcatatttcatatattttacatgtccaatgccagtgtactgatttgcatcattagccatcacatagcactatggtaacgtgtaatatgtagatggactttctgtctctgtctttttattgtgttccactgtccaaatttgataatatcatgaaacattgcttactgttatatcggtgattaagcattacatgccacttacatatgggaaaatctgagcttctgattctaaaccatgctaaaactgattttgaaataaaaatcagcatcaaatgtaagtaactgattactttcataattgaaaagaggaaagaagaaaagtaactgaattcagaaactacagaacagaaaagatacttctcatctctatctcctgtgctaccttgaatcatgctgagcagagattgaaattagggtgagttaggaactttacctggattactttatttaaacctcacaatggccattttatagataatgaaacagactcagagaacccatgctctcaaccattataccacactgctcccatattttttattttaggtatccaagaactacttcaattagctttttgaggtttttaaagatcaactctttgaacatttattttcttcatttttctctgcaattattggtcattttattgagttcaaacagttttccaaggagtctggcatattattccttgagataactgcaacaaccaggtatatttgacatataattcaatctgacactagcccttaatgaatagcaaaagatacttacaaaattaataacaatgataatttgtactacactgtctggaaattgtttagcctttagtgtagcacaggacagttcctggcccagagtggatattcaatactgtatttgttgaataaatgtcaaaagactgataaataatagagctatgtcatatgcaaacatgtcttttgggaaaaaaaagtcaacttttagatatcctttacatgtaacttatcctttagtctgtcagttgtatagacacacacacacacacacacgaaataggtataaaggagatagatagatagatagatagatagatagatagataatagatttcaggtttatactgaataagatacatatatacatatatatatatatatatatatatgatactgagtgatatattctgatataagccggaaatattttcatctttcacatattacaatttagatatcaaagtaattacttgtcttcttgttatggtttccaattagataagagagtgtgattaagaaaataaagttgatccattacagtactacagactagtgctattaggcaacttgctgccattctcataaaaattatgcagtttaaactggaagatacaagtgcttgcttctattacaaacaagaacgcttttctacttcataatatgctcaattaactttagattgatccatgaataaattataatccaaatagacttctttaccttaaagctttgctggcttaaggtatcattgttgattcattatgttgtcacttttctatcggcaatgtaatgctttttttatatctggatagagacagttttagtgtaagatactgttatctttaaatgagtaggatttagcctttctggtgagaacaaattcatcaatgatgaatccctggagaaactattgaaacaaaactcacaccatttctgagctttgttcagttcatcagttacaaagcagcttttgatagtcctaaagaactttttcctttgtttaagaaatatagcatgacgctcaaaacctctcactttgagttaccgcaggctacaacttttctgtaagaaaataatgaatgaagaggaaaagctcctgctgctggcactgtcaggtcctgctgcttctcctcctgcaataggaaatcaattaactatatgttcaggcagagatttgaactaaatgctttattaatcatcactgattgcacacacacacagtggccaactatgcattcatcttcactctttcttagctttgttttgcttgcttgcttgctttatccttcttcctttttttttttttttttttttttgcaagatcaaaacacaaatgtatgcctaaatgtagtatgtgtaaaggtgatcggttgatcctttgttgcgggagagaattgatgtttttttgttttcggaaaactttacttttaaaatgttcagtacttaaatagccttaggaccactttaatatatacaacatattttttaaagcacttaaattttcaaactaataaggaaagcaaaatgtctacagcagccttgaagttttggaagctggtactataccttagtctctgagagctccatgtagcagtgaggaattaaacaaaaatgaacccaatttgatgtggagatgcttggtggaaggtggaaggagcagtcactgatatttggtatttttttttttgctttcaattaaaaaaaattggcaagttttccttttagtccattaattcttctaaccaatgcacaaagaaaatcctgtaggaatctttatgttaaattgagattctctctttaggactaattataaaaccaattagcacattagaaacttagcatgttagccaggggaaggctgtgtaacataatttatgtatggcaaatgtggtcaatcattgcaaaaaatgacagaaaatatcaggctgttggatatttacacaggctgtattatattcagcatcaaaagattttcaaaaatttattgttcttattaccattgttgaaataatttgaaatcattatggtttaaatttaactacattcattgtctgcatttggataaataataatctaaatgaaaaaatatactatcctctgatgtacatttaaaggaagatagattaaaaggttgcaagaatgatttcttttgaatggcctttacaaaactcttaggtgaaattagatgatgttgagtaaggtaaagtccaaacagagaaccatgtaaaccccaacagggaaaataatggttccgattttcatggagcctgctaacctgaggcatctgctagaaccagaggtcatatgtttcaacacttaaccgttcttgatagtctttgagtatattagattaggattgagatgcccctgaggtataagagaagcacgcagggggtgacattctgaagatttatatcatgtggacgtgtgctcgccaccttatgtggtgttatctgaccccaaaggcatttttttggcaccaagtgtaatccctaacacctcatatacctcatatgccccaagaaaaagccatttcataaaagcattgtcttttaaggatgcttatatatgtgataaggacttgttttatactcttatttattttatgcttttagcaagtcagtatcacttgttttatagcaaaatggatacaaaatactatctccctccatcctatcatttcatattactgcaacaattaaatattacaaattaagaaagcattaaggtgtagagatgaagtactcagttctagtctcattgtatataaattagtttggcattcataacattgtttccatttacttgacttgttgacataattataatgaattgataatggaagtaacaatcttagatatttctacataagtatgttctttgctaacatgaattacagttgcagtttgcagttcggcttaattggaacatggtttaagtttagcttacctactctactgaggtctctagaggaccagagaactcattttcctggggcgttatgcaagctgaaatgtggaggccagtgttttgaaacaagtgtgatttttcaccaaaatacttgctaggtcagagatcaggatgaccttcgagtgctgtagttttccaaacctccatcagctagataaatggactttattctgcaggagagagagggtatttttgcagtcttatgaaagagacctaccaattccaggttacaggccgacacaaaacatttggaattcagtgatgtctatcaccagcagtatgtgtcagtaaaagtgaagatcaaagtttctagaagaggggaaggacaaagtgaagagaaaataattgtgggataatgaatggtatgagggcattttcgtgttaacttgaaaccacttagcatttttccatgacgcccaggtatctttctaaatgaactttgtaaagtacaattggataaccttgaaatttaaagctccgtgatgtgattttgaatactgatggagtttgtttaagcactgtaatatttcctctccttttcatttctatttttgcctccatgcaaaataaaatttgttttctgtacagagaaatcaatatttttaccatttttgtttttcagctattccagtaagttgcaatcaacattagttacaatctttaaagagatgtagtaagaatttgaacacaataaaatagagatacagatgagaactttggcgaagtacctttgctattgacaaaagcatttgtcagggactacaactgtgtctatatcatgctaaaaacctgatgaaggggaaaaaagcatcaataggtttcaccttctgtctatacaaaccaaacaaatggtttaactaatagctgttgttttatgtgaatgggtttggtttgccattgtgaactttcttccatttagaaatgtattttaattaacatttgtatatgtaatacatacatatttggtaaaagtattgtactgttgtgttctttttaataattaacggaacctgataccgagaagactagtggtccaaaacaatgagtgaagacctagttacagtatacatgaaacaatccctagacacacatttgtttgttgataatatttatatgtttatatcttcccatttttctcttctctgagctaacatgcttccttatttgtgtgttttccttttagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggtaaaaattatgccaactatataagtatgcctactttactggttaaatatacaaatatagttaaaatgtttatttactgcttaaatgtatcactaatttggttttagaattataatgaaagttttaaaaacatctgtccatggtgaaaactgcatttaaattataaaataaccttttttatttgcatattttatactttttagaacactggcaagcatgcatgtcatggaaatttttatatacattaaatgtatcaggagatattaagatgaaattcctagttttcttatagtcacttaaaaattattttaatacataattaactccaagatatcttgtattagtcatgtagtacaactcaattatcaataagcacatcaatatcaatgtgatcacttgaaagttttggaaaaactttctctggtttggcctctggaaagcctggacatttatttgggtctcaggagattattttctggtaataacaaaaattacactaagatagaattatgagtatgtgttacctttcttgatttttttccttaaacttttcattttgacagaaatgtagattcacatgtagttgtaagaaataatacagagaggtcttgtgtaccctttatccagtttcacctgttttgcatgttgcaaaactatagtatgataacacaaccagcatactgacacagacacaatctaccaatcctattcaagtttttccagttttacttctatgtgtgtgttgtatttagttctgtacaattttgtcatgtatggaggttcatgtatccaccaccacagtcaagatgcaaaacagtgacatcaccaccaggattcctcaggtaacccttttgtaaccacgccttctttttttctgtcaccctcaagacagtattgtttccaagcagtcataatgagaaaaatggaggtgttactggatggcattctgtctgaaatcatcatcactaaaatgtagtttgcagttactgaaattcattcttctgtgtttgatgacactctactcctacatctccattttctgtttgaaatatcagctgaaaagcttgcttttatgtgttctcaagtagacctcactgaaattcatctttagcagtcaactggagactggaacccttaaaaattccttctacctatgaagaaaaaaaaaatgtatctcatgctaaaaacagtggtccagactcaatgttccaaaatttcagcaatacagagttccgaaagggcaaagggagtggctgaccacaaagcgtgccagcacttcaatgccatcattctaaataaaatgaacatttgggacttttaacagcataaaagccccaaatcgtctcttgagttgttcatgttaaattatttttgtgccactaaaagtatgaactgaacaaactgaacactaatggaatgcgaaggccagaacctacagcccttcacgagcctttttgccaatgtgtggctatgactactatatgatttggagatatagtgtgtctggaattggttcctgcccaggggttcatggtctcgctgacttcgagaatgaagccgtggaccttcgcagtgagtgttacagctcttaaatgtggcaaggacccaaagagtgagcagcagcaagatttattccgaagagcgaaagaacaaagcttccacagcatggaaagggaccccagcaggttgccactgctggttggggtggccagcttttattcccttattgtcccctcccatattctgtttttgtcctatcagagtgcccttttttcaatcctccctgtgattggctacttttaggaccctgctgattcgtgcgttttacagagcactgatttgtgcattttacagagtgctgattggtatgtttttacagagcactgattgatgcattttacaatcctagttacagagtgctgattggtgcattttacaatcctcttgtaagaaaagttctccaagtcccactggacccaggaagtccagctggcttcacctctcaataggaattctcccagctttctctctcttcttaatcaatttgaattaaatgtaaaatctccatctctaggcatcttttccttaggtgtaaaaatttctaaaggaagatattatttatatttgaaataaaagaagtgcaatatgattatgaaagcatttttaccttttctagccctcaaatctttcagagattgtatattaaatattgataacttagacaaaaaacaaaacagagcaaacaaaaaatctgtggttgcatgaaagcctgtagatcattaatcaaaaaaaaatcaaagtcagaattaaaccaaagaattgtgaagtcttggatgtagataaagatttctgaagtatcaaagaggaataaggcatcttattaaaaatagtgcaagtttatgttcctctcctaagttgtcttactttggaggttatccagagtgaaatgtccttggtgttacatgttacataagcctcaagacattgtagataccatcttaccagcatcttagaccttatcagtgtcaacatcttaatgggcagctgtggtagattttctcaatgtctggtggattttccactaccttggccttctccccagaatgtccatactcattccacctgttgtcatttctaggcagatgctgtgccctgtcaaaaaacaaaatagtagctgatagtggcgaggttttcggggaagcaagcattttcagtttttataaatgcagttatctctttagaaaattagagattaaatctgttataacaaataactgtattataaatataaaactgtgtatttatatttatattatactataaaactgtgtgtgtgtatatatgtatatatatacatatacatacacacacagaagctttaatttgtgtaatcatctctagcaaaggctcattttgtgatttttgccgtttgtttgcttaggttaaccttttctaccataagattatatcagtatttaccccatctagttgttttaggattttaatatttgtattttacttcaatttctctaaaatttgtttggctctaaagtatcatgtacagttataactttatttttttccaaatagacagttgttccaagacctcaatatttgcattttaaagggatccctttcatctctcaaattataattcagtgacaaaaatgtaccataaattgcatcatttactttatattcaaattttcaacctctcaaagttttccaaaacttttcaaggacaaatcaaaaatgaattagacaaggttctaataaggatggtcaatctctagaaaaaagttttatgccgtaagtaattatttgtgccataataaacaatttttaaatctttataaatgaaaacttctaattaaattcaaaattctgggttctaaactccttatttaattaataccaaacttaaaataccccttttacacttctacaaaacaaaattatttcttgtcctgtagctttgatcctttactttgaaatatgtttaatatgattcctttttccttctgatattaacctcatggaagaggtaggggaaggtgggccttgagaaaatcactgagttcagagagcagcgtgtagtctcatatgatggaagctgaagaacaggttggggaaagtagaaaaggattgaaagaacatgatgttggtgtctgtattcacctctctgcttccttctctctgtataatcttcctttatgataaatctaaacgtttcctacacaatgactcaactattctccatccgagacatcttttctatacttcagacttgtgtcaccatatcttggggtcacctccacctgcatcgtctgaccaaggaacccagtagccatcatacttagaactaaactgattcccattccttccaaacctgctcttcctcctgagtcctctgtctcaatgaaccccatcttacctaactcaaaaagctgcagttcagcctggatgtcatcttattactcatcctattcacaagctagtcagcaatgactattgttcttatctcttacatctccctcctcttacattctttacataatgctgaggcctcagtgtgttgcttacgtattctttcctggaattctaaaacattatattaactgtcctgctttcttttgtcctccttatctaatccattctccaactattatgaaggagtcttttaaaaatgtaggactgtttgttttatcccttgcttaaaattcccccattgtaaccgtaatcctaaggtaagctccttagcataaccttcagacccatcacattttagcttttcctgacccaagaagcagcttcaatggaatgatgagaagtagaatccaggaggtgataatttgaggaatgaatgaagactgagaaagtaacaacaaagtgtgcagaatacactttcagtaacttgagaaaggtcagtaggaaagggataagaagaggaatcgagtagaggaaaagattgttttgtttatatgagaacgatccaggcttgcatatgcttgcatatgtttgggagagaatagctgaagctgccagaaagggcatgattaaggaaactacatctttggcaagcagagagggaaaggagtctaaacaatatattaagatatcttgcataagaggagagacgtgtcatgaagctgaatttggacttcccagtgtcattttaacaagcagacatatttaaagaaagtgaccataaaaatgtcttcagaaactattgccctcattgaaatacaaagcaaagtttgtaaaattttaacagattatatttatggtgaaagaatttcctgaattaggcatgggactactctgtcacactgcctaggttcaaactatggcattgccgtttcatagctgcatgaacttgcctcagctaactaatctgtgaaatggaaataataaaagtatctgcctcatagagttataaattagatgatgtgtgaagtgcttttagcatggtgcctgcaccaaatgtgtcctaaataaatgttactattagctataatatttgaaatgaacagtttgaaagaaatccacgttaagatgactattcatttccattttgtccaataaaatgaactgaagaatgaaaatagaaatacataaagctctggaggccaaaaaagttggaagttttgaagaagcctatgtatttttcaggaaatctttattgcatacctaccatgagataagcaatgcactaggaattgagcttctgcagggcaataaataaaacatacacagcttctgtcctcataaagcatacagaatatagaaagagacagatattaaggaatcacactaacaagataaaattattttttgatatgagctacatagaaaaaatgcaagatatatagaatctgtttcatagtgagacctaatttagattgaaggggccaatgaaagcctccttgaggaagtgacatttaaggagccctgtagactaagtagagattagaagggaatggggaactgagaatatttcaggtatgccataatgtggtcctggatttggtaattggctatggtaatggaaacagagatgaaattaataaagtcttgttaattcttcctccaagagtcagtgattctcattatattaggcataggtatagtaaagagctgataataagaagactaagatgtccagcttttttatggttccacagagataaagaaaaataaaagataatgagttaaggttttgatgttagtgttttaggtttgaggggagtttggggtgtagcatgaaaaacttagatttgaatgtattgaaattgataaaggaattatgggcctatgctggaggatataaaggagaaagagctgacatttccaacgcccactgtgttccagacccaagatagaagctgcacatgtattttcttatttcttacttaacctaatactctatgaagaagtagggagttctggaggaacaaatgtgaagaagtgatcaaagaaagagaaggataaccaaaataaaatgatagtgtggaagaaatacaaaaaggaagtcttaagaataggaaagtggtccacaaggtcagaaagcaccgattgttttaccaatactttgtattgtttcattttgtctcgcatatgcaatcaatgaaattccacctctagttggcaacagttgtcaaattcatccatgtatgtttcttaatttgtccaataatctttaatgtgcaaccactatgttccggtactatagcagtcattggcacaatccagtagtgaaaatcccagctctcatggagctcacagtttagtagggagaaacagacaatgacaaataaacagatgaatacataatatgtcagatggtgacaagtgtaatggagaaaatagaacaagcttaggagaataaaaattactagagagactggccagggaacacctgcctgtttaatggcatatgggcaaacacctaaaaaagtgagggaatgaatgatgtgggtatccaggggaagaacactgcattcagaatgaacagaaagtgcaaagaccctgaaatagcaaagtccttggcaggaaaccagtaaggcttttagaaaggaagactgatatgatctggcttatttttgcaaaggatctttctggctgcagtgttgatacagtttgctagaggggcaagggcagaaacaaggagaccagttagaagctattgtaacagtccaggcaagggattggcaggagggaaaatatatactggataatgtcagaaggcctcaactccattgttttaaatgaaaagatatgtgtgaaagtattatacacagcacagctctattcaaattctaggagccacagttattgtcatttttatacaagtccctgccattttgcccattatttcagaccacatctagatgatgtggctgtgtgatttttcagtccacgttgatattaacggccacattccctttaaagtcattttctgtctgcacatgaatcagacattgcttcttgtccttttattgtggttgttattgctgttttttagcacacacccaggcacgccatgtaattgctgctacatgattacttcagtgttttccctagagtgtttcttctttcttgacataccatttttcctacttccctttttcctggaggacctgggttatctgttttcatgcttaatattttctctgtccacccatctgtttattttagcttgtttcttccctcctctctgctggcctctttatagattcctctgttcgatagtttaaactccatgacactgctttgtttatcctctcagcttccacagcacattattccccatctgctgtagaaagaaccccagtgtcccacaaagttaactaagcccctcttgtctgaacaagtttttcagtcatgcattcaagtttctgatctaccccatcttccctggttgggaatgcaacaataatatttctaagcaagctatgctcagtagatctcatcttttgttcttttttcctttcaaatgccttaatgacttaatggtctatttcttcagaggtaggcagtttcaatatcagtcaatcagcaagtatgtatttagtatttgctgtgtgaccagcagtgtgctaaggactgcaggagattcaaaaaaacagacacggcatggtccaaggctcaggatgtttgtaatctcgatggagatgtagtgctaacatatatttattatgcacttgctgcaatccagaaattgtgctagaaactaggaatacaacgtgaattttaaaaagaaagacgtctatccttatggagctcatagtctagcaagggagaaagacacatgttaaaaattatttacagttcaatcaaatatgtacaaaatgctctgggaaaacagaggagtgaaagggattagttctgccttgggtaattgtggaaagcttcacagagatggtgatatttaaaatggagtttaataaattagtgttaattaagcagagaattaataataaaagctaatatttattgagtacttatgaggtttcaagcatcactacgtgcttgcgaattagctcatttaatcctcacaataaccctctgtgctattatggagtaagcaattgataaacagaaaggttaaataactttcctaaggtcacacagctaggaagatatcaaagccaagatttgattccaaagggtagctctaaaccttgggcccttaagcactgtcctctgctgtctctcatgaaacatagaaataagaaagaaaaggaaggtggcatttcaagcaaatcagtatgtttgcaaagcacagtattcaaacatacttgtaataacctgcagccatgggaccttaaatccaatacataatccctggatcaagcagatagtgacatcaaaatggtaaactcattcttttgttaaattggaattcatagaaagcacagaactgagaagcaataatgaggaaaataactgggttttataaatcagtattaataacagaatataaaaaagcaatgggatcaactgattaaactgctatgaatttcatttgaacatcaagcatggttatgcccagtgttatccagggactagagagtccttgagaaccagaaatctttgctagacaacatacatcctgattctcctagccccttgaaagtaaaaaaaaaaaaaaaaaaaaaacaaacaaaatggcctcagaggccctccgtcctacccctgggaatgatctggggccctggggacagcctggcatctgcatgatttcccttttatcaacaccacatcttcatttccaatgcataatagcatagcatttaccatgcgtatggcccatattatgaagctaccaattccataagggaaacagaaagaaaaagattctgaggaagaagagggtatcaaaagaagtactggaaggctgatgggaaagaatgagataaaagaagaaaaagaaacctggcctcctgcaatgagtataaagatttccttctaaaagatgaacaaggaccttctgaagaagctcctgacatattctacaggttcacctgtgctagagaaaagaaaccagacaatgcctcctacaggaggcagtttcgtttcctcgctgagagaactgaagtgacagtgtgcacatttggcccagttaaatgagaaacgtgctttattcccaggcagcatataacagagacttgagagtctgccaagacttataaagtcccccgaatgctttccacttctgttgatatatatgagaatgaattctcattctctttatgaagccgggaatgtatctctaacgtctttgaatttctgcgtaggaaaatgaatggtttaggggcactagtgatgttttcatctcttcttcctgctgcttctagtaagagatggactgcatctcataagactggcaagacagtgttggcgggacaccagtcagcctgatcgagtgctttattatttcaattgaattgtgaaaggaaagagaagagtactcagataaaactgcaagaccatattggatactatggagcataaacaggagggaacagaaagaaaaatagtggaggccttgcccagcaatttccaaaagataccagagaaatgggctgggaacaaggttaatattctcacttgtccctgtaccaacacatagcagatgaaaattatcaaactgaactttaaaaactgaagagaatttggtaaaataatcccttaagtcttatggggatttgtagaaatgtgattcctgaccagattatggcatggaaaggtgtatcttgtctggaataaatgggtctgatggaagggctaggggagaagcagtatctatcaaaaaaattatacacatgcatggaaatccacaaacctcagggtggagtatggaggaagcagctgcaggagagtgaaatgaaagaaaaacaaaatgttaccctgggactgcctcagagaccttgtaaccagatggttaatagggacaggcaagacagaggagtgatgaaagcctttgcaaacttcagatggaaatcccactccactaaaggcaaaacatcggaaaaattattgaattgccttgttggaaattcagtctcacaaaagagagacaagtaatgaggggacttgctgctttggcttatttctggctaaaaaagtctgtttgaagaaaatggcagctaaaggaatcttgaaggaaagtaaccattccacgttaacttagagtttattaggccaatgaaaggaagtctgagcttagaaatgcaagtatcccacctttagtaaacctaatttcaggaagttcagagaaaacaatagatattatcttatagtcagcaactctaacctgaagatggatcaagaaaaatgagaagctgacaagtacaaatttgattatataatcactaagtttcctaagaagtaagaaaaaggttatgcatttagataactcagtgtttggtgcttatatgagaaaagacagatcacattaccaatgatgaaataaaagggtggcatcaagatttaaggacaggtcagaagtgctaaagcctcaaatgatctgagtttggagaaaatattaggaaaaatagcaacatattttgtctattaatactcactacttagagcaggtggtacactgttaaattataattagagagaactgtttgactcctattatctttctagaatcccataaagaattttatcagaactaaaaagagtagagaaaatatatttgagagttaaaacctaagatacctaaggatattgtagaaatacacttaccttcattaaatgaatttaaatccaaagtgtcttgcaagacattaccactttaaagcctgagctcatcccagatagaaaaaatacagtgatcagggccacagacaggtactgaaccaactttgctcctggccaatccttactcatctgactctctcactaataatctccctctcacccaagccgctctcactactttggttccaaaagtctcacttgccgctattccatctcttgatttacttgcttctctcaccctcgccggccaatctaatacttcattttctggatcatactttgtctctgccctctgctctcagcatattcaagccgagtccttagttattagagttctgccaaatttaaacttaagatgtccttttcttactgtacagtactcctgtctgccttctgctcagagggcatatatagaatatccagaataaggcacctgctatatttttaagtgcttttgtaagagatcactataccacactgatgaaaaataaatgttgctccaggttctttcccaaagaaaaaggtggatgttgtaggggaagtagggaaaagatggaaacaaatcagaaagattgagatctaaccccaaaggaatcctacaaacgtcattcagcttttgacttgggagcattagtaaaggaagaagttaaaaatcagcataaattcagtaagagcaaactgaattatctcattttctgttttgaaagatgcattaggcaagaagtgaatataccataaaaagatatgacattggtaatggtacagataaggaaatagttaaatgattaaatagctacatccaaataatttaaatattgaatgtttttgggttagaagtcatagtgactgcccacagcatgctgttctgggtcctggtttttgaaggatacttatttgcagaagttgtacaaagtgcagacagtcctgacctacaatggtttatcttatgattttttttttattttacaatggttcatattaagaacttaacaatggttcatcttatgatttttctttctactttacgacagtgtgacttacaatggttcatcttatgacttttgttttactttaagatagggcgagagccataggcatgcagtagaaactgatatgatacatgctaatcaaatatgaagacttgaagctagaaagaacagctaacatgctagataatcacagtttgaaaatacttccatcagctattaaaaatagaccaaaactaataaattaatattagtcgtaataaattcagaatgaaacatcagggacggaatcagggctgtctagttcctcactctttggccttaaactttatatcaaacagaaacattgactggtctattaaaaaaaaaaaaaaaaacttggccaggcgccgtggctcacgcctgtaatcccagcactttgggaggccaaggcgggtggacacaaggtcaagagtttgagaccagccgggccaatatggtgaaacccggctctactaaaaatacaaaaattagccgggcgtggtggcgggcgcctgtagccccagctacttgggaggctgagggaggagaatcgcttgaacccaggaggcagagcttgcagtgagccgagatcacgccactgcactccagcctgggcaacagagcgagactctgtctcaaacaaaacaaaacaaaacaaaacaacgacaacttttaattatctcaaacaagtaataaattgataataatgggatcttggaattctgtagtactttgcaacatccattccttgaacacctacattaaaattaagtgttatcatctataatttaaaagatttaacattgctttctccacatacatatctacatataaccatttccactaatcagggatggctacaccatactgctgaaccttcatacatccaaatgggtgtaataatgaattggaataatgaatatgggttccctgatctccacagatgtgtgtacaagaggggctggagactagccatatgtgacttactgattttatgcatctttcagccaactccagattccaggacatctactcaagggtattcataagctggtagtactacctggaggctttgggattaaaacaaatgtccacattcttagccacatggaataattttttttgctactctttcccaaaatgatttaaaatagttgtcattcttttatcctcttccagataaagaaaaaaatataattttcttaaaaaattgtacttaataagggatgaattgttaacaccatgtgctaataacttctagaggctccacattggcttcacattaaacaatgatgttttaataaatgacaaaagcaaatctccaatttagaggaaaaggcatatttaatgtacacagaatgtggacttgctccacgtaaaatttctaaggcatatacaacgtttcttttgaagaaggcttatacacttgttgactgcctagagagtttcctgtataatcatcatttgaatatttattgatgattttagtcaccattatctgattcagtgaaacaactctttgggttgatttatttactagatttaaaaaattattttctatcacatataaatgggcttttacagccagatagtgacctcttgaatttattattttaaaatagtactgggaaatattacacatattcagatactttgactatgattattttgtatttaaaatactcatatcaataaaaatgttcagtaaaatagctattacttcatcccactatgtgcctactaccatattataggtttagtgtatagatatataaaatttatatttatgttaacaaatatttgcgtacccattgtgtttcaatgatctccagaaacaggatacaccacatgagatacacagatgaattaaagcttactaagagaccacaacatgggaagctaaatgtagaaaatatccataacatgaattagaatttgctaaatacagaataacaaatgagtcagcatagcagagtgctgatgatcgtggtatttaaagtcaggcaacactggttctcaatccctgcttcatcatttacttaattgggtactttaaatctcagtcacatcatcaactattaaatgcatgaggtttaagtgagaaaatgtgtaaaacatatggcactggcctgaaatatattaagaactcaaaaggtatctgttgtcattagttccatataatagatattggccatcaaaaaaaatttttaagaaagaggatatggaggagagagggcaaggaagggaggaaaaggggaaaaggtgagaaagaggaagaaagagagatcacgtcctcacatttggttaggaaagaagaaggaaggattaaggaaatcttcatgaagtagtggcattcgagatgtctttgaaggatgcttgggattttgcaaagtggagttaggaatgaaaggtatcttagacagaggatttaacctaatgttagatctcagatgggtcagttgaaaagtgtgtcctccagtgtagctgaagtgcatggtgtttgaaactgagaaataagatagaaaaagacatgtttgcagaaagccttaaatgccagcgtggtaagcctgtgcctaattcaacagatttttgaataaggtagtgagaaatttagtctgtgtcttacatcctagattaaggtggcagcattgcccagggtagagtgggaaaggaagaatgtgaggatgaaacttatcaagtagtctcttacaattgcattaaaattaatgagaaattcattaataatgtttaaagatggcagtaaacatggaaaggattcaaaagatattgcacatctggaacccagacttggcaacagataggagatattggagcaagttatgtagtgacatataactatgaaattccaagactccgtgattggaaaaatcgtaatgctattcacaaaactaaagaaatacaaaggaagacccagttcgtgttgttgatgataagttcagtgagtagagaatctgaagtaccaatctctaatgacagtgctcattatgcagctgataaatgtagatcttgagtttatgggagcatttcaaaatggaaatattgatttggatgtcaagtgcccacctacaaacagactgcagtgtagttgaaattataacttcaatgcattataaagaaaatagggaagacaatattggaagttttctagcatcttatcacttgaaagatacacaaaggaactgtataaaaatgtaaactttgtctcagtttgaaattccatgataatgagtatattataatttagagatcaaatagaaaaaaaagtaaagaagagtaagcaagattataaaaatagcagaaaatgcaataccaaagagaatatggaaagatgattttaactaagagtcaaacctccttgaacatggaccttgaattcaaacaagattctcatgttaatagttaaaaacaaaagcaaaaatcttgacagcatgctaatttgacattgctacattcttttgttttgttttatgaagcaaaatgtttcttattgttgatgaaacatagtctgtgcttcacatattaggcacactcccaattagtatgaagaacaaagcaatgtgtaatcacatgaaagatcttcaatggtgaatgaagaaaattctagttctttaaagtaaaagagcatctgacttaattattggatcaacctaagcgattaacataaattagaatttttaaataatgttgcatactcttcaagacatgacaggtgagtattctatcacagcactttttaaattaaaatctaaaatcctcatgcagtgaaataaatgcataacattcacactcgtattcccttcattatgagcaatctaaacttttctagcatagtgtattaccctttgtcactttgtattacttttggtccttcaaggtccaaaaatgagaaaaagttagccataacaactcacacgggtgtcatttattctttctgtccacagaaatgctgttttaaattatccagtcaaaaacctattgaatgcagttaattaggtctcgtatttctaagccaggcatgcatattgcccatctttcagaagacaaacatctaagctataattatcataaaaagcttatctatgagaattatactatccagtctcccaagttaatataatgcaacattgtataaaaacaggaaaatgctgagtgatattaattattacatgaaaatgttttaaaatgagcttgctaagtaattcagtggctatttttaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggtaagaatcctgctggaattagaatgctatgagacatgtttcttcttgtttttacggcagaaagcattttctgttgctatgtgtgaaatttaaaccagtggtgccaaatattgctcttctgcaacagtacatctttctgtcctgtcacccttataatatggtctttttttaaaaggaaacttgtaacttttactaactatgccagcatttaatgcacagaattatttttataccatttcatcagccacaacattagagagaaaaatccaactgaaaagagaaatgcacacaaaattaggaatactaggaaagcattatgctttaatacagaggaaagggaacagaactaccatttatggccattactctgaaaggctatgattccttctgccaaaagagagttctcttccattcagtattgattaggcttttactacagtcagaaagaagcactttcccaccaacgagttgtataggttggtcccaggaattcctctgaagctggaaaagcctaagagatgtattcttccctcatgaagtgagccatagctactttccagctcctcagtcctcagcagagcatctaccatgcaggaaaaaaaaaaaaaaaaagaaaagaaaagaaaagaaaaagaaaaagaaagaaaaattggggatttgactccttctagtgggctattctcttgaaaacacattctgtgaatttctctttggcttataatttgcttcttcatttacttcctatatatttataacctgctattttttaaagagtttggcacaactatgacttttaactggttgaattttagaaatgaatgaaaaaatgatcataacaatacttttaaacataagtttcttctcaaaagcctgatttattgtgaaagttaaagaatttcttaagaagtagagtttggagaaagcaaattttaaagttttggaaaactactaaactattaaaaattgctaaaaactatacaatattgtttttattatatttttcaagctataagtaaaaaaagatctttttaagaaatgatcaatggaatgttctaaattcataataaaatgtccccatgtttaaaaagagaagtttgtgtaccttattcaacctaggggcagattccatactgctcatggtgggattttgcatattcttatgacagacatattttaatttaaaaaaaaactattaatttttcttcctagttccacagttctacaccaaatttttactcaattcatcaccttttttctagctaaaagctgtcttaaccgttatttttataaagtgctagccatatcacatttactttcatgtcgtctttcaaattaaccaatcagagatcaatcaggaagtcctataactatcagagcatcagctctctaatatcttaaatcttagaacttatggctcccaccgtggaattctagacttggaacaactttagaaaaatcttcttagtaatgagaaagaaaatcacaagtatgcattttaaaagacttagaaagttctttgattcttctgtctcagaagataaaaatagaaagccaaaatttttaattgaacataaagttttatatctttgcagattttcaaagtatatttctaagcattagtcttaatttttatcagttacttcattgagtttccatttatataaaagggtacctaaggaagataaatcgtttttactcatccaaacagcaccttaaaatgttgttttacaaaacatagcaccaatttgtgtggacagatattctcatgacttgctatagctatagttcttgttcaaatatatgtttatttccttacagatcagactttttaaaaatattaagcaactatcatgatttactctgaaaatattattttcatttatatgtgcataaaagagaaaaaatatagttgcatgcagcttcatttggaggggggaattttttaaacaactatatatatatatacacacatatataattgaattataacattggtatgagacaggaaaaaaatcaaaataatgcaattccttgaaaatgtaagatttgtagacctggcctcaaggggtaccatgggggtggagagacacttattgtcccttgtaatttcctcagccccgacttagtcacttcaaagtagtacacagtctgagtaaaactcttgtattttttttgcaagtgagactgccaggcaagtttcctaaatcccctctgacaccatgatccacccctacgtagctgccctgaaatccctcctagatagaaatcctgtaacttccgctgaggtcttacatgtcatttttcatcattgaaatgtttctctttaatgggaaaataatcatcatatctttttttaaaaaaaactcggtcctgaatttcatactaggtattcttaattgcttattctacattgcttcatggaaagaaaaagagaggaagggagggaggaagggagggagggaatagaggaagacgggggaaggaaaattgtaaaatttctcaaaatcctaagccgtttcagagctggaggcctggctgtggtaatctgggctcaatagtgtcagggccaggactggacatcagttttcctggctctccattcagtgtttttccccttcgtggtggacaatgactagagtcagcttggaaatcttcaaaactcaaagctgactgttaagctaatttttttcttctgctttcttctaaaaactacatgcattatttgaaatccaaacaaatgtattcattgcctcagaatctgacagtaacacttttccactgtcaagaacaaagagtgtgaagaggaaaaggaggacgtgtgaaagtcccccaaaatccacaggtagaagacgccccatcctggtagaactggaaagacccgaactctgctcagaacaaagaaaactagagagtgactatgttatgacatattttcctcacacaatgaagaaaaatacccctaaggaattttaaacattgtgtttttaatttaaaaggatttcttttctcgctctttttttcctcctctgtcagctcaactgttgctatagttgcaccatagagctggacgtagttgtctcatagtgtggctcctctgcagcagagaaaaatgttaacgctaaaatggggacattgttgacctttgtggtcagtgacatcaataccctctatttctgtttgcaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtcttatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttgctgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcattttaaatatggtcttttgctgcctcatttgcaaatataatttcatataaacaatttagattttgagatagagcagtttttggttagtcctatagagcattccatccagatataaaactcatgttagtttaagtaaaataagggtgataatagtgcagtcactcaaatgtttcacttcctgtccttcttacccatctttacctactgaattagattctattctgccaaaaggcatcttttactgggaacaggccaggattcttgcaatggcccatgggcagggacaaatggaaagtggcagcctgcctgcctgtctgaaagtgccagtctcactgtaggaagtacacacctcacttaatattactgcttagatagttatgtgatattattgactcatataaattgactctctttgcactcttgtcgtggtgagggattttaacttttggagttggtaacacttagaaaacagttccagtaatctagaaaagagatttaccagggctacgtggatgccatcataatgtcttaccccctacctgaatctgatgagagtttttcactctgggagttctgggagtttagtagccttctgggaatattataaaagatatcccatgtatgtacacacctgagtcctcttcaagatactgaatgccaaatgccaggcagaaatttccttgatcgagattaaagaaataatcatgacctttgcatttttttctgagaaagagagggcaaaatactttaactgtttctgtaactactgtggagaactacaagtgaccagggttaggccatggcaatccatgattttatactagtttcttccttacacacatttctttctgttgtattcactttctatttcataccaagaagtctttcttatccatgttgtgtgtagaaaacataactcaattttacatatgttatttacagagagactcagaataaggaagaatgaaaaccacattattcccatccagcaacacaccaggagccattgaccctaacacacacattctcatggcaccttacctccagacatgattggggacataagaccggaccagagagtgtggttagtgagcacttcctaacgaatgtctgagaagctgtactaaatgttctacatatatgatagttaattttatgtgtcagcttagctgggctgcagtacccagacacttagtcaagcattactctccatgtttctgtgaaggtgtgtgttttggggttagatttacattaaaattagtggactctgaggaaagcaaattgcccttcataatgtgggtgggcctcatccaaccagtggaaggcctggctagaacaaaggctgacctccctcgagcaggaaggaattctccagcagactaccttcagccttcatctacatcattggctctttctggttgtatatcagactgcctttggacttgaactatagctcttttctgagaggccagcttgcaggcttcccctgtcaaagttgggactcatcaagcttccacaattatgtgtgttcattccttaaaataacaaatgaatttttttaactaaataaagtgtatcagttatgtttctctggacaatcatgactaatacaacatgtgttattacattggaatgttataaagatcacaggtaagtgctatatttttttccatttaaaaatgaagacataggtgcttaaagagtctaactaacttgttccaggtcatataactgtttagatatgtttgtaggtgcccttggttatgtctaatatgctacatgccttcatccttttgttcaaccaaccatttatttattcaacaaatatttatgaagcagctattatacagtgaaccaagcactggactaagggctgagggtatgaactcgaatgatgaatgctccttgtcttaatctgttagggctgctataacaaattaccataaattatgtagcttataaacagcaaaaaacaaacaacaacaacaaaaaaaaacatttctcacagttccagaggctgggaattccaagatcaaggtgccagtagattcgaggtctggcgagggactgttttatggtacagagattgcaccttatggctgtgtcctcacatggtagagggatgaacaggctcccttgggcctatttatgagggcactaatgtcattaaggagggttccaccttcctgatttaatcacctctcaaaagctgtacctcttaataccatcgccttggatatggaaatttcaacatatgaattttgaggaaacatagacattcagaccacggcactccctaacttcaaggtgcttacaatgtacaggggaaatagtaggtaacatatggtaaatgctaggaaagcaatcttgagagcagggacatcaaaggtatactgtcttaacaaggtgacaattaagccaagtttgttttttttttaaactttggctcttttatttagaagttttctcatgtattcaacaacttgattaaaacatatctctttaatttgggatacattgatttttcataaaatataatatttttaacgtgattatcagtattgcacagtgattaaaatttgggctttgaaataaacagaactggattgaatatgacagctgccactcattatctgtatcatcttggacagattatttaatctttctgaatatgagctcataaaggaatttcctaaataggtaacaagagaaggacacctcaagcagtgaaaacaagagagagcacagaagtttgagaagtctggaatgtttggaaaaccacaaaagcttgaattagctaggacaaaaggaacgtggttggaagtaaggtggagacagagagacaggtttggatcacactagaatccctcaaggaatcagaatccgcactttgttcactcattcaaaaatattaagtaacttctttatgccaagaacttcctagctgatagggattcaactatgaacaagacaaacatggctcctgccttactgggtgggccccttagtggatgatacaaaaatcaagcaaataaattaagtgcaaactatgataagtgctctggcagtaacaacaaggcctgagatggagttgaggaaggtacttattccttctagtgtgggcaggtaagtcctgatgggtgggaagaaaccaatggcatgaagaatagagagtgtgttccagaggtgaaacagcaattgcaaacgtcaagagattggagagcctgagttacttaaatgactgcaaaggtaagctgaggtaggatagtaaaagacaatagctaaaatctataggaaccatgaaccagaagcaatctgcaagatgctccttgggatgtcttccccctctcccactctgactggtgttatcaccttttctgtacagttaatgccaacatctatacctgtaagttggacttctgagtacctgagcacttgctgtatttaaatatttttaacttaattccaatatcaaaatagttatttccctactttttctgttccatactgttccatccagtcagttaccatgtctaacaattttacctctaaaacatctcctaaggctttctccagttttccatcgtacacactgccatgattcattcttccattatgtattatccagctcttgtaggaatatctcactcccactcatgcaagcactctcctagattgcttgccaacctgcatatcctatcatatttctccattgttataaaaccctcaagatttctccacgttttaacaaattaaaatggaattcaagaccctcctaggaaggcctcccactactattccaactatatgtgaccttccttacccccaaagtttgaggattagtatgtatttgaagtttgacaccctgctgcctcttaattgcttgtcacctcagacatccaaacctcaacttcccaatctgtaaagttggtattaaaatagtttgtaccacctaaggttaaggttattgtgaggataaaatgaaatagtgactcttcaatgaataagtattcaattactgtttttctcatttaaaaacatcctatagtgaaacactaaaaaacaaatgttttgaatatatttcatattttgtctcatgtatttttaagattaaaatgttcataccgggactacttgtaaatcttaaccattccctcattaatagtgagttaaatacaatgtttaatatgtattcagttaaaaaatgtttgtatcagaactcatctaatcaaattatactttataacatatggataatttcaataataagaaaacagtaactaagatgttacattatcctatgacagcatcacaactttatcttataaaatacttatggtagagctttgtcaatacattgaaatggcttaaaattttatgctgactttgtataatgtcaagaaataaattacttgtagatacttgagaatttttatataaatcttatgtttttaatgctgaaaaaaaaaatctagctttgttttaaaacttcattgaccaaaaaaatgccaaaattgaaatgtaatgaaacatctcatttaactgcacagaaatgtagtcaggtagaggttatcagctccatttcacagatgaaaaaacaaggcttaggagtttctgtgattttcccaagaccatacgttgccaagggcagagtttatatttaaacctgctccttcaatcactcactatacagtccatagtgcatgatccccatcttcactggagtctcttaaaacttcctactaatatgaaaatagttattcaccttacacacacaggatagtagaatctatatctgccacttgctgaacttggatacattaactagactgctcagcctcaatttcctcatctataaaatggagaagataatagtcatacacttaataagttagatataattactgttgttcatgagcgtagaaatttcaaatacagttttaaaagatatacggccactaactaaaatctacatttgctagactcaaagtcagatggtcatagtagtaactgatagtatgacttcctaggctaacatttgtcatggcaatctggaaaaaaaaaagtactccatgcaatggaaagatcaagatttttttttaagagtaagttaatcaactgggcacggtggctcacgcctgtaatcccagtactttgggaggccgaggtgggtgaatcacgaggtcaggtgttctagaccagcctggccaacatagtgaaaccctgtctctactaaaaatacaaaaattagctgggcgtggtggcacatgcctgtaatcccagctacctgggaggctgaggcaggagaattgcttcaacctgggagacagaggttgcagtgagctgagattgcgccactgcactccagctagggcaacagtgtgagactctgtcacaaaaaaaaaaagagtaagttaaccaattctgtcaaaaataaaagatcttagtaataaaatatatataattgaaaaggtgaatgtgattaaaatgaacatgtttatatatttatatattagtatataaatatgaaaatatataaatattaaatgatctcattttacctccctaattctataagctggttatttctatgttttttaaaaaggaaattaaaagacaaagcaaataaatgacttacataaactgacatgtttaattggaactgtatttggaaatgaagttaaattgacttgatattcaggcaatgccctttgtcagataatctttctgagcattagatagtttgctgtaatatggatatttggagatgcatttttcacttttgcatggtcttaggttaccagcaaatgggctggcaaaatcatgtaataatattgtctgaaaggtactgcccttaggaatgagtttgttacctggcaggatttggtctgcttctatcccatgaagttaatccaattaacaggaaagccattaaacacactagtatctacccagagctgtaacattttccacttactcacatatgtgcaaaattcagcaaactgcctgccgggtgaaaatttggacccagacccttaatggttctgggaagttcctgtagtctatagtgctcccctttgttaattaatatggtagcattaattaatatggcacatcttttattaattaatatggattttctgcttaaatttttaaaattacagatgacacctttaaattggatagtgctatttgcattggaaacaagcatggctgactgtcttgttgagtgtgttaacctttcgttagctgatctagagcatttataaactttgatactgtctttcatttactattcttctggtatgcactataaacttctacattataaaagaatccaagttattttgtcactggcaaatagtctatagtagtgagtcatattgatttatgaatctgtgcagttacttgtttacagaatttatatcgtgcttttttgtatgctgtattctgcaagcaccaagagccttctgtctgtttctgtctttctatggccctgccttccttattccactaccattgatgcattcaagtttatacgcttttggcagttttcaaagatttgcattaatcaacatatggatcaagacctcctctctcaccagtaattttcctttatgtgtttctactgaaaatgagatctacctgcctattaatagtgttggcttattcatctttcctggcttctatgatatccatctctatgaaacctaggtatttggtcaataataaaggaccaaatatattaatatatatgcatatacacatccatgagtgtgcatatatacatgtatgttaaaatttaagatgaatgaaaaggttaagtctgcatgttttgtcttggaagcataagaacctgagtggaagataagagcctttcaatttgatttatgtcttcaggcaagaaactcaaagatgcttatttcctcaattttagaagagccgcttttgagtaaaataggtagaaaggggttagggatttgggataggactgtagaaaacaaatcatgaatatttttacactccatttcagttttgcaacatttcggagaccacatcttgctcttctttcttataggctaggatgtttcaatgagacttcaaccagcatatgtggttggggtggggggaaacagtgacacctcattttctctttctcttttgagactacgcgcatgagtcatttttatcacactacaaagtcttgccaacaattatggccaataacattgctttccatcacaatataaacatgagctaacccttaaaactttgaaagtttcttaaagacaagaatgtgatgtctttatgctctcctctgctgaacatggaagtataggaatccaaggatctagaaaaccaagaacaccgtagataaaaacatgcatattaaagataaagggaaaaatattagatatccccaaatctttctttcatcctgacttctctaaaacccaaacctatatgtatatatttgaatacaaatgtatattttattcaaatacaatgtatattcatataacaaaccctaaactcaatatgtctaaagtttactctatctcttcctaagttcatatcttctcagccttctacatgtataaccgcttcagccttctcacatttgcttaggattgatcattaaatttgcaatgaactctttcttctctttcccccctacctcttccttttctttcctgccccatatcagtaaggatgtttgatttcaagtgacagaaaaccaactcaaactggtttaggaaaagaaaaaagaattttattgcctcacataacttaaaagcccaggaatagagttcactgaagtttttactgaattcagaatttcaaacagtggcatcatcagaactgtttcccttcatctctctgttcttctttatgtggctttattttcaggccacatgtaacccctgtagctgaaagttcatattatctttattgttctgcatagtagacagaataatgctcccccccccccactgcccccaaagttacctatatcctaatccctgaaacctgtgaatatattaaataccatggcaagcaggaatttgcatggtgaaatcctaaccaacaaggtgatggtattaggaagtggggccttttaagggatgcttaggttataagagcagagccctcgtgaatgggattagtgcccttataaaagagggcctagggagcttactcaccccttacagggtgtgagaacacagcaagaagttgctatctacgaaccaggaaataggccctcaccagacacagaatctacagacaacttgaccttggacctctcagcctccagaactgtgagaaatacctttttgttgtttataagccatccagtctatgctactttgttatagtagcttgaatggaccaagacaccttccttaaagaggatgttcatgatcatgaacagacctacatggaacttgtcatatagttaaaattttaagatgagttatttggtacagcaacagtaaaaaacaaacaaaccatattttgcatatgactatcaggtcaactgtttttacattggtgtttacaaatcaacactcttcttcaccatgctttaaataacagagatagttctacactcaacaaatagcaattattaaggactttcgggtggcaaggctgcccaaattatcatgaaattattgggctgtatgtataaacatttagcttttggatcaattttatcagctggaaaactgtagattcttttggtcgcacagaaaaaagatcactaatattatctcatatcacagggtatggtgcagggtaggcagcacaaagtctaattaggatgctgttacatctgctcaagcaagaaattttgagtgcctggactaataaggtagcagtaatagggttagggaggagggaatggattgaagaaatatttagcaatagggtttagactaacaacatatatttattaagagcctactagataccagccactgtgaaaatggaaaatatagcaatacggtgtcctacatttctaacaaaatgttgaacattttattttattgctattatgcaagtatagataaagccatccttaaattcgtctgggaagacaaaggatgcttcacagaggttatataccatgggaactgaattttctggagttggttcagaatgcagattctggaatcaaattccctgtgtttgaatcctggctctggctcttagctgtgtctttgtgtggaaggtacttaataatgtaaacctcacttttctcaattgtaaacagatgtagaaagaaaattactgataacagctaccacttagcagtcaccatgtcaggtactattccaaatactcaacagccaataatttatttagccatcacagcaatcttacgaagtaggtactattattagatgaggaaactgaggtactgatatattaaacagatttcacacaccacactgctggtaaatggcagagctaagatctgaacccatgcagttcgcctcccgaatccatgctgttgatcaatatgccactttcccaaggatcagctgcttagcattatcaagagatccaaaggggaaaatgcacgtaaagtgcttagcacagtgcctgcatgtagaacttgcttgataagtattagcttaattttatactcataaaattaaatattaataaatattggctcttcagattggtgtcactgggtggttggatctgctagttaggcactataaagagtacgaaggagggaaaaaggcagctgtcttgaagcagaaggccaggacctccatttccagcttctctacttgtaggcagtgggattgcctgtgctcatgcctatgcttcatgcttcatagcatggaatctttgaaataaacagataggagagcatggatttattcaaacaataatcattttcaaaggtccagcaatgggtcaggccttgggccaggtttcatggggaatacacaattggaataacgccttcaaaataagattagtggcttagagctcaggttctggagacagattttccaggttgaatactaactctgccaattggccacttgagactttgggcaagtcaccttacttctctgtgcctcatttctcttgtcaataaaatgaagaagagtaagcagattttatagggttgtgtgcagacaaagagaggcaagacctgtaggaacagggcaggggctctataaatgtgccctttgcttattcccaactctccacaccatcccacatgtgtgacctcaacttgcgtccttgccacctttcatcaatactaaagcaattgcccaaaaagtgctttttaaacttctttttttcctttttgtagcatagagtttttcaaaaataaattatatcaaaataaatgtgtaaaatacctccacgtcttagcatgtgctacttcctcattctgtattgctcttaatcatgccacacttggaggaaactttttttttttcttcaaatactatctcaagcagctgggacctcctctctgatatctctgaggatatccccaattgcaagaattaatcattcactcctggtaatatctctactccttatgcatatgcctattagtgcatcagagtaaaagcagttgtcatattcatctttgcattcccagagccaggtgcagagcctggcatgtagtagcctaggtacataataaattatcctttataacagctgtattgagctgtaattcatgtaacagccatctaaagtgtacaattcaataggttatagtgcatttacatttatgcaaccatcaccagaatccatttttatgacaccaaaaaaaagaaactcagtcaattagcagtcactccacattcctctctgcccaaccctagggaaacactaatctgcctctgatctctatggatttgcctattctggacatttcaaaaatagaatcatgcaatatagtgtggatattaccactgtactttgtgagtggcttcttttgcttagcatgctattttcaaggttaattcatatattagcatgtattaatagttcattttttctatggccgtataatattccatttgatggatatgacatattttatttacccattcatcagttggtggatatttgggtggtttttactttttggctattatgaataaagcttctgtgaacattcatgtagaaattttgttatggacatatattttcatttctgttgaatatatacctaaaagtgaaattgctgggtcatgtggtaactctttttaaccttttatggaagtgccagactgtcttctaaagcagctacaccaacttacatttccaccaacagggaatgagtgttctaatttatccacatccttgccaacacttattattatctgtactttggatcatagctatcctaatgacatgagatggtatctcattgtagctttggtttgcattttactgacagcttatgatgctgaacaacttttcatgtgttcgttgactttttctgtcccttcttaagacaaatgtgtacttatattgtctgcttatttttaattggattgtcttattattgagttgcaggagttctttgtacattctagactcaagtcccttatcaactgtatgatttgcaaaaatgtttcacattctgtgggttgtcttttcactttcttgatagtgtcctttgaagcacaaaagtttttaatttggtgatgcccaatttatctattttttaaaattgtgttacttttatttttggtataatttatctaaataactattagctaatgagagttcacaaaatttacaccaaggctttcttctatttatatttttacctttacatttgggtttttgatccgtttgagttaattttttttagatggtgagtaggaatccagcttcattcatttgcatgtagatttccagatgtaccagcccatttgatgaaaagaccaatctttccctcataagaaaatttagaattaaactccatactacgccacctctgccttcagggaatgcatagtactgtgatggagactggtagatacatgaaaaagtggcaatgcaacatggcaatgcaacatagcgatgtgtgagcccaaaagagtgcaagagctggctaggaatgtcttcttcaagtttccgaactgagccccgatattgaacatagagttacttacaaacaatgattctctcttcctatgatatataattaaaatgacacctgcataatgcctctattgtctccactcatatgcaattctcaacaattaatagacaccaagaataaaagcacagaggaagatggagatgtctcgatttaaaaagaagaaaatcttaagtgttattaaaactaaaaaatagctaggaaactgaggtaggtctcttgaaacacaagtcccattatcttttatgatatcctcctggtcacagataaattaatttttttagctttaaataaaaagccaccacattgcccttttttactcttctatcttgttttccattctgaatctgagtgcctggcttctctgcagatattgctgaaatcaccatactcaattagcaagaaagacctacactacctaccctcagatgcctggcagaaggtgtcccaaagcctataaggaaggcttaagaacgagcagagcttttcaatcacagcatcttatttcagcatctgagccgagctttgagtttggtacttctaagatgataaagaaaatattgacatgaaatgacattattcatcaaaattttgacatttatctctaaactacaatgtattaacaagataccccggaatcattttctttctttattctaatatgtatatgtacatgcacaaaaacatatgtggtattctgaaattgtgtttttccatcaacaaaaacaatcagcataattcttattcattgaataatatggaggtttacaagttctctaaaatttttctcataaagatctgaaatcttcttttgttgcataaaggaaagtactggggttatcctttgctttaatgtggagcaccactttgctgatgacctgtggaaggcattttccctgccagcatctggctacctggcagactccataggcagctgggaaagaaacttcagagctgcttctgggtcttccacataattagcctgtttataggccatctgggttgctttgatttcaccatcgccatttctcttttctgaagattttctgtgtgtctcttcctttgggactaaagtcattaataagtccttccttagttagggacacaggcttctttcatgtgtctggcaactctctgcccctctggatccatctcattatgaagcaccctacagaccaagggagggtggtgtttatatttgattatgctatcatcaaattaacaggcctcattagaaggaaattgcagatttggggctccctaatacaatagattcttagaaaacctcatccaaaaaataacaaagcatagttaaagagaactattgcaagaaggccaggattttagtgagggctgcttagatggatagagaagctgaactattggtgctgtgctaatcaaacaatgtcagtatgaacttaagctaatttgaatatcatgctattcccccttctcagaaaccctcctttctcctgttcagttatcaaatcctacttatctttaaaatccatatcaaatcttacccaaagtatgcaaattagctgcaaatgaggtcatagaaaggattttgcttgtatcagatgacattaaatgtgttttgattcaacatgttaaaatcaagatatttcacatcacaatcttgacttctaaatccctttgaaaactcagatccaacagccatcagctctagagcagaggttggaaaactatggtgaccacaccatggcctctagtttttgcaaataaaattttactggaacacagtcacacccatccagtaatcatgtggtcaatggctgcttccatgggtaacagagttgcagagctgagttgcaacagagacaggagggccttgaaaagaataaatatttgctatctgtcacattacaaggaaacatttcccaacccctgaactaggcctgaagcaactgcctctttaagtaggacatgagttttccaggtcaacagaccatcccaccacctacacaaaggctgtcatatctccagttgcctgcctgtcccctgtagacctggaagtctcttctctgtttacagtttttagaatctcttaacatgttagctcatgcttttctttctctctcctttaaccaagttagacccagattctccccactgtcaatcaaaacagccacatttatctgccctggttttgctgcagaaatgttttcttcctgtgcaaagtttgttagttttgtctctccagggcaggaacatttctttgcttcttttgcatttccctaaggcctggtgcaatgtgaataaaatagtagatacttagtaaatattttttatttgacttattgttgtcaacctgatgtactctaacctcagaaacaaataaagagtactaaaatacatgtttttgcttcagaaagaaaaactctaggggaagatgcacaacaaggggagtcacctgttgtctgcttcacctgaccacctgtctaccctctggaagcaagggcagggtgcctcaggagaagccatgtctgcctgcaagaagtcctctctgggtggcagcctcagcctctcagttatgagggcttgttagcacacacaccatgactagctccctgccttggggcaaactctgactacctcaattcacaaacatagttatataaaatagaacgtgcaataagaactagaacaaccgaggaacttggactcttgcgtcttctgaccagtgtatttttttcctctaggcagggaaaacgtaggaataaagcaagggaagttggttagatggttggaatgtttgctgacatcagtttcaaagagtccagagcactgaggctggcaagtcacctcccatgaccagggttcccttcctccatggtactttaacaatttctgtcttttgaaatcatttctgggatttcattactaaacaaatgcctttccagtgtaatatttcttttgtaaaacatgtcattgttagcatccattccttaattaggcctaggaaactgctatctctttaccatggccttatatctctggtttgattagtaaatacagatcttccaacctaaatctcagagctattttattttcaagatgaacagaaagaaatgtcagagagtcaccccagagttgtcccaagagctagctgcataactgaagtaggacaaggtagagtcagcacgctagagcagctaaactgaacaccaaactgaaaaccacagagagagaagaaaccaaatctccaacatgcaatggcctgctggaatcagaaatgctaggtccatgggcttatagtctaatttcactggggagattatccttcagtttgaattataatcacccaaacagtctctaaattttgatccctggcttcaaaagagcaggaagggatggctttctctagtgcaaaaaaaaaaaaaaaaaaaaaaacccatcacagtctgtcatggctgttgaccttggttcaatggccttccttttctctgggagcccatcagggctctgtgtagaggtgaaagatgatgcaggattttctgctctttagctcagttaaatccagtatcttgtctcatgaccaagaagaattaggcacatagacacattgaagggtgaggagggtggaatttattaagtaaaaggggagctctcaacaaagagaggggtctggccagcagcctccaatctcatggtggagtgctaggactttcacatacgagctgaagaggctaggctcctccccagcataaagcatgaattcctggtggctctaccctattctcccagtgtgcatgcaggcatgcccaggcaagccataggttgtatagaaaaaggtaacattcaattggttaaaagggactattcagaaagaatcagttgggaaagagcaggcaaacaggggcagttcttcctctgggtcacaggtttcatctggtctttcagccttcaggctgttttaggcttgaaggtggggttttgccggggacacttacctatctgcctaggcatctgtctgccttctgcctctatcagggacagactctcaaggagcaggcattcagagttggaggctggaggaggaaatgatggtgacactgggtctgctcacattgctaaaccaaagtaaatctgtgagtaggtgtagttcttaattcctacccacaaagcttggggccacatgtgtttccaacttcagaatttttcacattttaggaaaaaaaaatgtatacgctttatgttatatatacccccagtggggtctagggcaacactccatatgcaaggtcattaaatgcttctgaatcattgcatataatattcattctaaggttaatgaagactctacagtagactcacatgagttcagattttgcccccaaatgagtgctgatcaagttagttttactaataagtgactgccccatccccaaaaaccctctttatttttggagttctttagatttcagaattgtgggaaagagatcatggacctgtactgccaaataaatctataaattgattagcatcaactttagctcatctttagtgctatctcagcccagtgggaaacattgttgtgcctcaggaccttggttcaggcacagagaggttcccatggcacttgttgcctccaatctgcaggcccagaaggcttagactgttttcctctactcattaagtgagattcaacattcagtaatgtttgaggatgctttctcccagaagggaaatgctaccttttgattttcttcaataatgaagagtgagcattgttgattttataaattttactgccaaacattatggggacccagaggtgaattggtgagatatcagtaatagtaataataataaaagtgggaaataatagcagtaacaatggtactaacagtaataataattattaatacttattctgccattatgtgtcatccattgccctgacagctttatttacatgatttcatggaactgcaaaataagtcaatgacatagatactaggattatctcaattttacaaataaggatattgaggtattgataggttaatttacaaatttacaaacgttaatttacaaatttacaaacttagaaactttaacaaaccctgactttattggtgagatggtaatgttacagttggattagactgtggtctcagcttactggtttttaattgttgaagatagaaatctacgtcactccttccctccaaaaactgctcttcgatcattaagttttagaggaaactatagcagaacaatagaagccacctttccccaagtggttgattgacttattccagcaatttctaaccatatggaaaacatttgtctccctttcggagttctcttatatagaactaaaacaggcaaatttcactggtgtctccacagactttccaccactgttcccatcaactactggatgaaattagaaagtgtaagaaaagtcctcttgcttaaaggaactttataatcagttgccctgtaaaaggactaaagcagtgatcatgagctagccagcaatgtttagtaaatgtaatagggcaatttattgatcagattaaaggatgactccagttcaatttaacataagttgacaagcagttcggaactcacaaataattagacaactctcttgtgtttcctagaaacatgtttctgtctagaaaagctaaacattatgagaattttttatgtttgtactcaaaaaagtggttttttcctgctccaaagtcattatcaaatgtgttaaggtatatatttccacctacaggtaatgatttatcctcaaagcagaagatagaagtaaaattcagaatgaaacttacatttgcaaaaattctgaccctgtggaatgccaccataaaattaaaataaatgtgctttaatctccagtcataactgcttaacacccaaaaatcctgcccttcaaatattagcttataaaaaaagacattccactactaaaaaggtagtcaatgttcaatttatgcagtaatatctccctgccccccttttattctatttacacatgaatgtagctaactagaatgtatctgctgaaagaacaattattttccttattcacaggtcttgagacttcttgcaatcaccatttctatttgcccttattagaaaaaggttcaaacacagtaaccatagctgacaatatcatacacagttaccaaacatagtaaccaacaaaaatatatccaatatttggtagttgatatttcacaggaaattatttaatagtatcatgagattggagccagagaatgaaatcattcaatttgattatgtggatgacactgtttgtcctgagtctaatgaccaagtaatacatatgcaacatctatgtaaagaatgattgtagtcatgttaataattaagataatcttaagtgacttgagatctgatctgaccacttctaataaaaaggaaaatgttaccatgccaggcagatgactcgaactctacttttatttaagatgagctcacctagaaaaacgtaatgaaaaagttttcatcttccaaacccctccctatacctctctttttaaaattcatcagctcttcagagggctcagaattatatcccacttgattcggccatttcaggcaaaaccctttgtacagacaatttatttgaattgttcatgctgaactctaatagataagccaaaaaatcagtgtcaaataaatagataatataactgggaaaaaatatcatgctaagaaatacaagactcaattacaatctcttcatttcattcattgacacatttttcaagtagctagtaagtgttaggcattataataggcataggcaatagagagattatccaactgtaaattacttatttgcgagatctgtgtttcatatacaatttgcattcccagtacccagtacattcctggcacatagtaggttctcaataaatatttgctaaatgaatttgatcaaattatattgtgcaccagttttatcagatgctgagacagtcaccaggaatacaaagatgaaagaaagacacattcagaagatcaagaagcggaggagtgtcacttaatgatatatatatataattattataatgttattcacatatcatgtaatattttttgaattataaaagctattcatgtatattaaggaaagttaggggaaaaaaagaaaattttaaatgaactataattataccacctagaggtaatcactttgattacccagaggtatgtaccatgtgtatatctttccaggttcttttctgtatttcaaaggggtgtgtgcatgtctatgtttcactttttacaaaaatataatcacacaaaacctttctatttttaaaagaaactattaagaaagtaaagaggaagccatagacagggagaaaatattacataatattgagtgatacaaacataagacagagaacttattttcagaaaaaaaaattctaaaacgttacaactccagaaaaaggaaaattaacagtggccaaagatttaaacaaacattcaccaagagaagatataaaatcactcaatcacttttaaaaacaatttgacagtaccctgtaatcatatactgaccaattcttataggctgaatgtttgtgtcttcccaaaatttgtacgttgaaattataacccccaatgagatggtattaggagatgaggcttctgggaggtgatttagcttctggaggtgatgagggtagagcctttgtattagtctgttctcatgctgctatgaagaaatacctgagactgagtaatttataaagaaaaggtttaattgactcacagttctgcatggctggggaagcttcaggaagcttacaatcatg

SEQ ID NO: 1764 - DNA, 80626 bp, Homo sapiens
  D1S155E gene - 114971995 - 115012620 of chr1; NCBI Entrez Gene ID: 7812; Build 35; sequence includes 20,000 bases upstream of initiation codon and 20,000 bases downstream of termination codon of the gene
aaagatggaataaagcaccttggaatgtagtaagcttcctgccagtaaaagtattcaaatttaagttaaacagccacttagagatagtatccaacatccaatgggtagttaaactacaattgattttttttttccatttcaaatctttttattggagtgtggacctactgggggattgatgcactggacatagataattttcagaaatgaaaataacattgcttgcatcgaatcagatttcacccacaaaaatgactaaggccttaccagagttggcattggatgaaaccttagtcctttatggaaagggaatcatgtggccttctatttctgaaatagactaaagattactcatttattctctgcaattacagccatcagatcctttgaaatcttggaaggcatgagatgatgacatgagtgtaacacaaatccatattgaagagcccagtattttaaaattccccatgttcacataccaaagggttacttatgagctgatgcatatcacagataaccatatgattatcaacttgatgtctgggcaaagagcgaaaacagaaaatgcattctactcttcacttcttggttttaaatataagaaacattatatatattttaaaaaactgtattccttagtagtggtatcaatagaacatatacaactggaatgaggatccccttaaggaggccttttttttgtttgttttttaaataagttctagggtacatgtgcaaaacgtgcaggtttgttaacatatgtatacatgtgccatgatggtgtgctgcacccattaactcgtcctttacattaggtattcctcctaatgctatccgtccccactcccccaaccctatgacaggccccggtgtgtgatgttccccaccctgtgtccaagtgttctcattgttcaattcccacctatgagtgagaacatgcggtgtttggttttctgtctttgtgatagtttgctcagaatgatggtttccagcttcatccatgtccctacaaaggacatgaactcatccttttttatggctgcatagtattccatggtatatatgtgccacattttcttaatccagtctatcattgatggacatttgggttggttccaagtctttgctattgtgaatagtgccgcaataaacatgtgtgcatgtgtctttatagtagcatgatttacaatcctttgggtatatacccagtaatgggattgctgggtcaaatggtatttctagttctagatccttgaggaatcaccacactgtcttccacaattgattttttgaaagaaaaaaaaaaaaatatccgtgaatacaaggtcactttactatggcttcatgtctgaggactaaaattgtagggaaactccattgtaacttctgtatcatagattaaatgaacttttaaaaatcgtaatgcacatgcttttacgttctttatatctacagaacaggtgatttttccacctttgtttccttaatatcttcacaggaaattgagagtcagattgacagaatctgtgaaatgggagaagtgatgaggaaagcagttcaggtggatgatgaccagttttgtaagattcaggaaaaattagcccaattagaggtaagattgtagctaatttaggttcacagtatttcatagttttccgagtctggaagatatgccatcactatcccatcactgtaatatattgatgttttctgtgtgctcatgatttaaaattaaaactcctccttcatacccttttatacccttttgaagaaaggaaatatagtaaacagcaatcaatggaaataccaactatgtattggcaagaacttgaggtattatcatatgggaaggtagagggagtggaggggagaagttatatgtgagataaaatccttcatctgccataataagaagtgaagtagataatgtctaaaattgatgatcaggaaatagcagtataagcatattatttagaattacagaattaaataccaaaagaaatagataaaagtgttaaaagtggttgcatttggggtacaaagccaaagaactgcttgtataagccttgtagtcttgatttcttaaaagctatgtttatgtcatattttgattagaataggaatatgttacaaaaaaagttcggggtattagtgtgctcataaaattgttaaggaaaaacatttcaactttgagaggctgaggtaagtgaattgcttgagcccaagagttcaagagcagcttgggcaacatggcggaaccctgtctttacaaaaaatacagaaaattagccaggtgtggtggtgcacacctgtaatcccaggtactcagaggctgaggtgtgaggatcacctgaacctgggaagtcaaggctgcagtgagccacgatcatgcatgccactgcactccaaccgagtgacagagtgagaccctgtctcaaaaaaaaaaaaaaaaaagcaaagcatttcagtgaatggtttgaatgctgcttattacaaggtgctgtcctggggcctttgagaaataccagagagaaaaaaacagatacctgcccagagtctagtggaagggataaccctagtattatatgatattaaataatatgtaaatgctaggagacagatacaaataccgaaggaagcacttcatgtggtagaagattcgtcgaccacaggctctaatctcttagttactctagctgggacttccgcacatcttggtgaagctaaaaatgctttggtttaccagagttttctgcagaggataaggatgaagagcagaagctaccctctctagaaatcaaaggtagtgacaggtcccaagtaggaattaggagctagtgaaatgatagcatgaccttctatttatccccgatttacctcacttacggaaacagccctaaggaaatgtggggcaaattctaccttaatacttcaagtagaaaatacacgaccaccagattcagaccccagcaataccacatccaagttgtctgaatttggacaacttttaggaattttgtgagccagagtatcctcatctgaaatatatggatgtaggcaatgatacctaccctacagattattgtgagataacatatacagggcacccaagtagtacccagctacatgctcaataagtaatttctttccccctttccttccatttctctagaactgtaagatatccaggagaggagattaatcagagtgaaacgattattaggaattttttaaataaaagaaataatagtaaaactgtgggaaccaagaagaatataacagtgaattccttaaatggagaggaccttgttttttgtttctcctttgtaatcctaacacttggtatatagaaattactcagtaaattactactacaaaagagtatcattgcctacatcctacatgtaaatgtttgttaaatgaataaagtagtatttaaggaaattctcaactagtggattttttgtttccataaattttttaaaattaaaataatgttttctgctcctggctcaaaataatgtgttgttgtaatgcagttggacagtaaaaataccagaaataaacatgcctttttttttccagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacacaaaataaaaaaaacaaatataagtagtcagtttttcaatgttatcctactagttctacattctattttaatttttatacaatttccattttatagttaagaaccatcacttacttggattggatgtctttcattcctagcactaatagttggctttctttttttttgtttacatagaagcagggtttttttttatcttttttctttttttttgtttaagctatataaaaaggtgaggaagcagttttgttacctaatgaaaattattacactcataatgctgtgtaggcaacattgagattcaaatgcccagtggtcaactgggttcactcatcaactcattcccgtcccagtttactcacatttcaaatttataaatttcttcatgttatactattctatttagatttgcccagaattagttgaaataatgctaaacctgtcaatattttccagtaacattaagcaccatactgcatgggagagacacagtactaaaaagagttgttagtgctttatgtgagtgatatttctttcgtaatgctataaagaactacagttaaaataacaaaatattttaaagatgtcctaaaagcatctgatcccagtaataactaatggatgtcatctagagcagtgggtgttaatgaataggtatatgtcatttaagaatttttcaaatttctgtttgatatcctgcatagaatttgacaaaaaaaacacttccaagtgtgagcattttttatttcatttcccaagagtaagtaagtaactattagcccagccatctgcctcgaagtataccttaagtgaccccataaatccattcaagaggcaggtactctataccatttggcagccacggccaaacctaccatggccagatttcagtgaaaatgatgaagtaatcaaatcaaggtataatatggtgtccctttatgtgctttatgttcctttagagctgtttataaagttctttatatctcaagtgttaggataaatcgacatactaacttttccccctgcaaaattaaaagcctgaggtacaagtctaagaagcttttagtgctctacataatataaattctggctggtgttaatgctatgaagataatatgtagttagaaaattgagtcggggaggaatgctcttcattttaagtggattttaaagtttctccttgagtggatgaagaacttgcctggtttgcaaaaatcttagttcaaaattatattttctaacaaaaactgcattttgagaagataagctaattttactcagtagtaagtcaaatgaggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccattatagtatgtataagatacagaagagggactttaaacttgagaattcaatagagataataaatgggtaggagggaaatagaaaactttggtgccacaaaagcaaagtatgtatggtattgccaataatagctaccatctattgagtgctttactacctgtcaggtactgtattatataaactccattttaactgtacctcattttgcagatactcaggcacaaggaggtggttatttgtccaaactggaaccaagattcaaacccagacagagtcttaagcacatttttaatcactaactaacttgagatgcctaaatgccaaatactgttgggagttcaagtggttcttgattagcaaaatctatttttattagtgcaaaagaaacaccacagcttataaagtattatgaattcaataaatggagtcttaactaatgagatattattttctagaatggtgtagctgagagtatgtgtgattcaactgaaaggaataatgtttaatcagtgactcttactatatacaggaaaaggtgcagttctgtctttcaaatctgcctccttaccatattggcttacatccctcatgctgttttcttgtgtttgctagaaagttgttgccaagccaaatgtcatggccatgttgaaggcaaggaagaaaaaatggaaatggcctgtgccagctatatatatcgccttttatgagggaaagcaaagctttctcagaaatcccaaatggattttcccttgacttaattgcctgaccagttaaatggccactggtacctgcaaagaaagcagggtacatagctgtcccaaataaaatcagtattagcaagaagaaagaatattgagaaagcaattaacagtgtctgtgactgtgacatgtctgtgactttatattgtcaagtcctttccccttgaatatagttttggaagaattagctgaaggagtgtgttgacattgaatggccaagagaatgggctgtagcagacatctgtcatttctcttttggctgcccagtatcctaactcctgtgtttaaggaatccctcacctaatgaggcagagcatttcttcctcctaaagaatttgaaagtaccaggtaatgttttctcagcctccttttgcagctaaggaagaaacatctgccttcaattttaaaattagtgatacaaagaaggagggaaccatgcagattcctttgaagatggtgattaacaacactactgcattcatctccacagaggtacagcaaaagtgatttagttagcgataacctctaattctatttttttatttttattttttgagacagtcttgctctgtcaaccaggctggagtgcagtagcactgtcttaactcactgcaacctccacctcctgggttcaagcgattctcctgcctcagcctcccaagtcgctgggattacaagtgcccaccaccatgcacagctaatttttgtgtttttagtagatggggtttctccatgttggccaggctggtctcgaacttatgacttcaggtgatccgcccgccttggcctcccaaagtgctgggattataggcgtgagccactgtgcctggcctgtaacctctaattcttgtttgctggctgtcctagagatcctgagaattacttttaataaaatcatttttttgctgttattaaaactaacctgaattgcctaaaaccaagaactctgcttgataaaataagcatagttttaggaacagccatgcagatataaattttatcaacactttatacataatttgggacttatatttaaatgtaatatttgatgcttataaaagggtaaatggggaatgcaaataaattatcaagcataataactcatcacctaacttaagaataacattatgagtgcttgtattttatctatttgagctcttctcctatctttgccgacccccccgctctctttttaatagatttgttcgaatgtagaaagacctaaaatacatatgtatccctaaagtgacttattttatagttttctttctttttgaacttcaaaaaaattgtatcatactctatgtagtctaaggatttggtttttttcactcaacatgtctctagaattcacaagttttattgttttatagctgtcattttcattgatgtatatttcattgttgggttatacaacatattgttaaggaatacatacatatataataaattatacattttttaaaaaaatccttgctaatattttacttactaatttttaattctcccttcctgtgtctcatttatattaaacacatttaactataagatgacgtatttcacattctgcagttatttcactgataatatctcatggcaactttcagagtgaattaaggggtattatctgctaatataggaaaaagcagataatgctttttgttttgtcactcctgtaatgctgaagaggaggcagaaccttcagagtttcaattagctacaacttcactcaaaatttcatctaggctcgtataaatatgtgtggaactaattgatgaatgtttgtatgttactgattgtaacattcatttctatttcttattttaacatctttgatattgggatatgtcttacacaggtacaggttccgatgtggttgattgtaagcatatacaaaattggtttgcacttatggtggatgactggacaaaggcaatctgaatatttcagtcaaactcaggaccatgtgaaaaaagaacatgggttttggccattttctgttctttccattgacacctttttatcaagagtgtgccaccacacaaatttggagtatggctggctgtattagttttctactgctatataacaaattaccacaaataacagtttagagcaacatccacgtattatctcacagttctgtaggtctgaagtccatgcagggctcaaatgggttctcctctcttgcactcacaaggctaaaatcaaggtgtcagctgaagccagcatcccgtatgaggctccagtctctctcccacgttcacgtaattattgacaaaatccatttcagtacagctctacaactagaagactctcttcaagggcaacaggaaatatctctgacttcttgtctcccacctctagactccttttttttttttttttttgagacggagtttcgctcccgttgtcctgttgcccaggctggagtgcaatggcgtgatctcagttcactgcaacctccacctcccgggttcaagcaattctcctgccttagcctcccgagtagctgggattacaggcatgtgccaccatgcccggcaaatagactcccttttaagaatacacctaagtcaggtccaaccagaatatctccctcttgattaacccaactgattagagatcttaattatatctgcagtaatccctttgccataaaagagatataagtgatacagcttctcgtatccacgtttcacctatgcttaagatgggatgatacaagacacgtacgacaccagtgggaatcttggtggccagcttggaattctacctactccagtggcttttagcagctcagaataaaatcctggaaaccatgaagcactctttgaggaaatgctacattatcagtgttcttggtgggctcaaaataattctatgtgggaaaacctggatatctatgaaccagaaagattcagcaagatgcaccaatgaatagtgggctaaaatttaagcaaaaacaggatatttatatacgtttgcgttagttcctagagttgccattacaaatgaactcaaactgggtggcttaaaacaaatttattctttcgtagtcctggagactagaagtctcagggagaatgtgttccatgcccctctcctagcttctggggttgctggcaattcctgttccctgatttctagatgtatcacttcaatctcttgtcttcatatggcattctccctgcatgtctctagtcagtgtataaaattctctcttctaaggacgctactcattggattcaggcccactctaatccagtatgactttatcttaacttgattacctccacaaaggccctatttctaaataaggtcatattctaaggttctgggtgggaatgaatttaggggggacactattcaattcagtacattaccaaagcattgccctgcccccaaatactcactaattacaaagggaaaagtagtaattttacaatggagaatcctggcagacatcaactgattaaggtaaacatcattaataatacacttcaatggctggacaaggtggctcacacctgtaatcccagcacttcgggaggccgaggtgggtggatcacctgaggtcaggagttcaagaccagcctggtcaacatggtgaaaccccgtctctactaaaaatggaaaaattagccgggcgtggtggtgggcgcctataatcccagctacttgggaagctgaggtgggaagattgcttgaacccaggaggtggatgctgcagtgagtcgagatcatgccactgtactccaacctgagcgacaagcgtgacctcatctcaataataataattgtaataatacacttcaacattatatacccctgatattgagcaatgataggcacataacctctgtagtgttccaaataatgtataacctcaatctaatcaagagaaaacatcagacaaaaccaaattgagggaaatctgcaaaatagctgactgatactgttttaaagtatatatatagagagagagagagagtcagtgtctcactctgttgcccaggctcactgcaacctctacctcctgagttcactccgctcaatgcaacctctacctcctgagttcaagcaattctagagcctcagcctccagagtagctgagattgcaggggcctgccaccacgcccagctaatttttgtatttttactagagacggggtttcaccatgttggccaggctggtctcaaactcctgacatcaagtgatccgcccgcctcggcctcccaaagtgctgggattacagccatgatccgtcacacccagcctgtttcagtgttaaagttgtaaaagacaaagactaaagaactgtcatagaagggagacaaaggagacataaaaactaaatgcagtgtgggatcctagatttgatcctggaggagaaaatggacattgttggaataactggtgcagcccaaattaattttgtatttcaagtcatattatcatgtcaaagttgatttcctagttttgaaaattgttctatagttatgtaaggttaaaataggagaagcaagtacagagtttatggaaactttctgtactatttttctacctcttctgtaagtgtaaaaatctaaaaaaaaaaagttcatccccctgatttctaatgaggctgggtataatttcaagtatttgcctatacaggttttaaaaaaaatatggaccttcaagtattttctccattttccttttctttccttttggctttttcttattaatgtattatatattcatgataccaatacattttttatataatgcaaatatactagtctgttgattttttaaacttttttatgttgcctcatgatgaatggaatttttaaaatatggtcaaatttattactgaaaagaaagagattcagaagagttagactttgtgaagaagttttaggaataccttaacaaatttattttgccatttttttttttttttacttcatatacacacaaaagggagacatgatttaaatctatgtctaggcagggcacaggtggctcattcctgtaatcccagtactttggaaggctgaggcaggaggactgcttgagcccaagagttcaagaccagcctgggcatcgcaaaaccccatttctacaaaaaaatacaaaaattagccaggcgtggtggtgcatgcctatagtcccagctactcaggtggctgaggcaggaggattgcttgagcctgggagatggaggctgcagtgagctgagatcatgccactgcaatccaccctggacaacagactgagaccctgtctccaaaaaaaaaaaaagtttaaaatagccctttcaataaatataaaaattctaagtagtgaaagttttatttcataattgtattagtcagttctcgtgctgctataaggacatacccgagactgggtaatttataaagaaaagaagtttaattgactttcagttctgaaaggctggggaggcctcaggaaacttacaatcattgcagaaggggaaacaaacacgtccttcacatggtagcaaggagaatgagtgctgacaaaagggggaaaagccccttataaaaccatcagataggctgggagtggtggctcatgcctgtaatctcagcactttgggaggacgaggtgggtggatcacttgagggcaggagttcaaaaccagcctgatcaacatggtgaaagcccatctctagtaaaaaaaaaaaaaaaaaaaaaaaaaaaaaaaaaaaaaaactcaaaattagctgggcgtggtggtacacacctgtaatcccagctatttgggaggctgaggcaggagaattgcttgaacccaggaggccgaagttgcagtgagctgagatcgtgccattgcactccagcctgggcaacaagagcagaactccgtctcaaaaataaataaataaataaatacaaataaaaccattagatattgtgagaactcactcactatcatgagaacagtggcacaggggtaacagcccccatgattcaattacctcccatcaggttcctcccacgacatgtggacattatgggaactacaattccaaatgagatttgggtgaggacacagccaaaccacatcactccgcctatgacccctcccgaatctcatatcctcatatttcaaaacatgatcttgcctttccaacagtcctccaaagtcttagctcattccagcattaacccaaaagtccaagtccaaagtctcatctgagacaaggcaagacccttcccttatgagcctataaaatcaaaagcaagttagttacttcctagatacaatggcggtacaggcactgggtaaatataccctttccaaatgggagaaattggccaaaacgaaggggcaatagtccccatgcaagcctaaaatccattacaccaatcatcaaaccttaaagttccaaaatgatttccttcgtctgacttgatgtctcatatctaggtcacattgatgcaagaggtgggctcccacaaccttgggcagctccacccctgtggctttgcagggtacagcccccctcccagctgctttcacagctggcgttaggtgtctgcagcttatccaggcatacggtgcaagctgtcagtggatctaccattctggggtttggaggatgatggccctcttctcacagctccattaggcagtgtccagtggggactctgtgtgggggctccaaccccacatttcccttcttcactcccctagcagaggttccccatgagggctccacctctacagccaactaatgcctggacatcaaggcatttccgtacatcctctgaaatcaaggcggaggtccccaaacctcaatccttgacttctgcacactcacaggcccaacaccatgtgtcagctgccaaggcttggggcttgcaccctctgaaataatggcctgagctgtaccttggccccttttagccacagctggagttgaagtagctgggacttaggacaccgtgtcccaaggctgcacatatcccaaggctgcacagagcagggggtcttgggcctggctcaggaaactatttttccttccttggcctccaggcctgtgatggaaggggctgccatgaaggtctctgacatgccctggagacattttccccattgtctggatgattagcatttgtctcctcattacttacgcaagtttctacagccagcttgaatttctccccagaaaatgggtttttcttttctactgcatcatcaggctgcaaattttctaaacttttatgctctgcttcccttttaaatacaagttccaattccaaaccatatatttgtgaatgcataaaactgaatgcttttaagagcacccaagccacctcttcaatgctttgccacttagaaacctcttccattagataccctaaattctctctcttaagttcaaagttccacagatctctaggataggggcaatatgctgccaatctctttgctaaagcatagcaagaatcacctttattccagttcccaacaagttcctcatctccatctgagaccacttcagcctggacttcattgtccatattattatcggcattttagttccaaactttcccacatcttcctgtcttctgagtccccaattctctaggaatttccaaaccttcccacattttcttcttctgagccctcaaaactgttccagactctacctgttaccagttccaaagtcgctttcacattttcgggtatccttatagcagtgacccactaactcctggtaccaatttgttgtgttaattcattctcatactgctataaggacacacccaagactgggtaatttataaaggaaagaagttaaactgactcacagttcagcttggctgggaaggcctcagggaacttatgatcatggtggaaggggaagcaaacatatccttcttcacttggtggcaggaaggagaatgagtgctgagcaaaggggggaaagccccttataaaaccatcagatcttatgggaactcactatcacaagaaaaggagcatgagggtaactgcccacatgattcaattacctcccattggatccctcccatgacatgtggggattattcgaactacaattcaagatgagattcaggagaggacacaaccaaaccatatcaataatgaaaatggctacatattttcttctagagctttagggttattttatttatttatttatttttaaattatactttaagttctagggtacatgtgcacaacgcgcaggtttgtcacatatgtatacatgtcccatgttggtgtcctgcacccattaattcgtcatttacactaggtatatctcctaatgctatccttccccccctcccccatcccacgacaggccctggtgtgtcatgttcccctttctgtgtccaactgttctcattgttcaattcccacctatgagtgagaacatgcggtgtttggttttttgtccttgcgatagtttgctgagaatgatggtttccagcttcatccatgtccctacaaaggacattaactcatctttttttatggctgcatagtattccatggtgtatatgtgccacattttcttaatccagtctatcattgatggacatctggactggttccaagtctttgctattgtgaatagtgctgcaataaacatatgtgtgcatgtgtctttatagcaatggctacatattttcttattagtaatccataaatgatgacctaccatacaatcactactgccttggattcaataaaataagtgaaatttactcattcaatgaatattgtttaagtatttactgtatacgtaagtcactgtgccaggttttggggatacaatgatgaactagagaattgaagcttatgctgtagttcagagggatgagcaataaacaaatggaaactgatagtttagtgggtacttttactttagaaaaggcctttgtaaagtggttaacatttgacctgaaatctgaatgatgagaaagtgcccaaagatttgggctagaacattccaggcagagacaacagtaaattcatgggccttgaagtaggaacaaacttacaatataggaagaaccagttaaccaggggttagagaatttggtggggactatatcattcagggccttgaagagcacagtaaaagagtttggatttatgttaaatacaattggatttcatcaggattcagtttaagttaaattataaatattctgttgctctacccttccctctattaactgactcccagagctacaatgttagatggttacttttggtgcagcattttagcatgtccacataattatcctattaagtgcaattttaacattttaaagggaagcattatataaagcttttgcattcttatttaaattctaatattttattacattagtggtattatgttattcttatttatataatgccctttaactgtttagaggctggttaaagaataaaaagttttgggttgtaggcctataggaccaaatcttaattatttacattaattcttatggaaataattcttctttatgaatgtttttgctctagaagtattatttctgttctgaaaccttggatgtggacctctttaccatgcactattatcataattttatcttatttaatgaaatattttttaagaccttgtctcattctgttgcccaggctgaagtgcaatagcacgattatggctcactgcagccatgacctcccaggcttaagcagtcttcccatctcagcctgctgagtagctgggaccacacatgcatcaccatgcctggctaattttcaatttttttgtaaagacggggtttcgctacattgcccagtctggtccggaactcctgagctcaagcgatcctcccaccttggcttctaaagtctgggattacagttgtgagccaccgtgcccagcctatcataattttataaaagaagatcctctttagtttccctaaacagggaggacatgtcagaataaaaacaactcttaaaatctggaataaatttagccttatttaatttttttaaaaaagctctatattgacctaatttttctcattcgacagagaaatgacaaaaatctcacccaccgctgctcaagaaaaccttacaaactgtaagaaatgcttacttttgattctaaagtagacttcagagataatgtacttattgatgattgtagagggaaaaaaagcacacaatcattatcaatttcattgtctaagtttttcagagtagaaaactaaatatgatgaataactaaaaataatttctcaaatttttttctgatggttccttaacagactatcttcccaaaatccatgtcaccctgttgcataggagatggttttccaaagtgatttaacaagtttctgatttaatttaaaaaaaaacataaaaagataaccacattttttcagtttttgatttgacttcaaaattcatctgaaaaaaatcattatgtagtgatctaataatgaaacctacttctgtttgtgggttttacttgtagaaacagtaaatcattttaacttgtgatttatatcaaattgttccacctgttactttctttaatgcattagaagctaaaatgtatatttctcggtttatacagactgcattttgtgttaaatgtaaattgatattaattttggaacaaggaggaatttaaaggaatttaaagacaattgggatatattcagaatgatgatgatgaaatgattatataattaaagaaggttttcagaagctatgtgtaatggtagaaatcaaggctttatccttccttattaatagtaattgtattgatataatttagtaagacttttttttttttacatttcctattgctgtgatatttgagaatgtatactaaaagtagaattacctaattacctaattagtttcacatgacctcatatctagcgcaagagcctggtacagtttctctataacattagattagaatacacagaccagctgtattgcaggaaggggagatctcgatttaagaactgggtgaattaaacaaaacagctggtttgaaatatttacattctgggccaggcgtggtggctcatgcctgcaatcccagcactttggtaggccgaggtgggcggatcacctgaggtaaggagttggagaccagcctgaccaacatggagaaactctgtctctactaaaaatacaaaattaggtcgggtgcggtggctcatgcctgtaatcccagcactttgggaggctgaggcgggtggatcacgacatctggagttcgagaccagcctggccaacatggtgaaaccctgtctctaccaaaaatacaaaaattagccgggtgtggtggtgcacgcctgtaatcccacctactcaggaggctgaggcaggagaattgcttgaacccgggaggcggaggttgcagtgagctgagatcatgccattgcactccagcctaggcaacacgagtgaactccatctgaaaaaaaaaaaaatttacattctgtagtttcccagaaatatattccaatttctaacaacttatcatactgttgtccagtgctatttattcaacaagcttttgagagttgttgagagcgggcactgtcaacaaccagggatgcaaagatgaatttcataagctctgtgctagagtattactacctagtaaaaactaataattacaatagagtgagctatgaaagcattgaaaatgaagcaaatatttgtgcttaggaaagcgtgggaaggcatcaaagagagcaaaaaggcagttttgaggtgttatacatgggactggacaccagcaacaaaggtggtgaggaaatttttgaacagaaatgggacacggcctcctcttagaattcaagaggttgaattgaaggttgtctttccttcattgcacttattccaatgtgtatgtttagatttgtttttgtgatcatcaatgatgctagactaaaagttccttgaggacaagtctatatccgattttctttacaactgtatacttcccagtggttacacatacaacatgtcaaataaatgtgttgtaagcaaaaagtgggtaggagagttctcagaagactggctgctcattatttatccaatactgtcaagtgagagagccagtgaatctgtgaaaacagaagcattgaatctgggaaaagcattcctctcaccagaggagcatgctctactgtctggcaggggataatccattgaacttcctgtggtcataattacccatttttctccttccttcttcccccattggatgaatcatctctttgctcttatttcaaccttttaattactgatccaccctctttgattacctgacacaacaggaatatctttcgtaacttgaaaggtcagttgactgaatttgtttcattttgtttagtgattatgcagccttgctcactcttgtgcatctgttgcaatgtttttcgtggaaaacaaaggtctcatttagatttctaaattaccttgctacaaagctgactctatactaatgaaattcctctaaaacagtagacgtaagaaagaatgcttgcactataagaagaaacgagtgtgaggtccttccggatttttgctgggaaaagataaatcattttttatgactcctgaatatgccatcagaattgttggccttcaaggtttaccccattattgtgggctaaaacgtattcaaacgctcgaagactagagacgcctaaagccacccgccacccctagtgtccaggaggagtcagtaaacaccgagattgcttcccgcagcacacccaagaaggaatgtaatgtaatgcagccaccatgttggttgtggttaagtgcagcaaactgcttggcgtcacttagccctgctgcgcaagcgtgttgagagtacgcttcactccgccccttctcgtgcacgcgcccggagcccgcaactctcgcgagagaagcgagatttattcctacgtaccgggccgtgctgcttatggcggcgctggagagggggcgctgagctgttggggtgagtacgacctcagggtccaactgggggtagcagaaacccaggggaagggctgagaataagaccaaggctaacgagaagccttctgagtcaaggtgggcactcgtagagctctaggtggggaagaatgcaccccgattccctgccctgggctttttcatacgtctcccgttcaactgcctgggcctcatgtcaggtcgcagagctgaaacgaggagttgaggccagccggctgcgcgtggtggtagtggtggtggtgactaaagtggggggagggagcgaaaatggaggctccgacagcagccaagatggaggcagagggtgcggggctcgggcgcggaggctgctgggatctgtagtctggctgcttccccatctgcggcttgtctggggaaacgggaactacatgtcccggcgggcggggcgagggggtggtggcgcggtcctttgtgtgaggttggaagagcctgagaccgagaagaggggcctactttgactctggaccctgtagtttcctggccgttacctgcttgggaatctgactaccagtaccagagcgcagtgcggcagtggcgccttctttgtgtatagactgagaccctgctccatctagatatcttaggggaagtgtttaaagacacctttccccagccacatctggcacagtagtgtggcggaattgacatcgttactccagtcacctagagcagggtctcagcacccaaccttcccctcattgtctccccttcggcgtcttgagaaagggaaccagtccctaatcttttaggcacgtggctcccacccctctatcttggggaatgggcgtgcgccctgaaagctcagtagtgtcctcccttccacctcctgtagttctcatggtgccagcgcctggcccacccacattgtgcaatgaacggcctggcttcgtcattctatgtagaatgttttagagttcccccgtcggagacagcttcaaatttttgccatgctattttatcaatacgaaatcttagtgccaaggttcttttgctttaaggttttcccttagaaacacccagatggcggccgtcttgcttaactcacaggtgaagcagagaacgctccctgaaacaggcttgaatctgcaaagaatatctgaacgttgttgggcaagttaattttcgtgttttgcaccttaaatgagtaaaagaatatggcgctctttaaacagttgggagacagggcggagagggagaatgctcaaaggcactgtggtagttaaatctttttgagaggcttaaattttcatcaggctggtatgaactggcagttctcagccactgctactaacctacttttttagaatgtaggtttcaaattatagcccacagatataagctactctatactaaaatgctgagtaattttcattttgagtaactaaaggcaaacattcttgatattgcattgaggagcactataatacataccttggttttcttttggtactaaccaataatggatatccttggtgtgggtaaggaggggctttatatacttcagtagggatatacctgagtcataaaacttagataaatatttggccttctttttgtttcgttttagccctgggactaaaataaaagagaaggtaatagtttggttttgcagctgttctggatgtttaccatcgagatgattatttatagcagctgagttgaaaactaaagtatttgaggcacagaagataggttttctttttttgtaagtactgacttaagtgtgacctttagcgagtgtgggtgaaaatctggtaaagtcctagcaaatcaaaattgaaagcgtgaaagctgacgtgcagtctggctttaccctctacccttattttcccttctccccacctgaagacacatcgtgtagggccatcgatttttgttttaaacaaacaaaatgctaaaatatcaaattatgctggagcattcataacatgaaatttagtgttccagtgtttttcattgtacagttcagtggcactaagtctattgaaactgttgtgagagccatactttcgacaaggtagttaaaacatggaaattttggaacgatgttcttttggacagatttttgaggagttgaatttcaggactgtattgcaaaatgagataaaaatcttgatcttgttaagtaaacacaaagaattgatgtgccttcttcttagctttgtccttgcagaaaacagaagaggaagcactttgagatctattttgtaagctttaatagctagactgttgtaagtggtgaaactactatggtgagagtgacttgctgttaaatcccttctgcccagtcaggattttaaaaagtcctttgttttgatattagaatgttttccacttgcatgtgtgggtacctagttaaaaacaacacaaaactttttaatattttaatgtccttttatgctgaggtaaaacagtgtgtggctgaaaattatcagtttcccctatgttgcacatgtaagctatccgttgatttgcagctacagccggtacataaccagttatttgcacttctttttctccaatttattaacaacaagcttctatgctagatactgcctacttttattagtgaaaatctttgctcaagacccttacatttacttcctgttgctaattggcacaatagtgcttttttagacccctgctcagtttatacctactctgtggaacatggtagccgccagccacgtgtggctgttgtgcacttgaagtgtgactagtttgaattgaaatgtgctgtgattgtataataacattggatttcaaggaatgtaacagtgtcaatttttttacattgattgcctgtagagaataacattttggatataattggttaaataagacgtttaattaaaattccttctgtttcttttgactgtaatatggttactagaattataattacactgtatttctgttggaaactgctggtctgtggtgttttctgatgtgtctagaatgtttcttcagcatcttcccacactgccatttgtcctgcttaaaactattaggtttctgggtgtatatataagcagttaagtgatagataattttaaatatctcagtagctgtttagataattaatccagcacagttgttactacacagatacaaaaagatagttgtgtcagtttgattttttatttttactcaacagatgacttaggttggttaattatctagagtttatcgtttaccttagatcctaaagtaaaaatgaattaagacctattaagcacttcagttataaaatgtggtgctcaatgaaatgtcaggcaatagagaaacttttcagtcctatgctacctatttgggtctttgttttttcctgcctaaaagaagatactgcctaaaggaagtgggttaggtgagcagacttttgtagactggcttagcctttcattaacttttcccgaagtgagtgctgcacatactttcaaaataataaactaggtagtgtgatacattttagatggattacttaccacataaatgtgttagtttaacctcttcatttagtgcccactatgtcatggcttatgctaggcctttgaggtaaaacagccgaggaagacatgaaataaaacaggtggtggccaggtgcagtggctcacgcctgtaatcccagcactttggggggctgaggcaggtgggtcacttgaggtcaggagttcgagaccagcctgaccaacatggtgaaaccccatctgtgctaaaaatacaaaaattagccagccaggcctggtggtacacgcctgtagtcccagctactggggaggctgaggcaggagaatcgcttgaacccgggaggtggagattgcagtgattaagtaataatactatttccatgctgagcaaagggaaaaggagttgattacttagcacacagtatgattctcagatacacatttaaattgttccctagtgtttttattggtaccctatggtgggtttgtgggggcgattgttttgagtcagcgtcttactctgtcgcccaggcaagagtgcagtggcacagtcatagctcactgcagcctcaaactcctggattcaagtgatcctcctgcctcagcttcccgagtagctgggactacaggtgcatgccaccacacccagtgaatttattttttatttctaaaattttttgtagagacagcatctcaccatgttgcccaggctggtctcagacaatcctcccaccttggcctgccacagtgctggggattacaagcgagagccaccaccccagcccaatacccagtgtttcatgcaacttaagtttcaagcttttagggggatggaggagatgcacttgtgttcctagggttaaggcaaaagaggtggttagtagcaccaattaatgttaatccgggcatgagtggatagctatttatattaaactgcctgaccaatacctttaagttcttcagtaagtgttaatttaattgaaaaacatttagttaactatagaagctgtgaagatgttaattcggccagtaaattattcatgactgttggtgggttcgtttgagctttaatagctcctaatagacctcattagtgcctaagaatggccctgcagtactccagagtttcagttccagaaatctctttttttgtgttactgaatcttggacttgacagttcttaatgtgatacgacaacctggaatgggttaatccagttcaagtgtttcaagataacttgttttctccatgttgagttctttgggttcattaatacacctaaagcattaagataaaaccaatatacacagtctgtattttttaaagaagagattatttcttgattggataattaaaactatataattaaaggtggtataactgtttacacttgaattgtggcataactgtttacacttgaattgtggcgtccttttgcttattaaggattaactacctttttcctttggttgtatatggcagcactggattaggtgcgaaaggaggctgtgataaagaaatttgagtttacctctcagaaatttgaaatagaattggaggaacaagatacataaaaacatgaagtaaacaaagtacagaaattgcttggtatcacttgctgcaaattgcttggtgcaggcagtggatgttactgccccattcattagtaggaattaatgaatgagtctgctggaatggtcaagaaaggcttttttgtcaccttgaagatcacaacatagtatttttttgtgggaagacccatataagcaaaggtggctagaattcaggaatctcccaagagttgtgtttaaggattaggcgaggtaatggacttctggtagaactggaacacagtagagagtaaggatggaaggtagaatagagacacctggaatagtagttcttaatcctggctggaagtcagaaacacttggagcaggggttggggggagataacaaggcctggcacctaacctagtgtagttaaatttagaatctttgtacgggactcaggctttgattttgttggtttttgtttgtttgtttgtttaaggttgctgggggtgggtggatagccaggattaaaaacttcccatctagaatggtggaaaaataactgaagatgtttgacaggggagatgagaaatgaaattggagagtttttgttttgttttgttttttgagacaaggttctgatctgtctcccaggctgtagtgctgtgtcactatcttgttctctgcagccttgacttcccagtcctaagtagctgaggctccaggcgtataccaccatgcctggctaattttttgtatttttagtagagatggggtttctccacgttgcccaggctggtctggagctcctgggctcaagcagacctcctgccaaggcctcccaaagtgctgggattacaggcgtgagccaactcacctggccaaaattcaagtttttgatagtctggtggtggtatgtgacagaaaatggaaagtgtgcacactggaagttggcggatatattagacacctgagctaaaatatgtcacttagtaggataagagatgaatacaaaagatatagcgagggaaatactaacacaacttgcaacattgggtatggtgatggagaggggaagaatcaagatagttaaagaagtggccctacctcaaaccagttgtattactctgagtggaggctgggcataggtttgtttttgtttttttttttttaaagcttcccaagtatttgagcaccattaccctgagacatatatctagtctgggtaataggagaatgatctaaataaagttgaaagatcagacaagtgtatgtaacatttgatatttgaaggaacatgggatgttagagaatagaaaatggccagatcagctgttattgagtttttattttacatgtgaggaaagtgaaacttagagagattaaataacttgttcatggtatttactagtaccagtgattgcgattaggctcttctggtctgagctatttaatcagctctgacctctcacctgataatcattcttctgatgttttcaaatatccatttctcagcacgtacacctttttcttatctctgtagaaataattttcgttaacaccattttgtaactttggagtcagtgcaaaattgttgtttattttatagctaatataaagcagaaatgtgatttttactgataaataaattttatttctcttctatagacatttctcatctatttactgcagcagtgcaaatgagatttctgtttgcttactaagtcatctcctttaggatttcaagacttaataccactttcatcaaaaactaaggcactgtttcctgttacatcacgttgaaatgcttcataatcgggctccgctacacctgtcacactacatatcctatttcacttcagcccagctctctgttctagccaggctagcctgttgattttcctctgaaacaacaagccacacatgttgccacaggcattcatgcagaagacttcacttgatgctgggcttagaaaatcatagaatgcatggtcgctgctctgaagaaagaatttagtggcatattctcgcttgacttatgtgctgtttcatgcctagaatactcagctattttctttctcctagaattctgcctgattttccaggttcacttcaaattccacttatttaaaagccttggttgctttgatggacatgcagttgtggataaacaataaataatatttctagatagtctgtgacataatagatacctagatactaattgagcaaaataatttttggcatttttgtcctatactctgttttttttttccatgtttacatcttgtcttttcagcaagattgtctatgctctcatggcagggacttcttttatgttttccacagagctagatccttataaaatacttgcactaaattaaacattatgccatgtaactgagcttatttgggggaagaggtcaataaagactatggaataatttgaggtcttgggtatgagataccaaaggaggtagttgctagtacttgagagattgctccaaataacatcagatgagcatgcttccaagtttcctgcattacttgcatgacccatgattctaagttaatgaaatgagtttgtccctcttctcacccactgtccctgattattttatgtatgttatacttaatgtcttcattttttacctttagtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgaggtaggtttgtaatttcctattaagaatcagttccataattctagatttcctgattatttggtcaaatataaaatctttatttgttcttttctaaaggtattcagaagacagtttttctattctcaactagtatgaaatatcaacactatctcttgttagataaggacagtatttatggtcaaacatttttcataccagattatattaatacatgctgatctctcgacttgctggtctcttagagaagctccgtctgtactatttagaagttaggatttcaaataagaatgtgcattgcagtctttctatgagggtctgtgaaactttggtgatatttgctactgacgtctgtttctttctctctactgtcttcaatgttagcttcttgaggaaagaaccttactttatatccatgcctacatttgcagtgcatatttgtgaacggtatacagtgcacatttgtaaatggttgacatgcctactgtattgttaggcattgctagtgctgaaatataacgaatgaataagatactaatggacttaatgatttagaacaatttgttacacaatatcacaatataggctaaaagatactaataaaatattaagaatataactgaagctgttcccttggaggtaaggaggagggtaaagaaagcctacagaaaagggatatttgaaggtgagtagtaccttgttaagaggtagaagagacattggtagaggtatagaggtaacagaattagcagattcagggctacgtgaaagcacatggtatatattaagttgttcattatgaacagagtagagaatataattttgcgggagagttatgaaagggaagtttgctggaggcttggcccaatgcatttgtctttattccgtaggagagccatcagatgtctataagcaagggcttaagggtttttcccccaaaagtaagatagctttattgcttcacattttaaagtaatattcagaagtgtacctttaaaagacaaatggtgacacttttgagggaaaggctgaggatgggaagacctgtcaaaagcagtggatcaagtataaggaagataaaagctaaggtgtaggtagagaaaaaggtaggtgctaggtgttctgatgatttagaagtgaggacttggggaccaattgaatctgaagataaatgtggagagaatggctttatcaaatccagttgtgcaaactagaaaccttcattgttcataggaatagggaagttagagtagtaacttactgatattaaaatatgttatggaaatctattgtgttcattagatagcaatctgaagttgaaggaaatacactagtatggaatattgaacagtggttaactttgagggtaggcttatgaagagcaattttcctttttaatctttagtttccagattttctaaagttagacataaaggaattcagaaaggagtcatcagtgtataggtaataaaaggaagaagcaccaatgaagagagcaaagacatagaagtcaggaaaaagcaccaacgataatttcaggaagtcaatggtaaacatttttttagatgctacagaggtcaaataaaatgaagaatgaaaataagtcattcagttacaaaagcttcactgctatttcaagaagcgcttaggactttatttccaatttattgaaggattatgtaatagtgtcagtgaccttgctgtgcactagaattattccttaacaactaaaaactatagtaaaattatctatgtctcataaacagacactgttatttaattttaaggtaattgtagcatttagtttttctatttgtttcttcttaccttagctgatttttaaaaaataattttagactaattgttgtggattctgttggattagatagggaagattaacacaaattgaaaccacaattttatgttctgaagcataaaagattagatttttttttttttcctctctgagacagagtcttgctctgtcgccaaggctggagtgcagtggggtgatcttggctcactgcagcctctgcctcccaggttcaggtgattcttctgcctcagtctcctgagtagctgaaattacaggcgcgcatcaccatgcctggcttatttttgtatttttagtagagacggggtttcaccgtgttggccagtctggttttgaattcctgaccttgtgatccacccgcctcggcctcccaaagtgctgggattacaggcatgagccaccgtgcctggcaagattagatattaaggctttcatttcattgacatgatttatagaaatagatttaacgaagtcctttttgtttagtgtaatctttgtattctgaatattagtttactacatgaacattttaatatataaatgcatccatagctgtctaaaaattacatgtttacatatgtacaaagaaaccacaattgggatgaagattattggcagtaaaacatggctgtggttgtacagttgtgaaatagttcagttaaagggggcacacagctaagaaaacagatttggtaatgcaatggaacccccagattttaaaggggggttttgtaaaatcagtaaaaatagtacgtaattaggaacaaatatatatagaagggtagaattagccataaaatggcaagaaagaataaggcttataaagcatttgtttgagatgtgaaaatagacctgaattgtttggtgaatgatttgatccaggttagtctaaaggtgacagacaagagaaaagcaaaactagaaaattcctgtcgcgctcctagttttttctgctgaatgcaataattttcatacttgaaacatagcaaagcaagagaaaactgaggccccagatgagtgagaaaataacaggattacttggcggttgctagggtgctagttgctaggtgtgtgatagtagtcaaatagagacctatgacaggaactgtaaatgtcctgatttttcagtcagatgtgggaactattgagcttacttttcatccctagcaaaaaccccagagccagtgaataaataacttggcagactagctcatgatagcataatggtcaatatggagaaatgttggatggatagcagttagtaagagactgattttagagaagtctccaggtgtatgctgccagatgctatcctcgccctgcttttttcagagacctaatgagtagttctgtgagtacctatgtgctacgtaagcacttattttaggctttttacgtgcagcaactcatttaaccatctcaacaactctgtgagacaggtgttaaggtaggagaatgaatgattaaaagataaactacaaagagtctgataatttaaaattagtcaccaaattggaatactagattaaccaacagaaggcattttaaaagcattaggttatagtttttttatttgggaacaaacgatccattacggaggaactgaaagaaaacctgatttcgctaatgtgatttgtgaagaaatgatggggatgtgttttagttttacaaagttataaaacttcagtctacagaatcaaggagtgtaatcactcagtactttatattggtcgggtacattaagaatagtagtgaaatgcactttaatgaataattacttagaacctatccagaagacagcaattagtgttaaaaatggttgtgttcagaaaattggaagaaacagtggaagtcaaggggaggtatgtctgagaatacagagtagttttctaaagatcttatggtgaaataggctaccttttccaaattgattgtcaatcagtagaagccaagcagaccagattaggggggaaaaacaacttagatgttgtaataaattacaaagcatagatttccaccccctctccccaaaggaacttggaaaccagttaggtgctcccactttacttttgaggaaaaaatcccagagatgttaaaagtacttgagagtcaggactgaaagccagtcttttgacttttatgttcttcagggaactttaatcaatttcttgagttacaaatgaagtttaaatttgacctgagatttgttccatttctgcttttattaaaggaggactaattttgtcaatgactttttcagtttaaaagtaaatatgtagaaaagggtagaaggtctaaactttatgaggctggagatatttgtctgttgtgttacctactatatgagtagaacctaaaataatgctgatgcattgtatgaacttaattgtggttgaatgaataaggcagtggttaagaatggagtcagaactggattctgttcccacatttgccatttttagcgctgtgcccttaagatggctaagtgttttctcatctgtgaacattagattttctggtctttaaatacatttgaaatcatactgtataaatatcttatgtctcatttcctattacagaataagcattttccacatattgtttccaatgaccacatagcattacataagttacaatgacgtcttgagctataaagtgtgttagactttatattatttccaggaatttgctacaaaaatatatttgttaaaatacttgtgtataaagcttttttcacatttcagatttccccaggagagcttttctgcaatgcagttattaagaaaaatatctccacattttgatacatgttgctaaattgcatttctaaaaggttgtaccaatttactaccataaaagtggtgtgtgtgttgttcttagctcactttttcattattttaaaatcttacgtctttgctagtttggtatatgaaagtattaatttgctttatctggattttttattgcaaaaattcaagtttttttttaatgtttaatgttttagcttttgtgtataaagtttaataattgatattcaagaatgatttatttgctcacttaatcagtaattcaacatatgagtgcctgctctgtgccaggcactgtttatctaaaatctagggatttagctttgaattgaaagttctgcccctcaagaagcttatattctggtaatttaattgtactgatttgccctatctactctggtgtatttacacttttcccccaggtttgagtataaaagcttgtgctttttgtataatcagatatcagtcccttgtgatttttttttaattgatttcaaatctagaaagttccgcccttgcaaagattttacaaatatactcatccatgggggtgtgtgtgtatgttttggggtttttgtttgtttgtttttgttgttttgtttttgtttttgttttgagacagggtctcactctgtcacccaggctggagtacggtgtcaggatcatggcttgacctcccaggctctggtgaacctcccaccccagcctcttgagtagctggaactataggcatccagctaattttggctaatttttgtatttttttgtagagacagggttttgccatgtgcctaggctggtctcaaattcctgggctcaggtgatctgccacctcggcctctcaaagtgctaggattacaaacgtgaaccactgagcctggctggtttttaaatattttttaagacattaaactcggttcatttgaatacatttttacatgctgttaggcaagcaactaaattgtggatttttttcccccctatttaaagaagaagtcaagtaacatttacctactgggtccttcctaccaccacctttgttagcatctttaattttttataaacaaggttctgttaaattatctacttccatttgtcctatactttcatgtaattgtttttgtgataacttccattttgcttgttttttgatggtgctgattaagaaatatttgcaatgccattaaaatatagtttagccaaattattaggaattctttgaaaagtattaacatgtcacatgtcacatcaacttatctaaagttgtttgagtggtgtgtttccctttggaaaaataaaataaaggcttcctccaaatggataaaggctagggaaagagagctctagtcagcaaagattctgggagaaggggaaggctttttcaactcttttggtatgtgtctagggatgagacggagactcgaacagtagagcccagattccaacattcttgttggggaacaacttagagtcttaaaatgctagctttgatgctttctaattctggttcagtctccctttgggtgagaaaaagaggatttctatctcctacctgcagtgatgtgtggcaggattggagacttgagaatggggatattttgcagctttaaggcatatatatttcagatcatatcattgtgttcttgtttaatagtaatcagaactatagtctaaacatgaggccaagtgcagtggctcacgcctgtaatcccatcactttgggaggccagggcgcagtgcaggggccggatcacttgaggtcaggagttccgagaacagcctggtcaacatggtgaaaccccgtctctactaaaaatacaaaatttggctgggtttggtggcgcacacctgtagtcccagctacttgggagactgaggcagagggatcacttgaacccaggaggcagaggttgcagtgagccaatatcgtaccactgcactccaggctgggtgacagcgagactccatctcaaaaataaattaattcagcctgggtgacagagcaagactgtgtctcaaaaataaattaattaattaaataaacaaacaaacatgaaagaagcacagcttgaaagtccctcagtgatctagaataatggttctcaagttaattttatactgcttgtcagttaaaaacatgtattttcgatatgtgtatatgtttacaaattgtgtaattataattctgtgtctgcattgtaaaacacagtggtacaaataggaaaaatgtgaagtgagggatattataaaaagtttacttgtgcagaaatgttctgttagaaatactatgttctggattgctggtttttaagtgtttaattttaaaaagctttataatatcatgaattagtatcagggaaatctacatttgtgtgttgtattgcaactaatttaagtccatgtcatagtcttgatcttaactgtttggcatacttaccatatctcgttagatggtttcttaatgtggaggttgaagaactagtactaggaatagaaatgtcagttcccttgctctttgcatgtgcttgccttatcttccatctgaggttcttctgcgggaatctttcaaccatttgtctatttgggcttttttgtttttctgggatggagtcttgctgtgttgcccaggctggagtgcagtagcacaatttcggctcactgcaacctccgcctcctgggttcaagcaattctcatgcctccccctcctgagtagctgggactacagacccatgccaccatgcctggctaaattttgtatttttggtagagacaggctttcaccatgttggccgtgcttgtcccaaactcctgacctcatgtccaccccggcctccctgtgctgggattacaggtgtgagccactgcatccggcctcatttgtcttatttgtgaaggtagcttagttacactagataactaaatttatatatctccttatcgggcatacggtaatacggtaagagcaaatgagtgaggacttcactgttggcctcttttggagttctccactctttcctcagaatacctgagtaatacatgatactcatagaccatctgacataccaactcggtgaaacctagactataaatacatagtaaatatttataaaagctcatttttatctctgggcagaaaaatagtcccagttattttcttctgcaccccattgggttatcagtgtgtactctagggagactagtgactaaaaatgataggttctatttaaagttgatcggcattgaaaagaaattggactgaatagtctcactccaacaaccatcaagagtctttgtggcattttcagaattgttgatgtcatcgtatgttttaatggctttaaaaaaaatacatttcaccttttatagtaatgttaattctatgtatttcctgtcaatagaaatctaatttatatttcgctaaacccaagctaaaaatatatattgactgtgaaatgtgcattaaattgttattgatcatagttatcaacattatgctatgttataacagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctgtaagtcaggaaagcagtcatctcagcttaccttgctttgtgttaagagcatgacctaggattgccactcattctggttgaaatatcttgccgactcaccttctaacttcccgaatcatttttttcaccttcactcttgaaagataacttcagtagattagggtcttactgcccaaagtatatctaagaatcagaagcattattatcaccttggatcttaataaagatggaaaatttcaaatccccatacctactgagtctgattttatattttaacttctcatttgagaagccctggtttacagccagaccttcttggtttgaatcttctactatttgactttggcaagtcatttaacttctctgtgtctgttttctcattggtaaaatgaggcgaatacaatactttcttgtgggcttttgtgaaagttaaatgagttaatatatgttaaacacagaacagtggctagtgtagaagaattaggacgtaaccacctacaggtgtggtggctttgatttacgtgatttgaccatcacacatatcgttgactcaaactttggtttatctttctagaatttgttactcttttttcctagtgaaaatatatcctttttattaataatgcccaacattccacttaaatggaaatacttataaatcagattttcagtgaaagggtctaaaacataattgtaatgatttagaaatgtcattactgtggtaaattatagacctaggctttgctaaggatttcgtcctgttttgtgcttcacttatagtttttgttgttttactcaaagaagggaaatggaacatccaatgtgatagtattttatgacctaggcagattccattatattgcttttaaatagctcctatttcactaaagaatgggaacgaagtgatagttacagatttcatcagtatgtaaaaagtgaagggtttcttttaggtaaagatttctttaaatgtacctgtgaaatgattcagcatttttaaaatggaaatgcttttgctgtcttggagttttgttgtttcagaagttttctactgcactattttggatagtctttcattaaaggacctaagcatgaattactctgaaattttctagtttaagtattgcatagaaagttcattttattgtgttaatctctactaacttgaaatatgccttccaaatgcatgacttactaaacagtattaaggtattggctgaagtttcaaaatagcgttaccaaatctcttaagagtctttggtagtttgtggtcgctgtctcttaatattaattacctttgttctgaaattgttgttttagtaattttcacttcatgtaaaggcagcatttgctaatgtagttgctataccttaatattaaaccccagaaattctatttttgtctgataagtggaaattctaccataatttggggcaattccccaatataataagttgtttcctctgaaatgttttattagctaaattaatgctgcagtaataaagtctataatcttcccttcattttacttttttttgcgtttttatatggaagatttagtgacttattaaccagacttaatatgctatggagataatgtacagatatgtatatattctttttctttttaaaacagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggaggtaatctgtcagttctcctttgtaaaaatgtaatcacaaaatttgtcttgcatatcaatttgttcatgagtgtttttcaaaaagttttatgtaaattaaaacattttggacttttagttgtactgtttagtgaagaatatctgtataaaccagcagaatccttgaaagattatatttgcatatatttacaataaatgcttggaagatttcattgtttttccccataatgatgactgtttacccgtaagattttaagccagtacgaatattgaacttttgtaatgttacttatgattattctgtcaggtactattttgggtagtacctgaaaaaagtaatccttagagtgtcacctcttagaagctgggcgcggtggcttacgcctgtaatcccagcactttgggaggccgaggcgggcagatcacgaggtcaggagatagagaccatcctggctaacacggtgaaaccccgtctctactaaaaatacaaaaaattagctgggcgtggtggcaggcacctgtagtcccagctactcgggaggctgaagcaggagaatggtgtgaacctgggaggcggagcttgcagtaagccaagatgccaccactgcactccagcctgggcgacagagcgagaccccgtctcaaaaaaaaaaaaagtcacctcttagattatatggaaattcattgtggctgacaccatacaaattatttcacaggcctggcatggtggctcatgcctgtattcccagcattttgggaggccagggcaagtggattgcttgagctcaggaattcaagaccagcttgcagcctgggcaacatggcaaaaccccatctctacaaaaaatgcaaaaattagctgaggaacgtgacatgtgcctgtagtcccagctactaagtagactgaggtgggaggatcgcttgagcccgcaaggtagaggttgcagtgagctgagatcgtgccgctgcactccagcttgggtgacagggagactctgtctcaaaaaaaaaaaaaaaaaaaaaaaaaaaaagtttttacatgtgaagtgtttggcttactaaaggactgaaattatgaggcctctgtgcatttttaaaaaacgtttgagaaaagagtcagtataatagctaacaagatgcatgctataggaacattgttttggttaatcctcatggcagtcctgttaggaattattctccttttacataagagaaaactgaggtacagaggagtttaaaaaaaaaactcgccaaaggttatgattgttaagtcatctcatttgtagtatgtgtaaatgccataaaaactaagattaagacatggctatcttagcataagatggtggttctgaaacatttgtgtgtatcagaattagtggaaggcttgttaaaacacagattgctatacttgatccccagagtttgtctttggctaggactagagttaggcccagtatttcttttaagctcccaggtgatgttaatgctgctggtccagggaccacactttgaaaaccactggtctaaggcaattcaaatgctatgttaagtatagcttggaagcaatatatcgtttcgcaaaaatcagttcaacaaacataacacattatttatttttagatgatgttgaatttgaagtatcatcggaccgacggactgggaaacccattgctgttaaactggtgaagataaaacaagaaatcctccctgaagaacgaatgaatggacaagttagtgactttgatgctttgtgtttttttagggccctgcatttgcatatctttcacattagaaaaggaagattctccccatctcctcagtttgcacgaaagagagctatagtatataaagattactattttaaaattaatcaaaagcactggcatttcttgacctgaaataaaaatatggtcaagactcaattgggtttttacatataaccctgagtcaatgcttacagtcaatttacatactgtaagtttgaaacttggcagcatgacatcctcttgtggatcatattaaaatgcatccctgtatatagtatagaggatattaaaattcagtttatattgcacagtgctgctcctgaaatgattagcaatggaaatttttttttttttgactggtaggttgtgtgcgctgttcctcacaacttagagagtaaatctccagctgccccgggtcagagtccaacagggagtgtatgctacgaacgtaatggggtaaacttgtgtatttttcttaaacctttgcctgatccaccatgtgatctataagcgtactttaaaattcaaaatagaaaacgtaagctgcaattgttaaaatcagttttaaatttggtttctaagaggcttcaaatgcagcataatcaaaaaatttaaaaagaaaaattccataggacttccaagtgtcttagtttgcccaagtatgaccttagttagaacattaaggtaaaatgttccttttaatcacttttttgggggttgtgggggggatctttttctggtttcttttaagcactaacaccagctttttttgtttggaatgccttatataaaattgtttttttgaaatgtaactatagtctctgggcaaatgcttccacgtgtgtaagctttttgaagttggattgctgctcagctgtggactcgcagaagtcatcagcaccatggaggggaagtgtgtgtttatatgaataaagtgacttgtcataaagcatttaattttaagaaatttggcttaaaatgccagtataagaggtttttaagtaagtaaatcacagtatacagtgaatatgcatcctgccaaaatagtaataatgatttattaattcacaggaagtgttttatctgacttacacccctgaagatgtcgaagggaacgttcagctggaaactggagataaaataaactttgtaattgataacaataaacagtaagttctttttttttaaattttctcacctaagcggtttttttttcccccctccattaagaaatttgaatagagttaaaaacctaacttgtaagtctggatagttttcatgaactttcaattcatcaactaatgctttgaggtctatgaatattgtattacagccatgatgcagggtctcagaggaagatgataattaaaacattgttaggcattttaaggacttgttctagagatcagtgaaggtttttcaaaaaatagtgctttgaggtaagttttgagggaggggtatagtcactatagagaggtgagaaaaaagcattatgattagaagtatcatgacatgttgggggaaaatggccaaaagtttggtcgaactgaccagaaggtaaagtttgagcattcttctatgtaggaatctgcgttgtttaaaacaaggaagtgtgattggtttagatctttggaggtggtggaagtggtagacttttgaaaggtggggatgctgttgaccagaggcagtgatgtgagagttaacgtgaaagatgaccgcctgatatggatagactaagaggatggggtggaggagtcaagtcatattgagaagatagaatcatcaatcttaattgatttgataaaggtggggttggaattaaagggagtcccaaatactgtttttctggcctggcctactgggcagatgatggtaccataaactgggctaaggagacataaggagaatgttcaaggtgggaaaagaatcatacttatcttggcaatttttgagtgtgagatgtttgtgatatatctgggtagagatatcaaatctacagttgcgtgtataggtctgagacttagacctattaagtctaaggtctatttcctgcctataggggaagtatatagagctgtagaattcatcagcatacacagttaaggaaaatgtagttaagaaagcccagggagaatattatttttatcttggcataggagagatgagagatgcaagaggagaaggaaattaaaatagaaagttggagaaagtgctagtaatgtaccttccagtagcatgtggagggaaaagtcctaagagcatgtctgggattatctgccttgaaccttatctctttcttggcaagccttgaaggaatcagattgtgttgtaggtgtggttattattagttacagtctgaaggcctcaatttatatagttgttaatctcagaacagccttacctggtaagtttcttcatctgtaaaatgacgtataagttctcacaaagttacttgtcgatgttcatactgcttttaaatagcaggcatttaaattcccatctgactctaaagcgttttcactgcagtaagttacaaaaacaggtagaatttttctggtgtctttgttagtctgtaacatttttttaaataaaaagcacattttgggttatttgtctgtgaaaaattaagggaagtaattgcttggtgtataggtcttttcttaaaacatttagactaacagtaccattatgtcttatacagtctatgttatcttaaaaacaaaattgaatttacatcgctgctacacaaatatgaaggcataaaagcaacatgtggtgtctctaacttgtttccattctccaatggaggtggatatcattacttttaaaagcatagcaagttctcttaaagtcacttcatttactcaacttttatggctgtttactcagaaataattaatgagatagctactaaatttagcactcactgaaaatagagaccatctcctatttatctctgtatcaccagtaccttactttgccgcagattatacctacacaaatgtttgtttaatgaataacctttataagactttagtattccccacctttggtagcattcgctttgtggctttatttcagttattttgttgaaatagaaaaacagagtagaacatcacgcacccatgtgtaagtttgtaaaaaagcaaatcttccaacaacagtcccagagaaagatgacctatatatatatttgccaaacgtagaaggctaaggagttaaagtcctttgcatataaagccatatgaaaataatcaaatgtcataaaccctgtatttattcttagtgatgatagaattcttaaagccccaggaaactagtttctttagactcatatctaagcaggccaatacatttttaatccctgtttcattcctcctccctgcaattattttttttctagtactggtgctgtaagtgctcgcaacattatgctgttgaaaaagaaacaagcccgctgtcagggagtagtttgtgccatgaaggtaagtgttaaatttgagaaacttgagttttctttggccacttgaaatgttgtacttcaaactccagcctttgtttttttttttcttttttatcttacccttttaaaatatttcactgttaacctcaaaagtagtctcttaaaattccttggttgctaatacattatcttctttaaaattggctgtttaattgataatattaggttgtaccaaattatattattgtgactacagtataattttacaaaaattactggttttaagttgtaatcataaatttgtacagagtggtaataatgttcttggttttttattttgcttcaggaggcatttggctttattgaaagaggtgatgttgtaaaagagatattctttcactatagtgaatttaagggtgacttagaaaccttacagcctggcgatgatgtggaattcacaatcaaggacagaaatgtaagacagtcagttaacttgatctttggccttttaagatcagagttggtttatgtttttaagaaacacttaaaattatgtgattcttccttcctctgtccccccaccacctccaaccccttctgatttagggtaaagaagttgcaacagatgtcagactattgcctcaaggaacagtcatttttgaagatatcagcattgaacattttgaaggaactgtaaccaaagttatcccaaaagtacccagtaaaaaccaggtaaataatctttttcaggagagtcctatttcgcctcagtagtaatagaataatatggtgtggtatactgagattttatcttattcagttaatataatgtggtagtggaacaactaaggacctcttgttacgtatatttaaactaaaagagaaaccagatttatatattcataaatatggtgtttttttttttttttttctttttttgtgacagagtctcgctctgtcgccaggctggagtgcagtggcgcgatctcggctcactgcaacctccgcctcccgggtttaagcgattctcctgcctcagcctcccaagtagctgggactacaagggcatgccaccacacccagctaatttttgtattcttagtaaagacggggtttcaccctgttggcaaggatggtctcgatctcttgaccttgcgatctgtccaccttggcctcccaaagtgctgggattacaagtatgagccacctcgcccagccaaatatgtatttttttttactgggtgatgaaaaaaggccaaagaagaaaatgctaattaaattggaaagcacctgattggattagactgcagttcaggtgtacatttgttccctcctctgcccctgccctacccctccagtttgtggggaaggtgaggacacaagtggtgtcattcctggaaaaattccttaaataaaatcttttggtaccagagtgctgggtcttaattgcattgttgtaattttatggttgactcgtgtgaccatagaccatgaagctttcacattggacttatgttgtcaacaccttttttcgcttcagggaactaagttaaaaataacatgggtttactatgtgttcttcttgtttgacttagaactaggaaggatgagaaatctccagctaaaatcgtttttccttctcatcagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatggtaagtgttggatattactggatatgtatctaatatgcgaaagccaatgttatattcaagtttatactactaaattaaaatttttcttaagttaaatgaccctaatgggcatttaccttgttaaggtgattaagaatcatacacatttgagtcagtctgggttatctctggcagttatcttggaaatatatgtgaaaaaattttttgaatggaaatctggacaggattactaagatatttttagagtcagtgattctcaggcccttaatatgaagagtaagaaaattcaagttcatcattgtagaaagtagattttcccaaactatttcctaagacatttaattagtggtttctgtttttaggaaacacaattcttcctccagtgtggtccagggaagccaaaagattgaacacccatgatctagacactagatcacacataaaatacactaacagcaatgatagctgatgagcttttttaaaaaaaaaatcataggcacggtggctcacacctgtaatcccagcactttgggaggctgaggcgggtgatcacttgaggtcaggagttcaagaccagcctggccaacatggtaaaaccccgtctctactaaaaatagaaaaattagccaggtgtgacggtgggcacctgtaatcctaactactcaggaggctgagacaggagaatcgcttgaacctaggaggcagaggttgcagtaagccaataccatgccgttgccctgcaacctgggtgacagaggaagactgtctcaaaaaaataattgcaaaaacatctcatcatgttttaagaaggtttaacaatttgttgtgttgggccacattcagagctgtcctaggccatggtttggacaagcttgcaattaaaccagagtcaaaaaggttttgttttggcagaacttcacaaattgttttttaagagtttgtgtctgggagtggcataaaccaaccagattttttcccaaacatgttttatgaactcattttctcagacataatttgcatttagttacgtttgggatcatatcatctacactataactcagtgttgccagtggaactgggtacattgaatgaaaatttaagtttcttgagttttttttaatcctttgcctttgaagaactggttgtatttgacacagtgtatttaactttaaaagtttgtaagtctgaatgtgtgatttttttttttttttttacattttcaaaggcaagatctgttttgctttacggtatggaaaatataacttggctactgtcaggacttggcaaggattaaatgtcaaaatattgtttaggtcatatttaaaacttacagaatcacttctgcagtgagcagatatgtagtatgtaatacaatagcagattgataatttgtgttcattgtttcattaaacatgagtatctaccatgttccaggtactcttgatacagtaagccttacaaagctgataatttagtaagaaggaaaaaaaaaaaagagaaaagattgcatatattttattcttcagatgtaaattttaactctttcctgggcctaaactcatgcaatttttgaggtagagactggagaagtgcctttgtctactttggaattatggtctgtaaattagtgaagtttctggagattatattgtcattagacttgggcttttatgaaatacattgtgttcacgtgtttacgttcacatgtggtaattttttctagtgcatatttgccaggaagtagcaattggagagtcttagaaaattgctcaggttaagttactttgttgaaagcaatgagtttgtacttaagtgagaacagttcaaatgtggatacagtatttgtgtcacatcagagaaaattcctgatgaatttaacttgatggtggttgtaaagttgaatgttgccttcttgacaagtttcacagccagtgaaaatattatttgggtttcagggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgtgagttgtttctgagaaaagttgggaggtgtttcttgatgctttctttttcaattgaaagttaattttgttttatcatttttaggatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggtaggttttgcataatccaaatgatttttgtagctgtttatttctcttctgctttaacagcacatagtaatagagtacatataatcagcggaagtttgtctctttcagaatttctgtcatattaacagtgaactaaacaaagtaaggtttcttaaccttgggattattgacattttgggatgaatgattctttactgtgggggatgggatgtttagcagcatttctggcctctacccactggaagttagtattctgaccccttttccctgcctcccattgtgacagccaaaaatgtgtccagacattgccaaatgtcccctgggaggcaaactcattccaagtagagaactagttatataaaatgatagtactgtcttccaggcaatttaaaactttcaaagttgggtgtatcctcagttcacacatttaaatttcatttattgaaaaatccactaaataggaaatagaaagatgtctgagatgaattctcctttcaagttaataacaaattgagagttttatagaaacaagtaattcatatagaatataaaatattgctattgaaggtcagcgatagtgctctggtgaaaattaactggtagggtatgtgatggttttactaacagatggagacaggaaagagcattcttcacagagtaaaagtatagatgagaaaaattcagggtttctttaggaagcaatgagtaactagtccgacaggaatttttttttttttttttttggttttgtgtgtgggtttttgttggtgagggaggttaggagaaataaggatgaaaaatcaggatccagctagactgggagggtgttgattgctgctctaaagaatttagaccttattgtcaggtgcggtggctcacacctgtaaacccagcactttgggaggctgaggcgggcggatcacgaggtcaggagattgagaccatcctggctaacatggtgaaaccccatctctactaaaaatacaaaaaaattagccgggcatagtagtgggcacctgtaatcccagctactcgggaggctgaggcaggagaatggcgtgaacccaggaggcagagcttttagtgagctgagatggcgccattgcactccatcctgggcgactgagtgagactccgtctccaaaaaaaaaatttagaccttgttctgtacttcaaggaaaagatttcttttggataatgacatcaggtatgtgctttgggagagtaatggcagcaatatgaagcctagatgggatggagaaagacaaaagatgaaaaggattactatgaaattacttggatagttaaggtagtccttgaactaggcacacagatagtgactatagacaagtgaaggtacatgagagatactggaaagtcatgttataatttaataattgctattagccagaaagagcaaggctagtatcttgcttatcacttactgtagcttgggaaattatttcacctctgagcttcagtttttaaatttcaaaaatgattgtgtaatagtttaaaaagccctcgaagtacctagctcataataggaatttcgcatgtgacagatgatactgttaacaaaaataaaaatacacttcagttgggcttatttttaataacttttaattcttggaatgctctgcttcccaaatgtgtctggcaaaactggcttgatgaagagagcctttgtgtgagactttccctgccattttttgtttttttttctttcttagtccaacagtaccctagtaaatcctctgtcatcatgcttcttacagtatataacatttacctgttaatgaatctgtctctgctgcactggactccctcagggcagggattctcctatctctatttaatatatttgatgtatagtatattgtcagctgttgatgttgaagttggtgagttaagagcaaaaggtgaacagtaagcttttgagtttggttgtggaaaagttgatgacattggagtcagacctgagttcactgacattgttcttaaccaaactcaaatcctctggattattttgcgctgggttttgtaaccttggtaaggtttacttaattcctcagatttccccaatttgtaaaatgagggaaaagagaaactatggagatgattttgtacaagattaatttgataatacataatacctggtaatgttgtaagtgttcaataaattattatatagcagttatggaaggaatgtgattggtagaagaggaaaatgaattggttttgaatatatcgtagtttgtaatgaggactggagtttaggaaggaagtcagggctagagtagggacatgggcattatcttcatagaaatgttgaaaccataaaatcagtataatttatgtagttgctgtacactgtcattacttaacggtgtgattcaatacgacacacctgaactttcttagacttttatttttttagtcaagtgcagtagtgagaaggggggaaagaggagaacaaggaagttcgatctgtaactgactgaacaatcgagataacccactaccttcagaccagcccttagattttttaagagttaatcattcttacacgtacgatgactgaaatgttgtttctccttgaagtctggtattaaaaaaaattgttgaaatactagtatgtcataatttttaatcatctactttatgtcaagtacttgaactgtgctagatcatacaccaaattatcctgcattgttaagtatattgattgacattatatattaaatactgtgcaaggtgctgtgtgctactaaaagaggatacttcagcagcttctttaggaaatactaaagcttcttgcccttatagaatttccacttccttggaagtaacatgcccagtttaatttctgattggctatgaggagcgcaggtgtattaaacattttcagtaagcttttttctcctcaatagcaaaaattagattcttaagattgaaagaccaattaaaaattacagcagactgagctaggcttaaggcaagactaccttttattcatatgaataatcttttagaaaatgctggaataagacatttttacagctgtaccaatcctttggcacaagaatatgtaagaactatagttgtttttattggtttttgttcttgagattgttttcattctgtttttgactgtatctctttaggaggctgaggatggcattattgcttatgatgactgtggggtgaaactgactattgcttttcaagccaaggatgtggaaggatctacttctcctcaaataggagataaggcaagataattctgctcattcgagagagggttaagagttgtcatcttaatcataaatcctgcaggatgggttcttcaaattttatcaagttttgctgaaatatattttgtgtttaagagaaatacatgaatatcttgtatttgaaagcagcttattaaaagtgtctgtcaagctctttgttaatcaaagccttgttaatctagctgtttaaacgttagataaaacatgcttaataaaatcgttattggtaagaaagttaaaacagttactactgaaacattatcaaagtaaaagcacaccaaagattttacgttgttgttcattttttctcatacttaatatgtttggtttttggatagccctctagagaaattcagaatctataaggaatacagactgaaagataaaagtttgatcctttgtgaaaagtgggatgagacataaatgttttggtgaaaatcaatttcattgaagtaataacaaaggatatttggaatgaaaagcatgcgctgggggagttataggtcttgttttctgagttaaggagattggtgtggaagtgatatggtgttaatgagcatccttaattttcacaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacaggtaaggcgtgactttcaggaactttacagctaacttaccatccattctttggtgttggaataaaaaacatttagtattgattgattatacttgttgaggttcagatttcatattggtagaattatggcaagatataaactgaagttaatcactgatcttactatatacagagcctgtggccaaaagaaatagaaaggcctgtgccaccttattttttgtgttggtaccatagagttggccatttggtgtataatgtagtgtaagagtaaggggtctgactgggtgtggtggctcatgcctataatcccagcactttgggggctgaggcaggtggatcccttgagcccaggagttcgaggccagcctgagcaacacggtgaaactccatctccacaaaaattaccaaaattagcctgacatggtggtgcatacctgtagtctcaccaactcaggaggctgatgtgggaggaccacttgatcctgggaggcagaggttgcagtaagctgagatcgcaccactgtactccagcctagccaacagagtgagactctgtctcaaaaaaaaaaatagaaagtaagggttcttagaaccagacagttcagtttttgaatccaggccctgccactttatacctgtgtaatttttaccaaataacttcttggtatcttagtttcattatcctgaagttagggataatgttacctcttcatggggcattcttgaggattaaatgagtcaatacatagaaattacttaaaatggtgtctaatgtaaataagcatgccatgccatgactgttactgtaaaataaagactgcctgttactgttgatgtttatggtaatgtttagttaaatgtcatttcctttctccttagtgagttctctggtgatgttgatagcctggaactgggggacatggtcgagtatagcttgtccaaaggcaaaggcaacaaagtcagtgcagaaaaagtgaacaaaacacactcaggtaataaattgtgacttcttattcagcctgtgcttttaagtgggagataaaggatggagtagtagagggagatgaggcctaattattctacatcagtcattctcatgtgcgattccatagaacagcagcatcacctggttgcttgttagaaatatacgttctctgaccctatcccatacccactgaaactctgtgagtgggcattcttttttaataaatcctttaggtgattctggtatacactgaagtttgagaaggattggcctagatattttaggaaatttgctttatattttcaattcattgtcttcttttgaaaaataaacccaggatagccagctgtggtagtggatgcctgtagtcacagttacttgggaggctgaggtgggagggccgcttgtgctggtaggttgagactgcagtgagccatgatgatcctaccactgcactccaacctgggtgacagagcaagactgtctgaaaaaaacaaaaataaccccaagatatgtatacatcaccatggagtagggaagagaggcatttccctagaagattgttttgaagaagaatgaatctaaatgtgaaaaataatgggaagttaaaaaaattaattgtaatttaggatcttggatctctgactttaaaagacctgcaacttatttttggctctcatctgaactcttaagtgtgtgttatgttttagacactggggatacagcagtgaagaaatcagatacatccctgtattcattgaccttattttttggtggaaaatatggggcagactagaggagtaaaatactgtatatgatgtttagaaagacaacaatacatgtaataaagatgaatcaggacagtatgtaagtattgtgatttacattttagagaccaggaaaggcttcttaaaaaatgacatatggtcacctggaaaaagtaagagatcaaggcatgttttatttatgaatacttattaattccttaaacaattttatttaaacaattctatttaggaaaagcaggcattttggtagtttagaagtatttaaagtccagcagctgttctaaaaatagaacttggcttcaggttccctaccccatttcaatagcagccagccaacctaccctgttaacatttgtgctgttattttttgcttacttgtctttctatgtagtagagatgaaataaaattgaaagatgtacctgcctttgttttgtagtgaatggcattactgaggaagctgatcccaccatttactctggcaaagtaattcgccccctgaggagtgttgatccaacacagactgagtaccaaggaatgattgagattgtggaggagggtaaggatcatcactatcaggctgtttgaaatttgccataacttcagatgagcacctataaagttttaaaatatggtgcttattgcagttgtttttaggtttaaaactgaattaaggaaaagtgacctctctcatgcttgctttttatttttataccccttgaaaatgaggtcagtctgggtttaaatagtgaaaacgtgactgctttgtgagcacatgactgatacatgagcaactatgagttatattgagatagacttaacaacaaactctgataaccaaagcttttactgttgagtgtatgataatcaaatattcagttccttcattagtatttaaatcagtaagcattcagttctgtatttttgcttcctgtaaaagtttactgtttttttcccccctacactacacatatgtacataatctgtttcttaatagctagagttctatgaggatcctatttctcgtttctagctcaggcttcctttcattctctactttcttcttcttttttccccatctatcttcaagaattcccagagttccagtgccgctgttcccccaacagtcaccatcagaaaggccaactttgtatgatctgtatgcataaaataaatacatgatagaaataggagagaactctgtagatgattaggatagcagaattacatgatgtggagtagatgagagggcttgagtattccaaccaaagatgatggcttggtaggccgggcgtggtggttcacgcctgtaatcccagcactttgggaggctgaggcgggcggatcacgaggccaggagttcgtgaccagcctggccagcatggtgaaaccccgtctctactattaaaaaaactaataataaaaaaattttaaaaagaaaagatgatggcttggtttacaaagagaataaagtccttgcatcatctaagagtcagcgaacataaagtgctgaatagcaggtcatttgggagaaggaaatgaaccttgataacctattcctttaccacatgggattcttagaatttctgttctacataaaaccactgttctcccacctctaaatatgaatttttaaacaaatgccatgacatcacacccctaaaaaggccatgggagtatggactactaactttaactcataatatgatatcaaattgcccttccatctcctaacgtgctgcttttacttccttttccatccccacttcccagtccactcattcttcagcactggctgtgggatatagtccaaagcaagggttttatttaggcatctctaagcctggtgggatatagtccaaagcaagggttttgtttaggcatctctaagcccgggactagacagattacattttcccacttggtaagaactagctcttttattcaggaacacaactgtaacttatactaagactttgaagttgggcagacctagatctggacaccgttctagcatataatcttggacaaataacttaaatctttgctagctcagtttcttcatctttaaaatggtaataccttcagccttagatggttctataaagtatgaatcagtatgtgcatcataaatggtaattattgatattgcatgaggtcagaccagcttcctctaatcactcttcccatgacttgatctctttggattatctcctcaaagttttttggttcctgtatttaaaattaaaagtcagctggggtcgagagtaggggctcacacctgtaatcccagcactttgggaagccaaggcaggcagatcacctgaaggtcaggagttcgagaccagcctggccaacatggcgaaaccctgtctctcctaaaaatacaaaaattagccaggtatcatggtgggtgcctataatcccagctacttcagaggctgaggcaggagaatcacttgaacctgggaggcggaagttgcagtgagctgaatcatgccactgaactccagcctggttaacagagcatgactccgtctcaaaaaaaaaaaaaaaagtcaggtgtggtggctcacacctgtaaacccaacacttcgggaggccaaggtgggcagatcacttgagcccaggagtttgagaccagcctgggcaacatggcaaaaccctgtctctacaaaaaatgcaaaaattagccagtcatggtgtgtgcctgtagtcccagcgactcaggagctgaggtgggaggatcacccgagcccaggaaatcaaggctgcagtgagccgttgatcgccactgcactccagcctgggtagcagagcgagaccctgtctcaacaataacaatgacaaaaattcttcacttaccctgtaatcatcaagaggatggttagaagcttctgcttcccacctgtttttctcatgttttccactattgttgactgagtacatttgcctggatgctgaaaattgttaggcagctgaattctttggcatagtttttatctgtagcctgcaccgggctccaggcaacttcatactgtagggcagggctcagcatatatggtggccttttcttgtgatcacagccacaaccatttgtttacatattgtttttcgttgctttctcactacaacagcagagttggttagacaggatgacttgcaaacctaaaataatactctccggccctttaggaaaatggtttttggtctctgatctggaaaaaggaacctatgtgagggagccagaattcgaacaaaaaaaaaggaggtggggtgtcaaatttatctaaattgtttttgcctgtgcccgcctagttgtttactggctcattgagtatgggacaaaagtatttttggttggctcatattgtgaacttgggaagaagatagtcctgtgaatattggcaacccatagtgcttaaaatttaggcaatgggattgtaaatgacagtattttttgttttaatttataaatgcagtttaaaattgttcatcagctaataaagtactgatgggagctgtgacattctcatttggttccatggtagtatttaacatttaggatttcatttaagctttaaggtgaaacttctgagtactgaaaatgtaaatatattttaagtaacataacacatttttagcagttatataaacttcctagggtcatcagcagaggactgttgtgaaatactagcttttagactttgtacctgttttacaggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcaggtaagtgccagcatctctgtatctgaatttgatccttctatgagttggtaaccaaaaccttcaaatattttcagccaaggggaaatcatcaacattcattcgtttttttatttctacttcaccttttttcagtcatttgaggtagcttaataaaaacagaaaactacacaaaaagtgactatattagcaatgagaaagtaagattggtattagtaactaatattatgcaatggggaaaataagttaggggtgagatttccagaatagaaggactatatggttttgtacacttttgcttagagcttcttttgcatatcacacaaacacagaaaccacgttcaaaagtacttaaaaaataagcttagggcaaacaaacttagtcttactcctgagatctcagggaaatctgagtcctcagaatgtttttcatcagtacagagaataataacattttgtatggctgctactataacccagcttaattctagaggggatccaaacaatatatatgttgaagtaacagcttcctgatgagtttgcttaattcaaaaagcttagttcataatatacgaaggaacaaggcaagttttatttgtttggttcaagtttgtgatatagtgaatggcactttcagagatacatttcttccctgacaggttttgccacaggcagctggactggagtatcaacattaataccatgttttatacatccttttagataggggcaggcattgtgcttcattcagagtgaggtgtggcatgccctctcttttttacctacttttttttttcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctggtgagttttgttgttgtggtttgattagtaactaccctggagtgtctcaactttatagtctctgttttgtcacatcacttttctgtgccttgtcttctgccacttattatttcttgatacttcctacttctagttgaatacaaaaagattgtttagtacatgttttttaaaatttttgccaaattcttcttcttccattaagtcatttctaggttatatgctacttaaaattctaatagtttagccatgctgattcataatgccgctttgcttccccagagacagtctcacagtctgattcggttacccaggcgctatcacgactcactgcagactcaaccccctgggcctaagcaattctcccacgtcagcttccccagtagctgggactacaagcatgcgccaccacatgcagccaattttattttttgtagagacatggtcccactgttttgcccaggctgatctcgaacttctgggctcaagtgttcctcctgccctgtcctctcaaagcgctgggattacaggtgttagctaccacatctgctaccttgtttttttatgcatctgtggaactggtcactcttgattgcattcaagtctagggtctgcaaatgattccttccattcctattaagttgggaccttgagttggggataataatacataaacaaacttgtctgtcctgtctttctagctaggtatatgaggcaagagtcccatcataaaaagtgagtcatttgggcagttaggtggaaaacacactcctttgcaagtgcttgctgtctgcccaccaagtgtggtttcttctcatcttttgacttaattacagtgagggccccaaggctgttgcagctcctcgacctgatcggttggtcaatcgcttgaagaatatcactctggatgatgccagtgctcctcgcctaatggttcttcgtcagccaaggggaccagataactcaatggtatgagggcatacaaggcttgggggaggccaactgatagaccaacataaaatatgtggtcctatttaaacaataggtcaggaaacttaatgaagcagggagacttccatattgcttataactagttaggactttctacacattggttcagccccctaacctaatggttgcttacagtaagaagcacatttcttttcttgatgctttgaagacagtttaggtaatgaatgggtcaggagtgcttactgtggattttctcctctaggaaagaattagtactgcataagatgattaaaaataatgcttttgtagtttcatttcggaatagtgaatgtactatgattgttgtgcgctcaaatcattaactgcagggttttttttttctcccccccacaggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggcctgccgcatgactcgtggttcggaggcccacgtggccggggcggggactcaggcgcctggggcgccgactgattacgtagcgggcggggccggaagtgccgctccttggtgggggctgttcatggcggttccggggtctccaacatttttcccggctgtggtcctaaatctgtccaaagcagaggcagtggagcttgaggtaagtttatctcatgcatagtgttcggctttgggctgtggaatgttcaggcgtttcactgatgccagaaatggagcagaatctatcagctggagacaaaggccttgggcgggggtccttccatttggtgcctacgtggggagatctttggagacagaagggagaatgggaaggagttgcggcctggaggcttcctgctagagctgagaagccttcggggagtaataggaagggggatttccattgcttaggctgagggcggggcccaaggactgttgaaaaatagctaaggatgggggttgctagaaaactactccagaagtgtgaggccgatattaatccggtgtttttgcgttctctagtcactttaagaaccaaatggaaggtcacactagggttttcatttccattgattatagaaagctttaaagtactgtagatgtggctcgccaattaaccctgattactggtttccaacaggttcttgctggtgtgaaatgactgagtacaaactggtggtggttggagcaggtggtgttgggaaaagcgcactgacaatccagctaatccagaaccactttgtagatgaatatgatcccaccatagaggtgaggcccagtggtagcccgctgacctgatcctgtctctcacttgtcggatcatctttacccatattctgtattaaaggaataagaggagagaaagtaaaaagttattttgggtatacattcagttatgcaataagcttaacgtgtttatagagaacagttcatttttattagctgctgaagtttctaaaacctgtccagtttttaacagttctgtaaactattgcaaactcagtgttgagttcattcatgagtttcttcatatataacagctctattacatgagaaacacaggccatagtagcgagactgtctgattgtatgggagataataggatggagataaaggattcagagatgagtgttcttcaatatttatttattagctagttgaagcagctgagaccagatgattggagtagcaagaacttgagatttttagtctttatgcctaggattttggtccctgtttgcagtttatttagttgtgtgatattgagcaactgaatctctcccaacctcattttcctcatgttttaaattaccataaacttgtcctgcctaccacacagggatgttatggaaagttaaataatatatttaagttatttatgaatggtaaagcactatgtaatagtacttagggattctattgttattatgagagttcatggtacagattgtcttcagtaagtggcacctaaggctctttaaataaagggttttgccggacacggtggctcacgcctgtaatcccagcactttgggaggctgaggcaggcggatcacaaggtcaggagttcaagaccagcctgatcaacatggtgaaaccccgtctctactaaaaatacaaaaattagctgggtgtggtggcaggcacctgtaatcccagctactcaggaggctgaggcaggagaatcgcttgaaccagaggcagagggtgcagtgagccgagatcacaccacagacctccagcctgggcaacagagcgagacttcgtctcaaaaaataaataaatagataaataaataaagggttttgtaattttgttcagtttagaaatgcctaactttagagattattttaatcaacacctggcctccctaccatctggctactcgtgtttaattgatgaaaactaactctaatgtagccactataaaaaattggttgctaacccttggcaaaatctttattttgagcttaacagctttaatattttacatgaaatgtttaatattttaattaaatatttttaaatgtttgatttattgagcaatttacataagtaaaatacataaattttatgtctacagcccagtgctttttgcgtttctatatagtcatgtagctaccacccagataacagtatagagcacttccagtactccagagagttctccaagtgtgatgacattaaaatacaagtaaaagtcctgttgccataaaaccaaaatgaaagtattttttatatgatctatgcatgtttgtcttcctgagaaattaaacataactataccttgtttggaacctttaagaatttgattcaggaatatttcccaaaggtacatctgtcatgataaaaaaaaaaccttctctgaaacaaaggtatttgtatatttagtcataaacacaaatgatgtatatagggccaggttataattggtggaggtatgtttagatttctttaagtaaaataaacagcacaaataaaacagtccagttcatagcttagtgaaatacactgggtacttaatctgtagcctcctggctgcagtagagttgtcatttgagttactgtgttttcttaatcttttccaggaacacagtgaccatatttcttttctgcaggcatatagaatttggtgggttttcttttatgtagggtgatattggatactttttgtttgtgattatatattagcaatttgagggacaaaccagataggcagaaatgggcttgaatagttagatgcttatttaaccttggcaatagcattgcattccctgtggtttttaataaaaattgaacttccctccctccctgcccccttaccctccacacccccaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacaggtactaggagcattattttctctgaaaggatgatctttgtgttctgaatctttatggggaaatgaggttaccacactagggaagatagagctttttaattatgggaagagttggttttaggttgtttgacattgagaatctagggtaattactgaaagttaatactggaatttattttacataatatactgttactataaagtttgataatacataagtgaagcttgctactgggaatgacttggaaccagagttgttgtaattagagatcacgaaggaatttcagagaggaaaacatctccaagaaacatctttcagtatgtaatggaaaagataggccaggcacagtggctcacacctggaatgtcagtgctttgggaggccaaggcgggaggatcactttcagcccaggagttggagaccagcctgggcaacagagcaagaccctgtctctacaaaaataaaaataaaaaaattagtcacacatggtggcagctactcgggaggcagaggtgggaggatcacgtgagctcaggaggtcgaggcatgctcactccactgcactgctgcactccagcctaatcaacagagcaagattctgtctccaaaaaaaataaaaaataaaatgataggagtaagcaaataggaagtccataaagatgaaaacaaagcaagggaacataaagatagactttgtccatagaaccataaagtttcaaagctagattggaccataaaaattctagtacaatattcttattttgcagaatcagaaacagagttcagaatgtcgtttgttaggttttggagtcaggattgttattagtagcagagccaggaccaaaaacccaaagctcctttttcttagcacagtgttcttaaacagaataatataatggttaagaatgagaactctgcctggattgaaacctagctctgtttattagcgacgtgactcaggggctatgtggctttcctaacctataatatggaaataataatacctacctcatagagttgtgaagattacagttttaataaatacgcaaatcactcagaatagtgcctggcacacagtaaatgctacttaagtgttctgcctaaaggcttgagtcttggcttattttctatccatgtgaagatgtctgctctcaaaagcagattggtccaacactgaattcaagtgttcttttcctaacctgttgtacttcccattttttttttgtctaaaagtaatagcagtacttaataaaatgcccacacttggcatgcatctaataaatgttttttgaatttctagaagtcatttttcttctttcttacaagaaatttattcatttttctatatgccttagctcaaaccaaagagtatttaaaacatcttatgaaaatgcatatagtagagcaagataagattaatgaaaaataggcttaagtgagaccaaaaaaataagggtaaaataaacaaatttaggagtgagcatattctgtgattgtgcatgaagttccagtggctttctaaaggtggactacaaatttggtcactgttgtgaaaaggaaagtagccagctgaaagattcagtatctgtatgctgaaagccgttaagttgctcggactagaaggaaattttcccatggatcctcaaagaggcttgtttaatgtaaaaatcagtagtaacctgacagtgacatggtccaggtactttaggctgtcttatcccttaatgtaggctattaccatcaagcacagttttgcaaatagccagtggaatgtagttcagatacatgactttgtgggtaatccaggggtagagactaaaacagtactgtgcagtatgtggttatttacagttaattaagattaaataaaatttaaaaattagttccttgactaccaaatgctcaatagccactagtaggtaccatgttgaacagtacagatatagaccatttccatcatcacataaagtactgttggattgtgttggtcaagacaatctaaagcaattgtttcccaggtgtgctgtgtggtgtgccttacatgtcattgaaaggggtgctgtcaggagttctagatgcttcagcctccctttactaagagcagttcttatgttttctattttatcgcttgggcttccagatacaatgttttgttttaggtttgttttttttgtttgtttgtttttttttttttgagacggagttttgctctggttgcccaagctggatggagtacggtggtgcgatcgcggctcactgcaacctccgcctcccgggttcgagagattctcctgcctcagcttcccgagtagctggaattacaggcgtccaccaccatgcctgactaattttttttgtatttttagtagacttggggtttcaccatgttggccgggctggtttcaaactcctgacctcaggtgatccacccgcctcggcctcccagagggctgggattacaggtgtgaaccaccgtgcccggcctgttttagttttttagagatggagtctccctctgttgcccaagccagagtgcggtggcatgacactctcagggttcaacctctcagggatcaagggatcctcccacctcagcttcctgagtagctggaaccacaggcacatgtgccaccatgcccagctaatttttgtattttttgtagaagcaaggtttcaccatgttgcccaggctggtctcggactcctaggtcaagtgatcctcccacctcaatctcctagagtgctaagactataggcgggagtcaccatgcccagcttcatctacaatttatttgaagaaaatgtttgagcaccacccatcttgaaaagtgatagactgccttccattaaatactgtcacacctagttatttagcagcagtgagcttcactttttatactttagaccttaatctaaagggtgatttctagttgccagttaaatccagagccaagctctttggagaatccaggagcctcactaggtcatgtatcaggataaaatacccatccactcccattagaaggtgagcttgtacttatggcttcctgatggctgctgcaacaagtctaaagcagtctccttagtatacaatgtcttctctaagtggtagaaaaaagcaaaaatactacaagttaatagggctacataaaatttgctagtttcttttttgccctagccatttattccttcctgaaatcttgtctctctctcgctctctctttctctcgctctcactttctttctctttttcttttctcttttcttttctttcttccctttcttttctttcttttttcctgttgcccaggctggagtgcagtggaacaattatggctcactgcagccttgacctttctggacccaggtgatcctcccacctcagtctcccaattagctgggactacaggcatgcgccaccacacccagctataatatatattgtatatatattttttatttataaatatatataaatatatatttatatgtgtaaattatatatatttatatattataaattatatataaatatatatttatatataatatatataatatatatttatttttatatattttatatatattttttggggggggttgggggggatggagtctcactctgtcgcccaggctagagtgtagtggcgtgatcttggctcactgcaatcttcgcctcccaggttcaagcgattctcctgcctcagcttcccgagtagctgggactataggcgcctgccaccacacctggctaatttttgtatttttagtagagatggggtttcaccatattggccaggctggtcttcaactcctgaccttgtgatctgcccacctcaacctcccaaagtgctgggaatacaggcatgagccactgcacccagcctaatctttgtatttttttgtagagaccgggttttgccatgttgcccaggctaatctcaaactcctgggttcaagcagtctgccctcctcagcctcccaaagtgctgagattgcaggcatgagccactgtacccagcctaatcttgtttttcttatgttctgataatatattcccgtttttagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacaggtatggtacagctttcagcatttgtgcaagagtttgcatcagttgattaactctggtagagatgtgatccatattcatattctttgttgttatgcatttttttcatttttatttttttattttttatttttttttaggcagagtctcactctatcttctaagctggagtgcagtggtgtgatctcagctcactgcagcctctgtctcttgggttcaagtgattctcctgcctcagcctcccaagtagctgggactacgggcacatcatcatgcccggctaatttttgtacttttagtagagacagggttttaccatgttgcccaggctggtctcgaactcctggcctcaagcaatcctcccacctgggcctcccagagtgctgggattacaggtgtgagccaccacgcccagcctgttgttaggcatttttagtagtgttctttttcttaacgcttgtttaaacccaaaatgaacttactaatattctgttatggcatgtttactcctgcattaacatccacaaatatttcttgggaagatccttgactaaaaatatttataaacattagttatttctctgtcaacaccagcccgtttatggcttaagcctcctgaatggagtctttagtttaatgtagttttgttccgtgtttctcacattacccttttcctttgcatgaatgtttatttggcaaaatgtgccatttttatatcagcctgttcttgtgattcaataggaatgtgaaatttagtgttctcttccttaaatcaccatattttattttatcagctattcgtttagtaattggaatcttatgtccacataaagagatacaaatgcaagagagcttataatttggattgtgtccgttgagctagctctctcattttttttcattttttccttttatagggtgttgaagatgctttttacacactggtaagagaaatacgccagtaccgaatgaaaaaactcaacagcagtgatgatgggactcagggttgtatgggattgccatgtgtggtgatgtaacaaggtgagcatatggtttcttggcataattacaaatcttagtatatagtattgggcaatttggaggagtgctggtgttattgtctatatgttttttgagtttctgcctatcctcttctgcacattttccatatgacaccctttctgaaagtactgaggtctaaagtgtttaaaacatttgattattccacaggtatctttatatttttggtaacattagaaattataagacattatttatgaaatgtaggcataccctattcctggcaatgaccaggaatttgaaggatcactactttgaaactagttaataaggacatggtttctgttctttttttacagatacttttaaagttttgtcagaaaagagccactttcaaggtaggacaagtttggaaatgtattctcattcctgttaattttgtatatttgtttttcttatactctgaatgtgtcacttatacaaattctgtttctatttcagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataattcttatattcactgaagtgcctttatagaatgctaatattaatttcaaacttttggatgtgacatttggaagtgttggaatatctgagttcctcatttcatcataacatcaaatatatcaaagcctgctttaaagtattaccttggggatgattcatagctatttgtcagatttgcatacattaagatgccattggagctcttttgtctcgtttttgcattactgcacaatctagccatcttggtataggtggaggagcattgatgctaggggctggagaacttgaggcccgatataattttactacgccggcccagtttcttcaattgcaaaatagaagagttgaattaggatatatcagatttcccaaccttaaggagactttaaaaagaataatatcaaacctaggcattttcaactaacactggaatactaattttggagaccttggtttactctaccaaagacatcaaaattttttttcacttttttttcttgaaaaggaggcagggaaggtaggtcattaacatgtggctgaagtaagcttgggaaaaccaattttaaatgacaatattttttctagctaggacaactagaaagagtaaatattttaattataaaatgtatttgaaaaagaaatagaattagggaatttgtatctttcaaactatcacctcatatagagacctaggtgatagtttgagagagaaacatacaaagtccacagttctatttctttttcatatacattttacaaaaatttgttctaatgtttgaccctctaataacggaaaagaggaaaggatgttttctggtgagaactgctgttctgttcagcaaaataaagctacagaaacaaataatgagaaggtacctaaagaagcttgtttatttggaatatgagggaaccacctgtgcatctctgtgctattaaggtttctgttctcataagcaatatttaaggtcactgaaaggccaacatagttgcatgagttatttgatacccataaatacatgagaagaggccaagaggccttgctagtgatcatttcgcaaaactgtctgaggatgtccagctccatgagagcacagagagaatcactgtccagtttccaagtgggaagggtatgctttgtaatgcttttaaaagtaactgggcagtgaaatgtgaccctttaccttaataaaagacagctggaacttcaggaacatacaaaatagaaatattctttccagttgcaaaaggaacataagagggttcagattcatgaaccaagagttgagttgaccattcttatttgcagttgaattctaccatatgatttacttcacacttgcaccgaaatagtctattataaactactggtgttgggggtggggcgggagtgggaatggggaatgaaggggaggaatgaacttagtttcttaactagtataaattcagattaccatcaacttgtagaagccatatgaagtaaaaatgggtagcacctgcaacactgggacttagcgtgctattaaatgtttctaaagatagaggcacgtagctacatgtctcataggggaggatgtggttgtagctagcagttgcctactagcaggcttctttatttgcagcagcctgaaatacccaggttaggaaaagcaatcttccagaatggatgctgtggacatggtacaattggcgctattgatactttctgtaggagcttgaaatgtgtggattgtagttaagtctgaaagaaaacttgcacttgattttaaaacattttcttataaatcaattcacatttataactgagacccaacattcctgataggaatatttttgtaaatcaatggtatgaagtgtaaagacatgttgaaagttagaagaagagatcttttaagtgtatgcttgttttggctgtgaagctgaggggtttgacatttactattaaagttcaaaataaaactagcatggcatatgaagtagaattaccaaggcctgtgtttctctaagagaaccatatttggatcccctgtgaggcatagccataagccctaacaaaatgtttttgttacactggtttggtacattttccttaagactttcctacctaatttatttatgtatctagcccctgtgctgctctgggcatacagcagtgaatctgacagatactggttccttatgaatcttttatattctactgagtctccccagaaacctctaaaacaaaatttcttaattgcaattttgtgattatttcaaaggtgaaggacggtgtttactctgatatagctcgtttaacctcagtgttctggctgctgacctctggacactgtccatagtcaccttccctgattttcctgcaagtcctcttggctatccaagatgcagcatatactgactcacaactcactgctacttgggcctctccttttcaagtcaaggctatgtagaaacagaaaccaatatttttatattgcttcaaaaatgtcaaagtgcttttgcatatcttattttatccttcacatccatatcaagtaggaatcatctccattttactgatgagaaaactgaatcccctaaaaatgtattgattttatctaaaattcaaacccaggtctcccgatttccagaatctgctttttttgattcactagtaggtttttttgtttgttttgttttggtttttgtttttgttttgagacagggtctggctctgtcacccgggctggagtgcagtggctccatctcagctcactgcaaacctccacctcccaggctcaagcaatcctcccacctcagcttcctggtagctgggactacaggtgcaccaccatgcctagctgattttttgtagagaaggggttttgccatgttgcccctgctggtctcgaactcctgagctcaagcaatctgcttgcctcagcctcccaaagtgctgggattacaggcatgagccaccatgcccagccactagtagtttttaaaccatgctgttcaaagtccttggagtgtaaagaagactttgcagagaggctgaacggctgtggttctgctcctcctcccttgtcccccaacttcaaggaaggaggaggaggtagggtgaagagcaggttgggaaaaagtgggagttcccaacaagtttcacaccagattaattccacgttcatctctttcattttaggctttcattcaagatttagtttgaggctgggcatggtggctcacacttggaatctagcactttgagaggccaaggtgggaggatcgcttgaggccaggaattcaagaccagcctgggcaacatagcaagaccctgtctctacaatgttttaaaacttagctacccccacacctgttgtagtcctagctattcaggaaactgaggcaggagggtcacttgatcccaggagtttgaggctgcagtaagctatgatagcaccactgcattccagcttggcccacagagtgagaccctgtctctagtggggggaaaaaatctttagtttaaaaaaaagatttcatacgtaaaactatgaaaaccacttgacttcaccaatctacttctacaaccatctatcaaactgggaatcactagatcacatcctcatgtctagtccagatcccaatattctatagacacaatcatgttcattgcactctacataatagtgagatggtgtataatacagtgcttaagagcccccactctggagccagaataccttgccttgaatgccacttctaccacttattagttgtatgaccttgagcaagtcaacctctccacacctgaagtttttcaactgtaacatggaagaaataatagttcttcaaaagactattgtgaaaattaaataatatatatatagtatgaatatatatatagtataaataatatatagtataaacaacatcaacaagaaacaataacttagaacactatctaacactgtttttattgcagggaccccatagtatgcctccctccctctctcctctaacagaacatagtacactgctgaagtacagcttgttttgtttaaagcaaattgctgaatttcatttccattccagagacaggaaataaagtcagtttgtctcacggaaaaggatgtgtctcaaaaatttgacttctttatttttaggcgtgtgtgggaaattattactgacaggaaaattagactgaatgcagtaaagtagcataaaattcctcatcattccacaggtttggttatgctccaaaccaaaacgcattccttaagtataaaggaattgttacacacctctaagaggatgacaaaacctatagttgctgctggcaactatgttccagttctattcctaaactggaagttgtaatgaactcagaactgctcccactgaagcaatgtaacaaaaaaaaatggagctggcagtttaccgatggtcaccctcagccccacagaactcttgggtatgctgtcttctcaaccacaacttactgtgggcattgaggcattgaaggatgtggggtgatgaacaggttggaaagaggtgggagccccagcaagtttcacagcaaggagagagacctgctatagcagaatggaggtaaaggctttctggacaacaaggagccaggcacagtaatctgtgtacagttaagtcctgtacagcgtcatctgcttcccgcagagcctcaggtatctccaactcaatgaactacaagaaatctcctatttaaaaagtacctttgtaaatttgatatttggatcttagaatgatttccactaaaataatgttgtaaacaatggttaagtccctaggttagctccaactgatgtggtccatgatatagctgaaatatttgcacaccaatcattttaaaggacataaaaaacaggtggggggctaggggagggataacattagaactacctactgtaggtgacgggttgatgggtgcagcaaaccaccatagcacatgtatacctatgtaacaaaactgcacgttctgcacatgtaccccagaacttaaagtacaattttaaaaaaagacatagaaaacaatatttttgctaaaactaaaacaaaaatagaattcagtgaggctagtttatcttatatgctggtgcctgaagaaaagcatgcttaattagagaaaaagaatgagtagatagacttttcccattagagggaatttctgggcattttccttgaaggctgcggatgatgatacaattgagatttttattattgttttcctttaaatttagagtttgtttcctgatgatagaaataatacttgttcatggcagaaaatgtacataagccaaaagaatggggtaaaaatcaccatcatcacactacccagaaagagtaagagtgtaaactacacaagctgctttcaatgcctagagtgatatgtaaattaatacttttctttttttacaaagacaagattatactatatatacattgttgtaatattattttcactaataacattttgtgaatgtttttcatgttaatatgtattcatctacatcattattttattgtgtggcattttattttatggttataccatgctttattcaatcttttattgtagacgtgtgggtttttcctaccttttgactattataaatgtttagctacaataaacattcttgaactacatttttgattacttacataaaaactttcttaagaaagtcataaaaataaaggcacggtggctcatgcctataatcctagcacttcgggaagccgaggtgggcagatcacttgaggtcaggagttcgagacaagcctggccaacatggtgaaaccctgtctctactaaaaatacaaaaattagccaggcgtggtggcgtgcacctgtaattccagctactcaggaggctgaggcaggaaaatcgcttgaacccaggagacagaggttgcagtgagccaagatcaccccactgcactccagactgggtgacagagcaggactccatctcaaaaaaaaagagtcactgaatgtttccgaactgagaatataatgatcaagtggtttttcagaagatttaacctggtggtattatgcaatatggattggaggcaggggaaataattaggaatctattacaattatccaactttgaggtaactcatgacttatcaggtagaattacattggcttctaataataaaaaaaactgactaatcagtgactaaaacaaatttacttttccctttttttttttttttttttttgagatggagtcttgctttgtcaccaggctggagtgcagtggtgtgatctcagctcattgcaacctccacctcccgagttcaagtgattctcctgcctcagcctcccgagtagctgggactacaagcatgcaccaccacacccagctaatttttgtatttttagtagagacggggtttcaccatgttggccaggatgatctcgatctcttgacctcgtgatctgcctgcctcggcctcccaaagtgctgggattacaggcatgagccactgcgcccaaccatttttcttatgtatcaagaagtcttgctgggtatggtgatgcatgtttgtactcccagctactcaggaggcttgggtaggaggatcacttgagtccaggagttctgggctatagcaatctatgctgatcaagtgtccacactaatttcaacatcaacagggtgaccctccaggagcgggggaccaccaagttgcctaaggagtgaactagcccaggtctgaaacagagcaggtcaaaactcctgtgctgattttagtagtaggatcactcctgtcaataaccactacaccctggcctgagcaacatagtgagaccctgtctcttaaaaaaattccttaattaaacaagaattctaaatatgggaagtcctggactaatatggtggctttaggatgccatcagggaccctaattatttgtttctgttcagatagtcttcatgtggctcttgtcctgctcaccatttgtgttaaaacaatggttggtttggaggcccctatccacatatttcctttttcaggcaggaagaagaggaagggcaaaaggcaaaacatatgccagctgagctggtcccttttaaaagaacttttggagacatcccacccagcaattctgctta

SEQ ID NO: 1765 - DNA, 180537 bp, Homo sapiens
  SYCP1 gene - 115109497 - 115250033 of chr1; NCBI Entrez Gene ID: 6847; Build 35; sequence includes 20,000 bases upstream of initiation codon and 20,000 bases downstream of termination codon of the gene
tagtaaatgcagttcgcaatagattttcacatgcttgacattttaatcttaacataagattcttataaaaggtaaagagaaagaaaacagaatgcaatagaaacaggaatttttttgcaaaaagactaagattataatataaatttaatcttaaatgcagctttcttttatagtttgaactctgatttccatgccaacagaacatcagccagttttctactgtagtgaaaaaaagacggtcttatttgacagtcatccaagaaaggtcctcttcttctttttttttttttaaagaaagctacgttgttttactgttaaccttctttcttatataaggctgtcatttggtattcattcaacatttagcattgctttggatactgtaagattgtaaatgatttatgtaaattaattaaaattatgatgtttaccaatcttggtggcagaattttgaggataagaataagtctaatcatctaatgattcagcaccaggggaagcacacatattaaagacattgaacaattaagtattcctggatccttctatagccaattttgaaattttaaatttagtagttctcctgaaagcaggaagtaagttggtgtttgggagcttctgataataatgatatacattatgtatcattttataatatatacatgcttttaattacgtatagtcatgtgtcacttaataacaggtgctgcttacatacgttctgagaaatgcattgttaggcaatttcatcattgtgtgaatatcatggaatgtacttacacaaactagagagtatagcttactacatacctgggctctatggcctaacctattgctcctaggctaaaacctgtatagcatattactgtacttaatactgtaggcaattgtaacacaatggtaagtatttggtagattattctaaacatagaaaaggttcagtaaaaataaggtacaaaggataacaaatgatacacttgtatagggtacttatgaatagagcttgcaggactggaagttgttctgagtgaatcagtgaatgaatggtgagtgaatgtgaaggcctaggacatcactgtacattactgtagaacttataaatactgtatacttaggctaccctaaagttataaaaaattattttccttcttcaataataaactaattctagcttactgtaacttttttactttattaacttaatttttttagctttttgactctttggcaataatacttttcttaaaacaccaacacattgtacagctgtatgaaaatattttccttatatccttttcctattcttaacttttttctattaaaattttttaaaacctttaaaacttttttattaaggacaagacacgaacacatgcattaacctagatttacactgggtcagaatcatcagtcatcttccatctccatatcgttgtccctctggcaggtcttcaagggcagtaatacacgtggagctctcatctcctatgacaacaatgccttccctggaatacctcttgaaggatctgcctgaggttgttttacagttaacctttttttttttttttttaataaataggagcacacactaaaataatgataaaaactataggatagtaaatacataaaccagtaacatggttgtttattatcattatcaggtattatgtactgtacataatcgtatctgctatacttttacatgactggcagcacagtaggtttgtttacaccagcagcaccacaaacatgtgaggatggttatgacatcactaggtgacaggaatttttcagcccctttataatgttattggaccactgttgtatgtgtggtccattatttacccaaatgtctttatgcagtgcatgactatatttcatttcattcttacagtgaccctgtgaattaggtaaatttactcagataaacaacaaaattaaaaagaaactagtaatttaaatctggctacaaatggcaatgaagggcattgagatatagcaaatgaagagttcagacaaaatttttcttttgtttgaaataagcagataactggtaaaagtgtattttagtttgattttttttgcgaggtagtgaaataatttattaattcatattgttcttgaccggaatacactgaaactaattgtatccacaagggaaatgcagaaggtggggaaaaccttcttctgttccaaactctagaacatattatttttcacttgagggagaatggattgctatgtaagctatgagcaatgattaccctttcttatagctcctgagcaacctctgcatacctctgggattgtagcatttatcatgtatcagttgtttactgtctgtccatcatgctggacagaaagcttctgggatgtagtggatatgttgaactaactttgcttgttgagattaaacactttgaaatttgaaaactattaggaaattttgactttttaccatttgttctttttcatgttttaaaaactagatattttaccagaacaaattagttatcagctgcatgacactcattttaaaaaatcaccttattgccagtattctattgctcagtttcctccagctttacagtctgaatctttataaaatcatttcaacacttatagattggatccacaggacagtgatggtggacagtgtggatttagttctcgtgaattaaataaacccacttatgtggttgctcatgatgctgaagatggataccctggaataaaaaggtccagaccaacctattcttcctcgagaaataagggacaggaagaattctgtgtagtttgtggtgataaagcatcaccatcaccatatcattataatgcacttacctgtgaaggttgcaaaggtaaggataagattaaaataaaattgaaatcttagtacaaaattttaggcatgtgagaatactcttactttttaaagtatgagagttaaaaccagggaaagccatgctgtgattaaatggatcagtctgtgggatcaaagacatgaaaatggaatgaatgtaaagtttatatgtagtgtttttttcatttttcatgaggactcttacatttaattgtataatttgatatttatagagtagaaggtttccatattcctagatcagtctcctgttggaagagaaaatgatgttttaaaagatctgaatgtttactatcacatccttttatgtggttgctataattcatgcatttggaggaaatttgaattgaatgacttataagattctatattttttaacgctttgcaaaaacaaattaaaggtccgaaagtgaagaccattgcattttccaagagtgaaacagtccttgataaaatttgaggttttgaaatactcctgcatggcttttattaaaaaatgcagtttggggacagaacttgtgaatgattaggtcaatatagtgggaaaacatgtcttgtagaggttcagagtgaagtttcactgttagaatcttacaattcaccccttacaaagaatagctaaatgaagactatgggaaatgaagtaacagctttgtgaatagaatagctgggcacatgtttacttactcttgaaatgcagggccttgctattaaaactagattgacaaatgagacatagttctggaaaccaaagctgaactttttactctttttgttgaatctaaatcatgaaactcccactctcaagtgtctatggaaaaagacgatatggctggactttaagagggatattgactaagtttattgacttcactgcttggaatggaagaaaaagatagcagggattattgcataagaacaggaattgaaggaggaaatatgaagaggaactactatgcatggatttagaaagtgaaagagagaatgtagacctccccctccccctgccaaacatggccccctcaatatctcagtccaaataaactagcaacactttctcatctgggaaagtgctaaaaaagagacatacgtagggaagtaagtttggaagaatacttcttcctttgtgggttgagtggaaatgtgagagaagaaaaaagattttctttatagttttattttacatgaccacctattctttaaaggaagtcttgagagatgcttctttaaatcttgatattctgtaaaacatagttttaaaaatgcttttagctgatataaccacagtaacatagagagttgacttaatgtaatagagctattgagtttaatttccagatgtgattactgaaaggaataaccttggaatagaaaacatgaatcaggagagggttaagacaactatccagataaatgtatatcaaacgatcttattgagagaaaaaacattttattgaaataatttagttaacgtgattaatatgaaggcatatattaataaaaataattaactagaaatacctatggtaaaaaattttaaaacttttttattgggtttttttcaatgtagcatcaacaaaatgcagtatatagttgcaggaatggtagtcactgtgaaatggacatgtacatgcgtagaaaatgtcaagagtgcagactgaaaaagtataaggcagtaggaatgttggcagaatgtaagtgccatgtgttttgcttttttctgaggcggattttgattttttttaccttactgagaacttaattttgaatgtctacttatttgtttggatttaagctatttctctagcaaactactcaatttggatggccagttacgaatgtaagtaattatttccatagaccctgctccatattatcttgctctaattttggaaataatcacattttcttcttaattgaaaatccttgtattttcatgttacttaacctaaagtcatgtattgcatctagaaagaggacaattttaagtcagtagtttccaaaagcttacaagatacctagttatgtagcatctgctggtaattaacacacaagtgttaaaactcaactctataggcagaagagtatgtaatctttttgaatcccttctatgttcactgtgttttttgcttagattatatgatgttatttaatccttacagtagtactacaattttgacataatttcctcaatttctcctattccttgtggcttacttttttaattaatttttttcttctttccctccctccctctttttttttttttttagacaaggcttgctctgttacccaggctgtgagtgcaatggtgcaatcacagctcactgcagcttccacctccggccttagcttctcgagtagctgggaccacaggcacatgccaccatatctggctaattaaaataaaattcttgtgtagagatgagatcttgctttattgcccaaactggtttcaaactcctgggctcagtgatcttcccacctcagccttccaaagtgctgggattacaggcatcccatcatgcccagctaatttttctttaaagagtactattaatgttttcttttcatgtctaatctagccttgttcaaactcttattattttgcatttatgctataatattagtttcctggccatttcttccttctctctttttggtcaatctatctttagctgtcataataatcttcatttttttattaagctatactcttgttcaataaatgcccatgcaatattccttttatttcatactgattattataaaacccaatctctcttgtcaaagttcttcatcaaaaggattcatattacttaaaatttcagatatgttataaatcttaaggttatcctgtccaactagcctgaatccttcactttagccctgttttagttagcttgagttgccataagaaataccataaactgggtggtttaaaaagatatttattgtcttacaattctggaggcagaagtctgagatcagggtgccagcacagtttggttccgatgagggctcccttcctagcttgccgatgtctgccttctctgtgtgtccttacacagtggagagaagaaagagcaagctcaccagtgtcttttcttagaagggcacaaatcccatcaccagagctccacccctcatgaccttatctaaacataattacttcccaaagcctccatctccaaattccatcacattgagggttagggcttcaatatatgaattttgaaggatacaattcagttcctagcgatccctggtaagttgtcttttaacctatacatgaaaacctatgtgaaagggaactcattttctcccaggacaatccataaatgaaatcagtcctcctttcctctaaacttgaaggaattattccaaaattgaaaaaagagaacctatatgagtgttgctgtcatggaatatgaatataaacattattcaaatgttatttatatgctttccagtctcccactgcatctttctatgcctctctctctctctcgtttatccttctacatttgaattcctggctgtccgaccccatattctaggtaaaaggagttttcatcaggaaagccctggatttttatgtggcttggtttcattccataagcatacaactgaaatgatggaactggaaaaagatgaaccaaaagtattaaatacacagtacattcctatcttcatagaatacagaagtcccagtaaagtaatcggcatatcattaaaactttgtgattcctatggagtacaccaagctagtacacttgcttctcaagcatttggtgcctatttatctgagaggtgtgttcacagaacaatgtgcatatctctctagacttaggtctgcttaaatctatatgtgtcaaataaaacacagaacaatggagatattttatttgaaaggcgcactgcaagtggggaagggacttttgcaatagggcaagggggactactgcaataggaagaatgctgtagttaaaagatacacaagcaattcaagagttaggcaaaaaagagttttatagaaaggaataaataaagctagaaagaactgattacagagtaggataaaaaggtgatacgatcagataatgtatcagagaatgttttactctgagtctagcctagtctcagaaagctatgtttgctggctcaggcttagggtggatcaaagtttcagggcctggagcaagaaatgaaggttagccgaagttttattgatacatattttgttttgattgatcagtggggataaaacagttaagataatcattcaggaagcagagaatgtgaatttgcatggtctgtgtctgcctttgtcataggtaaacaaaggggcatccacgagtcttacctaagtcagattgggaaaggtagttctttgcaggaagccattttccagaacatagaaggatgggaagcttcctttagctttcgctattttatatgagcatgggactcaggtaaaatttgaaattgtcaagacctagtgatttgagggttgccccacgtttgccctaaagtaatgcatgactttgtttttatgatcctgccaccattaccatagatattcatactacactcaccattaaattgaactaatatacttttttttttcactttcgtaagtaattatagaagcctgtgcaaacagagcttgtacgacattactttctttcctttggagtcctaattcccttgccatatgatgatactttaagtatctgaatatagctatcttgttcctcatgaattcctttctctcattttaaagtatcatgtccattaccaaacatggtaatcaaacatgtgcaaagcagagtggaattcagtctttataggtactatgggttaggtatattaatatagtttaagaacacattggcttttaaaggtggctgctctgtagatccctttttctctgttttaatctcagctcaatcttattggctgctagtaaggctggaccctgaaactattatctcatattgagctaagtaagagttgacagactacctccttttgcttgtacatgtactgctattaatttactgttattaaccagttcagtctacaaagttcaaaagttgtatgccaaggacaaatttgatttattagcaagagtgtgccctaaccacactctgaggtatgattaccgtaggatatcccaggtagtggaagttatttgaagtcagatgagttgtaatgtcatggttccagattattggtgaattaaaatcctagccaaaggttgcagacataggagaccaagtcctctactttcaggggagctggtgagatctaagaatgtttataggccactagaaaaataggttagggctcaagagaaggtttcactctcactggggagctgaacagaaagctaataaaaataaaaaatagaaccgaccattttccacatgtcttacttaattctcactataaccacaatgaaatacgcattttatcattccattttatggatgaggaaagcaagtcatagagtcacatagctaactaggtggtagagccaacattcaaatccaggcatgctgaccaactccagtattggttatgttaaacattatgtggtgctacagtcagaaatacaatgtgtgtgactgtgtcccccttcatgttattcaagattggttcaaaaacattgcaaagccgaccctgcaggttaaagatactagcacttcctgctaaagagcattggaaaagtcagggactgacatcatgtgcaggtcttaatatctatcctcagtaaacttttcctttgttacatttcagcataatattcagtctgaagagctttaaaaaatttttttttgtcatatgatgtttgggttatttaagataacattgacaatttgatccataatgtggtttaaaatattgtctagaactagatgaaatatgaaaccttatgacttaccattaaagatattcttatagactggcattcatctatttatcaactttctttgaatatggttcctcaagtagttattactttacaccaacaatcttgaatccaacctacatctccatcctggctctaagcatatattaagaggacttgtgaaatgacgtgttaaattccatatatactttgtctaaagtatttccttgatcttccattctaagaatcctgtccaagacagaattgaaattaagctgacatgattagttgttctgttaatttatactgggtttcactgattattgcttttccttttgagtttccataaacaaattgttcagatgtagtttgtatgaaatttatctttctgcctctttttgaaaatcatcatgaagccttctgacttctaatgacatttcccttattatctgctattccttcaatatcagactatagttcaattctatagaaactaatgtttttcagttgaagagatataaatgcattaagaacacttgcctttaaagaattttttcacccatttagatgacgattttattttgtgctgtccaaaaaggttgacttgtttcctttaagttgtcgtcaatgttacatacaggcaccaagctgtgagtctcatttcttgctttggatgtaactaaaaacatgcccttttcccatatatcatggactccattttgacatggctccttattttttttctttttctttttccttttttttgaaaggactctttttcctttttttttgaaacagactctgttgctcagtctgtggagtgcagtggtgtgattacagctcactgaagacccgacctcctgggttcgggtgatcctcccacctcagcctcccgagtagctgggactacagacacatacaccacgtctggctaatttttatattttttgcagagatggggtttcaccatgttgccccggctgttctcaaactcctgcatggctcctttctttaaaggagtctataatttctctttccaaacagttaattcttgttaatttgaaatctttccggagttgaaattctttaccaccatttcctcttgtgcctgtgtaagactttatgaatttatttttcaccctttcatgacttatcttcacttctctgccattcccttttcctttagggtactcttctttctcataactaaaacctctttcgaatatacctctttagtaagcctccccacaattaattccctctgattctaatgactccttttctttatataatttttgcatttgtgtattcagttctaattattttaatatttgatattccttaaatggcttcatattttgatatattcttgtttcccaacaaaataatgaaataatttagaaaaaggctaaggcttttgttttttttctacctcagctcctgatatactttttatgtgattggtatgttttaaacacttatgaaaaaatgacgaacataataaatgataaagattagtatttggttagttttagtagttgtttacaacaactgttgctcttcaggtagaagttctagttgaagattcaaagatgtgtaaaggtggcaagtcaaaaataaaaattgttcactttataaagagtgtccactgccttgtcttgattataagaaaaaaattgactgagctgattttgaacaccacaagatactctcttgaccgtatgatgtaaaaatcaaagataaaagcctgtagctaaggtagttcaactgctttatgagttgatattttatgttgtttccaaaatataattcatgtgaaaattgttctaatattaaacagtctaaatttataatttggagatttaaaattaatgtataatttatgtctaggatcactgtgtacttttaagtaggcaagatagttgtggaatgaaaaggagaaagtaatgtagtaaatgtaattgctatgtacatacttgcccaaaagaaggattctttgtaaaaagacaagtctatgatgatatatgtatatatacatgtacaatataagagaattttaatcctatcatgttatctgtcataccagaaacattttatatgaattttgtaataacacaggtttgctcacagaaatccaatgtaaattaaagagacttcaaaagaactttaaggagaagaatcatttttactctaacatcaaagtggaagaggaaggagtagaccacagttttctatcatccaccactagacctggaaaagtggcaaggcttttcttataaaatttgtttctttaattatggtgttttgtttaataattatgaattctatatttataattttcctcctatattttcttatagattcaggaaagcatggaactaactgaagaggaacatcagctcattaataacattgtggctgctcatcaaaaatataccattcctttagaagaaacaaatttgtatgtgttcattactgaaagaaataatgtataattatgttaggaaacaaaggcataagcataacagtttaaaatttcaaaagatacttgaaaaaataaaattcattaatcttattgcttttttatgggttagctgcaggaacatacaaatcctgaactgagctttttgcaactctcagagacagcagtcctacacatacgtgggctaatgaattttaccaaggggctcccaggtaattacctttgggaaaaattaatttaatacttaagttaattttataaaaagttccctgttttaagggaagtggatattttaggaaaaggaaaaaaaccctctattttttcaccaatgttttgtttcttttttctttttcttttttttttttttgagacggggtcttactctgttgcccaggcgggagtgcagtggcatgaccacggctcactgcagccttgacttctcgggctcacgtgatcctcccacctcagcctgctgagtagctgggactataggcatgcacaccatgctcggctaatttttgtattttttgtagacagacggtttcaccattttgcccaagctgatcttaaactcctgggctcacaaagctgcctctcaatgcaaaaacgtgtttattttgtctgctttaatcagatgggtgaaaatctaaatattaaaaaatactgctcagagagtagaattcagataaaagaggctaggaagagtagtgtggtgagaggagtaaggatggttaatgggtacaaaaatatagttagaattaataagatctagtatttgatatcacaacatgttgattacagtcaacaataatttattgtacatttaaaaataactaaaagaggctagtgcagtggctcacacctgtaattccagcattttgggagggcccaggcaggagaattacttgagcccaggagtttgagacaagtctggtcaacacagcaagaccccatttcatcaaaaaattaaaaaaatctcaggcctggtggtgtgtgcctgtggtcccagctactcagaaggctgaggctagaggattgcttgagcccaggagttccaggttgcagtgagctgtgatcacaccactgcactctagggcgacagagtgagaactttgtctctaaacaacaacaacaaaaacccccacaaaactataactggaatatttgtaacacaaagaaatgataaatgcttgaggtgatggatacccattttccctgatgtgattattacacattgtatacctgtattgaaatatcttatgtaccccataaatatatatacctgcaatatacccataagaattaaaaataaaaaagtgaaattattaaaatgacttcaaagacttgagagttaagacaatcaaaaggttaattgcttatttttggaaaatgacttttttttttctataatgcatgtaacaaagaaaattccctgtacaatactgaaaaatcaaaccgctgttggccaaaacttagctatctatttacatgtacagatatctcatcgtaaacataaattcttcaaggctaaatcaactatgtttaatttgcttttgccacaggaaaaatattattcagttctgataaaagtgccccaaaatattaccatgtggaatcaagaatttatttcaaatttgaaataacatattatgattattctaagggagcatttaggattcatactattatatgaataatttaaaatgttaaaatactacatctgaaaattatcttttgattatcgatttcaaacaattatgtgatcttctctttaaaggatttgaaaatttggccaatgaggatcaaactgcactacagaagggatcaaaaactgaagtgatatttctccatggggcccaactttacagtcagaaacaatcagcctctgaaagtaaaaatggatttttttctaactttaatgttaatagttactgttaaatttagcaacaaattgtataacattgagctattttttattttaattttgccagttactataggcaaaattacttaataatagctcttcataaaaagctatagttttataaaaagctattttttattatatagcatcatggaaaacacatttttggagggtctcctatacaatctttctataaactaaaaactattaatttaacttcttgtttcagtaataaaaattataaatctatcatttgctgggagtatttctgatctaacaactatgctggattctgaaagattgagtttaaagattagaaaaaaaatcaggctttatatttttcctttttactaggttctgtgagaatattaaatcattcagattatacaccaaattgtcacaataggagtggtgatagaagtcttatttgttctatggaaaaattttacaatgaagaatgtccttctactactctaattggtaatatgactcaatatgaaatattatattggatgcaaaaatttgtatataatgtttaactttcttatactgctttgagatacaatgataatttccatatgtttgattctaccctatgtttggatgaaaatacattttcgtatcagttttttgggtgttactgaagaatttattacacactgttttacttctacaaaagaatgagcaaacttgatgtaactaatactgaatatgctctgcttgcagcaacaattgttttttcaggtaaaaactttttttcaggtaaaaaccattcagtggtaaaaatctgtattacatttggcaatgaaatgatgaggtttgtggttactaaattattaattacagccaaatgtaccaattttgttttatcacaatttccttctctacaggagcattcctttaagcttatatacatgctataattttttgcaacttaaaaaaacgctttcttgacctcatatccactttcacctactcttatttctctgttccactttacagaaaaaaatttctttagagggttgtgtatactcccttctccattccttttgttaactcctaaaccctctacagtaagattatgtcctctcctctccacatcaccataaccagtcaatatctttgggatcttggcattgctgattccagtggtcaattcctagtcttcagcttacttgacccatgagctacatttgacagatcacgtcccctctcttagaacactttcatcacttggcttcagttgatcacttcttccttcttgacatgcatgtttttttcttgatttccaagaccccacacactcttgatttttctccttagtggttgcactttcagtttattttgttaattcctcttcatctcccacagagacaaatgacaagaatattccagggctcagttctcttttttctgtactcactttctttgcaatttcatcctatctcatggctttaaaggccatgtatatgctgaccactcctaaatttattatatataccaacctggagtgctctcccaaaccccattaaatagcctattcaagattttaacttggatatctagtaggcatatcaaatttaacacgcttgaaagtgaattcctagttgcctccccctccatccttctatatttgttctccatctctgctaaatggtattttccatccttgaagttgtataagctaaaattttttgtcatccttaacttctttctttctcttatacccatatcaaatataccacaaatcccactggctctgctctcaaaatatatccagaacttaaccagaacttactatttctatctttaccatcctaatttaaactactctcctaactggctttttctgtttctgcccttgcctctctacagtctattctctatacaggagccagagtaattctttgaaaatgtaagtcagatcatgtgatacccctcagctcataacccttaaatggcttcctattttacacagattaaagccaaagttcttttcatcattgcctattactattccttttgcttattccattccagccatgctgcttttgacgcagatattcctaaaaaatttcaagcaggctcctggtacaggttctagtgtatttgataagtcttctgcctggaaacctctttccccagatagtcacatgactcccttattcaccatcttagatttccgctaaatgccattttatctctgattcgcctttgaaaaattagttaccaccccttaccctaaattcttatcctcctccctgttttttttcctctataacacaccactctgctatattacgttattactttaaaaaatgtgtatatgtctctttcctccccaactgctctcagacccagaatataaactcagtgaggggagaaaattttgtctgttatgttcaccgctgtatcgctagcacagtgactggatggatgaatgaatgctgcctaaacattaataaattattgattggctcttatattttacagctggatacttgaacaactttgccttttatttactgttgatcttgggaaaattactgaatttttttaagtttcaagtaagcccttggctgcttttatattctttttttttttttttttttttttgagttggagtttcgatcttgttacccaggctggagtgcagtggcgcaatcttggctcactgcaacctctgcctcctgtgttcaagtgattctcctgcctcaggctcccgagtagctgggattacaggcgtccaccaccacacatggctaatttttcatatttttagtagagatggggttttaccatgttgggcaggctggtctcaaactcctgacctcaggtgatccaccagcctcggcctcccaaagtgctaggattacaggtgtgagctactgctcctggcccggctgcttttatattcttataactacttactgacccttccttcctatgtaacttagtggaaattacttaattttctaggtttcaagaagctcatctggaaaatggtgataataatagaacttacctcatacagtattgtgactactacataaaataatacatagaggcaagtcacttagcataatatttagcatatattaagggctcagtaaatatttgttttttgttatttaaaagctgcattgttttaaaagattatttatcttttgctactttccaatatacattaagataaatatgatgatatttttcagatcgtccatgccttaaaaataagcaatatatggaaaatttataagaaccagttttacaaatattgtataagtattcaaaaatgtatcatccagaagacccatagcattttgcccatctcatatggaagcatactgaactgagaactctgaattataaccattcagaaatacttagcacttggaaaacaaaggaccccaaattggctactttactctctgagaagtgaaatttgtattcttgctgaaattttagaatgttgtagtttgttttaaacttcctaaatctgaattgtttaccatataggatgactttatcatataggatgactttatcatataggatgactgatttggacaacatgaacggtattgctgtgttaccaatatatgaccgtaaaatggacatcatcaatgctcatcaaaattttatgaaaattttgtggaatatagaactatcactgagggatatctaggattctttttatgattggactcaaaagaagcaaaagttgtttcctcatgtttccttcaaaaggagccagagagttattacctgaagaagcttcacttttttcattcagtaaaacattgaatgaaaatatataaatttatggatataagaaaggctagctagtgcaaacagttgtaattgaaataaagagagtttggccgggcgtggtggctcacacctgtaatccaaacactttgggaggctgaggcaagtggagcacctgaggtcaggagttcaagaccagcttgaccaacatggcgaaaccccgtcgctactaaaaatacaaaacaaaatacaaaaattagccaggcatggtgatgcgcgcctgtaatcccagctactccaggggctgaggccagagagtagcttgaatccgggaggtggagattgcaatgagccgagatcacgccattgctctccagcctgggcgacaagagcaaaactccatctcaacaacaacagcgacaacaacaacaacacaataaagagagtttgtgaccttcattaactaaagccagactgatggaataaggaggtaacattttaaacctattcctgttacagcattttgtgaattattaaagacgagcaaaactgttcaaatcttatcatttcttaatgccttaaaaaaagagatgctttataaaaacaaagtaggaattttgtgatggcaagaataatgaaaaattaaaatacagattattaaaatattttaacatatattaggaaattaaacataatttacttctcattctggcacagaatattttaacatttttgccaacatcttttgtggaaaaaaacgaagttcttaaaaccagaaatctttctacaaatttttaagtccttatatggacaggatgttaatatgttaaattaaatttcatgtgaaatacatggaagtgagaaattctatggtggcactattgctttggaagactgattttaagtaaataaaatatggtaaatttaatataacactaggagtagcattttggttttcaataaagaaaaaagtgaccatagttgaaattttcactgttgtaaaacttttaaaaatattgggatattagatttatagcctcaattgaataaaaatttttaattagatcaattattgcctctggtggtactttgtgtatattcttagtatcatctctctgagggagtatcttatctttttcagagtatctagactcagtttccctaaatagtaaaatgaaggagttaaactggatcatcctttactgctcaaaaattttattttatcgggaatgattgtttctgattatacaaaatgagctattaaaaatattgctaaagtccttagaaaaagcatcaattatattatgatgcccagagaaagttggaaaacaaagtcaatggtatattcaaaatggagctcattattttattgctcaaaattaagtaacttagcactaggatgatgataatagctagttactcaagcctgaaaccaggtagtcatcttagactgctccctttctttcacttcttactactaaaaagttataaaattctactaattttacttcttaaatatcttttacatttgacacctcctcttcactccactgtccgtgtcatagctcaagtcctcatgtctcacccaggctattaaaactgtctcgctactctggtctcttaagcctaaaccattcttcatactacaagttttcttctgaactcgatcgtgtaatcctttctgctcaaaattcttcaagatctccgtccacaaagtcaaaaatccagacacttttccaaggcctttctataatacttgctttctctttctctctttttttttttttttttttttgtgagacggagtctcactctgtggcccaggctggaatgcaatggggcaatctcggctcactgcgacgtctgcctccccgggggttcaggcgattctcctgcctcagcctcccgagtcactgggactacaggcgtgtgccacgtgcctggctaattttggatgtttactggagacagggtttcgtcatgttggtcaggctagtctcaaactcttgacctcaagtgatccgcccttcttggcctcccaaagtgctgggattacagaagtgagccaccgcgctcggctaatacttgctcttgaaatctctagtgtcatctcttgccattttccccacttaatcctcacacagaacgcttcttggacttagttgtaataatctctctcacaactccaatgcctttgctcgccttgcgtcagccagcaatactctttccccattccctctccctctccctctcccccttcccccgctctcccctctctcccctctttccctactctcctccgtttcctccctctgcctcctttctctcctctgtctcctctctctctctctttgagacagaatctggctctgttgcccagactggagccagtggcaggattattagctcactgcagcctctgtctccaagactcaagtgatcttcccgcctcagccttttaagtagctgaggacacaggtgcgcaccaccacacccggctattttaggagaggcagggtctcactacgttgcccagactggtcttgaactccttcctgggctcaagcagtcctcccgccttggcctcccaaagtgttgggattacaggcgtgagccaccggcccgcctagccaactctccattcactcattcttatgtgaaacagtaacagaactataccacatctgtggagcttctcctgactccccaagccaccctaagagccactttgcctacgtccttatcataggaattaccctaaatgattataggacattttaattgtttgcccatctgtttccttcctaagattgtgacctcttggagggcagaaatggatttttcactctcagcttcagtctgtcatagagcctgacagtttccctagcattctttgacaatagcagaagcctaaagaacttccactccaaggaaatacagaatccgggaaacaattgttcctagcgattagggaaatctcgcgagattcaggtcctgggagcctggcaagcccacacagcgacggttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaaggtgagggcaggtgccccgagttattttcctggggactgagcccagagcggggcgatgttgtgctactgcacctccccgccgcagccctccgctgttttcttttgggtagtggtccaggaacttaagacagttcctcctggcgatgtgatggaatttaatgggacaggagaagggaacgggctttcttttcaggccagcgtggcagcgggcggtagggcgaaagggagaaggaaacgagggtttattccgttgcccactccgcggtaagcgacgttgtagggctccactgtagcgagagccccgtggattcctttttttttagccatttagtttgtaaacatcactttaaagaatacatagtgtattcatgacactcggtgaaaaaaaactttccttcccctcccgcccccccggggcagtagatatttacaaccgtaacagagaaaatggaaaagcaaaagccctttgcattgttcgtaccaccgagatcaagcagcagtcaggtgtctgcggtgaaacctcagaccctgggaggcgattccactttcttcaaggtaaatttccatgtgactcttaattggactcttcttaactttagggaaatgaagaaaagtgtactttcttcctggtggtgttttataattatttcttctcaataaatggtctcatttacccaagaattttgaatcccattgctttaaatgaacagtgagcattattgtgtaggcatcattcatttaaataatgactgctgccgtagaactctgcatacatagtggaacgtgcttattttaattctccttctttccgtatttgattcgtggcaacttataggacagatactacgagatagtagaatatgttaggataaaattaggaaaattatcaagaaaaatgaggactatttggacaaatgcctatatatgaataataattcgtgttgtgactgagcttcagatttggctctgagcttcctagtggatagggcaaagagggaaattcatttatgtaatggtgttatcattggataggaggaattataccaagtttctcaggtgaaacagagctttaaaaattaattaaaaaaatttatcatgtggatccttatattggagatgcaatgatgcaatgaatattttacttgtatatgctgtaaaacaattcttgtggctgctataggcaataatatattattaaatgctattcaataaagacaatctttaattctatcaagggaaatcataaactgaagaaatctactaatattgttctatactactagttagatttactattattctcgaatacctacaaagccatatattgagtaatttatagtttagcttcatcttacaagtggaaatatctaattagaattttttctttgtttatatagaaaaggcatttgatattttaaacactgtatgtacattaaaggatttgcaattatagtaacctttttaagcagatgtatattacatatgtatatattacactattagtatatcagagtggtatgaaacagaatatttaagaacttctttgtgtctctagagtttcaacaaatgtactgaagatgattttgagtttccatttgcaaagactaatctctccaaaaatggggaaaacattgattcaggtaggagcatggaaaagcagtgtatcagcttatatagaaacattgtgttacatacatcgatagttattgaaaatgtaacataagtattatataagtataattgacacaaaagctagatataatacttaatataaaaaataaggctggacacggtggctaacacctgtaattccagcactgtgggagggaggctgatggagggggatcacttgaggccaggtgtttgagaccagcctgggcaacataaggagaccctgtctgtacaaaaaaaaaaaaaaaaaaaaaaaaccagcaaacaaaccccaccacccccaaaactagctggacatggtggcatgcgcctgcagtcccagctacttgggaggctaaggtgggaggatcatttgagccctagagatggaggctttgaggctgcagtgagccatgatgggtcactgccctctagtctaggcaatagtgccagatgtcctctctctctcaaaaaaaaaaaaaaaaaaaaagagaaaaaagaaaaaaaaaaagaaagagaaaaagatgttggcgtatttaatacctgttgtcttttatcttgcagatcctgctttacaaaaagttaatttcttgcccgtgcttgagcaggtcagttaagcatagtacatgtagatataatctgtttaggtaatgaactgcttatttgaagacgaaaaaagtctttagttattgcattactagtcttctgtatttaattgttattatttagaagctcttatcagaagtattttcttatagaaacatctatctttttaggttggtaattctgactgtcactatcaggaaggactaaaagactctgatttggaggtcagaagatttcccattcatattaaatttcttgtaattggaatataacttattacctatatgtatatttcttttgaagcttcaaaaggattattatttgattaacgttttaagatatatcctttaaaacctttttttctgcttctgtattttttgggttatgaaagttccatttatgtagaggcaatttaattttaaaccatgaaatcaagaagaggggaaacgagtactatacctgaaaagtatattatcaagagagtattttacaaaatcagcctttaattaatagacgaaattgactggttgactggtttattgtataaggaatttgtaggacatgctatatacttttgattttagttataaaaatatttcttatttatggcatatagtgtctttaaaatgaagagaaattccatagcctggtaaggtactgtatgtttgttgctgtgattatggtatcacagaatttaaaatatatagaacttatttatatatttttataagaaaaagttgtcaaccagcaaaaattgatgtgactaaaaatctctgatatttacaatataatgtggattttaaaaaggcaggaaatctatataaaaatcagacttgatgaaaattatatcttgtcttcacttttatttttcttgtcattatattttaaacttcatgtcctttagtgaatcttcaaactgtttgtataatcaaagtgtttcaagaccattgttaagatttatagatttcttataggatgatttattttagcttttaaccagccagattctgtcactaactaaaatatttttatggagccatttcattttattcagcaaggtataatttagtcaagtgaccaataactttaatgaagtagttaatattgccttagtagtttaaaagagttaatgtggctttcagtatgctattagtgcttaaattgaggagatatttggtctcaactattagtatatggatattttcagtaggcagctgtagtttggttatattagaattttggacaattaatttttgaaaacatattttaatagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaagtatgacacaattttgcattgtaaacatagtatagtaaatctaatcataatactgttgaaagtagagtattagttgggataaattggattgatcttgtttttgtgatgaatattttaaggataatgctttttaaaagttacatcaatactggatacattttaactttaagaatgagcatagaggacaagttgtataacgcttaatgcaaatgattagggaaataataaatcactttatataaaaattgatttaatgattctaatttattataaagagtttcaatttttattcctattgatgttttatgtaaatatattctcttagattacaatagttgtaggtaacactttaaatttgaaactgtgtaactttattttttttatttatttttgtgagacatagtcttgctctgtcacccaggctggagtgcagtggcaccatctcggctcactgcaaccttcgcctccctggttcaagcgattcttctgcctcagcctcccaagtagctgggactgcaggcttgagccaccacgcccagctaatttttatatttttagtagagatgggatgccaccatatttaccaggctggtcttgaactcctagacctcgtgacccacctgcctcggcctcccaaagtgctgggattacaggcgtgagccactgctcccggccgaaactgtgtaactttatctgtagcataaagtgaaaaaaatgttgagaaaatgtgacattgtattaggacaaagaaaaaaacattacttcaaaaatatttagagaagataatattgcattaaaatattgttgaatgtttcttggagatgatttagccttctttattttagattgatgaaggccatattcttaagggaaatcataagctattacaaaaatgtttcctttttatgtggaaagaaaataattcttttagaccattgtgtattagtaaagaaatactgcttaatgattatattcgtgtttatttttgctaataagcaaaatgggatgaacttttctgttttataaattagtttggaaatgaaaaagtaagtttgaaattagaagaaggaatacaagaaaataaagatttaataaaagagtaagtagtaatttaatgaatttgttcttttcacattttttattccaaatttactactaaaataattttcaaaaacatattgagcactttctatacgttatatcatatgaatttataagtagaattatatctgagtgctatggaaaaaggaagatgtacattcttgtgtttggcaaactgtggtcactgactaataacttcactttttaaaatgtcaggcatcaggaataaacattccttggtgtcaaaaaagatgcctgataattctgtatctacaactacctatgtatgttgtctgtttcactgctgtcttgagtacagtacttataaaacaggacttaacttagttccaagttaattcttactcaaattcctgtttttgaaaatgtaacagtttatttctacagaaaaatggtaagttagaaaattaagtctaactgccatatgtgttagtaacttcaagatagccacaggtctcatcattcacataatgaatgcctaatcagaaagttaccttattttgtgttttgaaggttagacatatattaatttgttaatgaatggcccaacctattctcattatttttccttaggcaaatctagacctgtttactgaaagtttattgatagcaacttgggtagaaacttgttaaggagctgtcacttttatttgtttatttattttagtggccagttactagaacttttacttttaaagggaggcaattactaaatcatctttgctagtagtacagtcaacccactgtttcttcatatagtcatttatgaataatgtgatgtatgccaaagattataatattttaaaaatttcttaaaaattgtaacaatatatttcataacttatatattgtgattttgctttgagatcagattacacacaggcaaactctttcctttgtttcaggaataatgccacaaggcatttatgtaatctactcaaagaaacctgtgctagatctgcagaaaagacaaagaaatgtaaatatctttcttgttttatgtgattttatcaatttattttactggtagaggtggagagggaaagaaattgtccttttaatttttggaaccaatttgatttgaacaaattatatgtgcctcagactatttttatataagtaataaggagaatcacagttctttgacttttgaaagctcaaaattttttgaaaggtaatatatgtcaaagggtatattcttgatatttatagttaatcctggtttcaagtaaggtatgattttgagactaacctctgtctggaacaactaggaaattcaatcgagaataagatacatagccatgctcgtaatagaaaataccagtagaggctttgctaaagccattgtatttatgaatagtggtgcaatgtttattttcaatctaaatagaattctcaaatttttcctaaagaaaaattcttttaaaatattctaatatggttgtgttgtgtatgtgaaagaacagtttaaaaattttaaagcatgttttcatttttttaaattataaagtaggattttttcccattttgatgaaaaataagtgtgtgattataaaatataattctttatttttgccataatttgaccctggctttactttgtttctgccaagaatccattgggaaatactgtctacctgctttttcgggatattctctatttttcttagctaaaaattttaatttgtatcatacagcttactacttaacagcttgggcttaaggattagatagccggtgctcaaatttagactttcagtttctgtccacctagggagcttgaataatttgagtaaattatgtagtctgtctgtcactctgtttattaattaaatgcctcttagtattgtcctgaaaattaaatgttaataaatatgcttagaacaatgcaaagtgctcaataaatgttgggtattttattattattattgtcgttatttctaacattgactgttaggtttttttattctttttttttttttttttgagatgtggtttcactcttgttgcccaacctggagtgtaatggtgtgatctcggctctctgcaaccgctgcctcctgggttcaggcaattctccttcctcagcctcgcgagtagctgggattacaggcatgtgccaccacacccagctaattttttgtatttttagtagaaagggggtttcaccatgttagccaggctggtctcgacctcctgacctcaggtgatcctcccacctcagcctctcaaaatgctgggattacaggcatgagccactgcacccggccaggatttttattcttagtccctgcctgtattaccttgcttttcaaaactctatgtatcttccagaatgtaccataccactaccagctcctctactatatcctatgtactcaacattcaagattaatttttctgcctagatataaaaagtggtgaaaagtacagtgatagggtagaaggatagtacattggctgtcttgcagaaaataacttgggttagagagacaagtctgatagttcttttttgttctttgttttttttttttttttagacgaagtctaactctgtggccaggctggagtgcagtggcacaatctcggctcactgcaacctcccacccctagggttcaagtgattctcctgcctcagcctcctgagtagctgtgactacaggtgcccaccaccacgctggctaattttttgtatttttagtagagatgggattttaccatgttggccaggatggtctcgatctcttgaccacctgcctcggcctcccaaagtgctgggattacaggcgtgagccactgcgctgggcgatagttctttcttacatttagttttcagctaagttagaaatcagatggtgaggaaggtttagagaacccaacatttttcaaggtggtctctttaataaactaaagttgaggtatgtcttgatgtgacatgtagaaagttttttttttaaagtcttgacacttgctttattgttagtgtaaactctatgcagattcttgccttaagttgttgaccagtctttttgttattgtgcttttttctttcttttattcattcattcaatatttttttagtgcctgctatgtcatgaaatcttctagatgctgatgaaaaacagcagtgaacaaagtctctactcttacaagagtgtatattccatggtgtatatgtgccacattttctttatccagtctgtcattgatgggcatttgggttggttccaagtctttgctgttgtaaatagtgctgcaataaacatacgtgtgcatgtgtctttatagtagaatgatttataatcctttgggtatacacctagtaatgggattgctgggtcaaatggtatttctggttctatttccttgaggaatcaccacactgtcttccacaatggttgaactaatttacactcccaccaatagtgtaaaagtgttcctaggccaggcacagggctcacgcctgtagtcccagcactttgggaggccgaagcaggcagatcacgaggtcaagagatcaagaccagcctggccaacatggtgaaaccccatctctactaaaatacaaaaaaattagctgggcatgatggcacgcgcctgtagtcccagctactcaggaggttgaggcaggggaatcgcttgaacccgggaggcggaggttgcagtgagctgagatcatgccactgcactccagcctggcaacagagcaagagcccgtctcaaaaaaaaaaagttcctatttctccacagcctcaccagcatctgttgtttcctggcattttaataattgccattctaactggcgtgagatggtatctcattgtggtctggatttgcatttctctaatgaccagtgatgatgagctttttttcacatgtttgttggtggcataaatgtcttcttttgagaagtgtctggttatagcctttgccgactttttgaatgggtttctttttttttctgtaaaagaatgagttcatgtcctttgcagggacatggatgaagctggaaaccatcattctcagcaaactaatacaggaacagaaaaccaaacaccaaatgttctcactcataagtgggagttgaacaatgcgaacacatggacacagggaggggaacatcacacacccgggcctgttggggggtggggggcagggggagggagagcattaggacaaatacctaatgcaggtggggcttaaaacctagatgatgggttgataggtgcagcaaaccaccatggcacatgtatagctatgtaacaaagctacacattctgcacatgtatcccagaacttaaaaaaaaaaaaagagtatacagtctagtgaggggagaggatacagatcattaatgaataaataaaatatatgttaggtgataactgcttaaggagagaatattttgggacagggtgattgggaagttttttctggttaagtgacattgggtagagacctgaataagggagtgggccatctattttaggaaagaatatttcaggcagaggaagcagttaagtgcaaagtcccagagatgagagcctgttcaatcttttcaggtcacaataatgaggccactgttctgtatttctgactctgtatttttcatcttttttctcactgtactccactcaggatacttttttctttctttcttttctttttttgatggggggtggggtggtctcacactgttgcccaggctggagtgcagtggttccatcttggctcaccataacccccgcatcccaagctcaagcaatcttcctacctcagtttcccaagtagctgggactacagctgcacaccaccagggctgtctaatttttgtatttttttagagacagggtttcgccatgttgcccaggatagtctcaaactcctgggctcaagtgatcttcccaccttggcctcccaaaatgttgggattataggtgtcagccactgccctggcccacataatttcttctaacctctcttccagtttactgattttctatttagttaattcttgtctgttttattttatttttattttattattattatactttaagttttagggtacatgtgcacaatgtgcaggttagttacatatgtatacatgtgccatgctggtgtgctgcacccattaactcgtcatttagcattaggtatatctcctaatgctatcttgtctgttttaaaatttatcagttggtgtcttaatttgttattgtatttactggttgagtattagctagttctttaaaaatttgtagtgtcactttccagaattttaagttctttgctgactttttaaagctctactttttatctgtatgaacataataaacatagttgtatccaataatgccaacgtctgcaataccctggggtccatttctgtgattttttttttgccatagatcctagttttattggttatctcatcagctatcttagataataattaataatttgagacttagaatggttaaattttcctagttcattgaatgttcagcaattctgtattatatcctggattatgttgtgagaatctgagtcctcttcagatttcctagagaatgtttatttgtttattttctaacaggcagtcagctcacttaggtttagaataggttctgtcttgccttttcattgtgggtgttccaatatcagttcaattttcaatgcctttgctgtgctgccctgggtctatttcatgtatgctgtactcaaggatagttctgggacttgggtagtgttttatgcagagtccagtttgcaaagcttttgccccatgcatctatagcctctccgattatcaacataactcaccagagtggcatgtttgttacaattgatgaacctacataggcacatcataattgtccaaagttcatagtttacattagtgttcactcttggtgttgtacactctatggatttggacaaatatgtccgccattatagtataatacagaatagtttcattgccctaaaattctgtgttctgcctattgattctctacaccctactctggtaaccactgatcttttaactgtctccataattttgccttttccagaatgttatgtagttcgaatcctacagtacgtaggcttttcatattggcttctttcacttagtaatatgcattcaagtttcctccatgtcttttcatcacttgatagctcattttttaagcactgaataatattccattcattgtttgcacataccacagcttatttatccattcacttactaaaggacatcttggttgcttccaagttttggcagttatgaataaagctgctataaatatccatgtgcaggcttttgtgtggacattttaaactcctttgagtaaataccaaggagcacaattcctggatcacatggtaaaagtatgtttagttttgtaagaaattgccaaactgtcttccaaagtgggtgtacaattttttatttccgccagcagtgaatgagagtttctgttgttctatactctcaccagcatttggtgttgtcaaagttctggattttggccattcgaataggggtatgtattgatatctctttgttgttctaaattgcatttctctgatgacatatgatgggaatcttttcatgtgattatttgccatctgtatgtctcctttggtaaggtgtctgttaaggtctttgtcccattttttaatcaggttgcatgttttcttattgttgagttttaatcaacaataagaaaaaagacttaacaattttgagtctttgtatattatagaaaacagtcctttatcagatgtttcttttgcagacattttctcccagtctgcggcttgtattctcattctcttgacattatcttttggagagcagaagtttttaattttaatgaagtccagctcattatttctttctttcatggattgtatctaaaaaaaaaaagtcatcgtgatacccaagatcatccaggttttctcctatttatcttggagttttatggtttgtattttacatttaggtctatgataaattttgagttaatttttgttaagggtgtaagatctgtgtccagattctttttttttttttgcatgcagatgtccacttgtttcagcatcatttgttgaaaagaccatcttttctctattttatagctgttactcctttgtcaaatatcagttgactatatttgtttgggtctatttgttactcctttgtcaaagatcagttgactatatatattgggtctgtttctggactctctattttgttcccttgatttctttgtccttttcccccacaaatccctcactatgttgattactgtagctttatagtaagtcttgaatttgaatagtatcagttctccaactttgttcttctcctttaatatcgtgttcgctcttctgagtcttttgcctcaccatataaactttagaatcagtttgtagatatccacaatataacttgctgagatttttattgggattgcattgaatctgtagatcaagttgggaaggattgacatcttgacaatattgaatcttcctatctatgatcatggaatctttctctattgatttaattattatttgattgttttcatcaaaattttatagttttcctcatatagatcttgcatgttttgttagatttgtacctaagtatttcattttttttgtatactaatgtaaatggtattgtgttttcaatttcaaattccgcttattcattgctggtgtataggaaaatgattgacgtttgtatagtatattaatcttgtatcgtgtaaccttgctgtaattgcttattagttccaggatttttttttgttaattctttcaaattctctgtatagacagttatgttatctgtgaataaagtagtttttatttcttttttctcaatctgattccatttgtttcctttttttgttttattgtattaattaaaactttaagtacaatgttgaaaaagaatggtgagaggggacatccttgccttgttcctgatcttagtgggaaagcttctagtttctcaccattaagtatgatattagctataggtttctgtagatattctttactagattgagcaagttcccttctattcctagtttactaaaagtttttatcatgagtgggtgttggattttgtcaaataatttttctatatctattgatatgatcttgtaattttttagcctgttatgtgatggattacaataattgatttaaaatgctgagccagccttgcataccttgactgcatcccatttggttgtgttgtataattttttttatacttttttttttttttgagacaggatcttgctctgtcacccaggctggagtgcagtggctattcacaggcatgatcataactcactatagccttgaactcctgggcttaagtgatcctcctgcctcagcctcctcagtggctgagactataggtgtgtgccactgcacccagataatttttaaaatttctttttagagatgggatcttgctatgttgcccaggctagtctcaaacttttggcctcaagcaatcctttcacttcagtctcctgagtagctggaattgggattataggtgtgggccactgtgtcaggctccttttatatattgttggatttgatttgctaatgttttgttgagtatttttgcatctatgttcatgagagatatttgtctgtaattttcttataatgtctttgtctggttttggtattagggtactgctagaaaatattccctctgcttctatcttctgaaagagatagtagagaattggtatagtttcttccttaaatgtttgtagaattcaccagtgaagctggcaggcctggtgctttctgttctggagggttattaattattgacttaatttctttaatagatataggcttattcagattgcctgcttttaattctgtgagttttggcagttgtgtcttttgacagttggtccattccatttaggttagcaaacctgtgggcatagaattgttcataatatttcttcattttaacatccatgaggtttgtagtgatgtctcctttttcatttatggattagtaatttgaatcctctctctctttttcttagcctggctagaatttattgattttattgatcttttcaaataaccagcttttggtttcattgattttttaaaatattgattttctgtttccactttcatggtttttactctaatttttattacttcttttctccttcttactttggatttaatttgctcttctctttctagttgcctacagtggaaacttagatgattgatttcagattgtcttttccaatttatgcattcaatgctataaatttccctctcagtttttcctgtatcgcacagattttgataatatgtgttttaattttcatttagttcaaaatgtttttgaatttctcttgagatttcttctttgactcaggtggtatttagaagtgtcttggttattctccaagcattttgtgattttccaggtatctttctattatttatttctggtttaattccattgtgatctgagagcagatactgtacaatttataatcttttaaatttgttaaggtgtgtcttatggcccagaatatggtctatcttgatgaatattccatgtgagcttcagaagactatgcattctgttattgttggattaagcagtctgtaaatgtcaaggtgattgatggttttattgaatccaactacaggttaagcagccctaatccaaaaatcccaaatctaaaatactccaaaatccaattgagtgccaaaatgatgctcaaaggaaatgctcattggagcatttcagattttggattttcagattggggatgctcaactggtaaacacaatgcaaatattccaaaatctaaaaagaaatctgaaatctgatatattaattgtcctggtcccaaacattttggataagggacactcaacatacatgtcttactgattttctgcctgctgggtctgtccatttctgatagagatgttgaaatcttcaactataatagtggattaatttatttctctttgcggttctaccagtttttgcttcacgtattttgacaccatattattaggcctatacatgttaaaaattgttatatctccttggagaaatgacccaaaagcattttatttttatttatttatttattttttgagacagggtcttggtctgttacccagactgcagtgcaatgatgtgatcatagttcactgcagccttgaaatcctgggctcaagcgatcttcttacctcagcctcttgagtagtggggactataggtgtgtatcaccactcctggctaatttttctattttttgtagagaaggggtttgctacgttgcctagggtggtctcgaactcttgggctcaagtgatcctccatcctcatcctctcaaagtactgggattacgggcatgagccactgtgcccagctctaaaagcattttgaaatggccctctttatatctgacaactttccttgctttgaagttggctgtgtctgaaattaatatagctactctttttatatgattatttgccatccatatgtctccttttgtaaggtgtctgttaaggtctttggcccattttttaatcaaattgcttgttttcttaatgttgaattttaatcaacaataagagaaaagacttaataatatttgagtctttgtatattatagataacagtccttcatcagatgtttcttttgcagacattttctcccagtctgtggcttgtattctcattctcttgacattctcttttgtagagtagaagtttttaattttcttttgattagtgttaacatgctttcttgtgattagtgttaatatggtgtatctttatccatttacttttattctagatgtgattttacatttaaagtgagtttcttatagacagcatgtagttgggtattgttttttgatccactctgacaatctcttagttggtcatttagactattgtcattcaaagtgattattgatatagttggattattatctaccacatttattactgtttttctatttgttgtcctgttctttgttcctatttttgtcttttactctttttatgctatttgtggttttaattgagcattttatgtgattccagtttctctcctttcttagaatattagttatacttctatttttactttttaaagtgatttcactagagtttgcaatatatatttacagtaatccaagtcgactttcaaataaccctctactgcttcaaggttacagtgagtaccttataattctttcctcccatcttttttttttctttttttttttggatacagagtcttgttttattgcccagattggagtgcagtggtgccatctcggttcaccacaacctccaccttccgggatcaagtgattctcgtgcttcagcctcctgagtagctgagattacaggtgcccaccaccaagcccggctaatttttgtattttcagtagtgacggggttttgtcatgttggccaggctggtcttgaactcttgacctcaagtgattcaccctcctccacctcccaaagtgctgagattatgggcttgagccaccaggcccggctggcctcctcccgtcttttgtatcattgctgtcattaatttcttttatataaagcataaataagcatttataatctaatacattgttgctatttttttgtttgtttgtctgttttttgttttttgaggcagagtctcattctgttgcccaggctggagtgcagtggcatgatcctggctcactgcaacctccgcctcctgggttcaagtgattctcctgcctcagcctcccgagtagctggtattacaggcgtgtgccaatttttttatgtttagtaatatgctaatttttgtatgtttagtagagatggattttcgccatgttggccagactggtcttgaactcctgacctcaagtgatccaactgccttggcctcccaaagtgctgggattacaggtgtgagccactgcgcctggcccattattggtattactatttttgacaaacttatatgttagatcaattaagaatgagaaaaataaaagttatttagccttcacttatttctgcgttgatgctcttttttttctttctttttctttttttttttttttggcagagatggggtcttgctatgttatccaggctggttttgaacttctggcctcaagtgatcctcccactttggcctcccaaagcactggaattacaggtgtgagccactgagaccagctgttgctcttttttttctttatagagatctgaatttcttacataaatcattttctttctctttaaataatttcttttaacatttcttggaaggcaggtctgctggcaacacattctgtcaacttttgtcaaagaaagtatttatttcttcacttttgaaggatagtttctcaaattacagaattctgtgttgctggttttttctctcagcattttaaatattttactccattctattcttgcctgcgtggtttctgaggaggagtcagatagaatctttctttttgctcctctgtaggtaaaatgtttttttcctctagctttatctttgattttttgtagtttgaatgtaatatgcataggtgtagtgtctttggcatttatcctgctttctgttctctgagctttctggatctgtgacttggtgtctgaaattaatttagggaaaattcttagtcattattgttacaaatattttatgttcctttttctctttcttctccttctggtattcccattatactttttgtagttgtctcacagttcttggatattctgttctgttctttctagtcttttttctctttgcctttcagtttttgaggtttctgttgaaatatcttcaacttcaaagattactttcctcagctgtgtctagtctactaataagcccctcatttcttcgttttattttttttagagacagcgtctttctatgttgtctaggctggtctccaactcctggcctcaagtaatcatcttgcctgagccttctgagtggctgggattatgggaatgagcccccacacccacaagcccttcatttctgttacagtggttttgatatgtagcatttttgttttgagtcattcttagaattttcacctatctctttaaattgcttatctattcttgcgtgatgtctactttatgtactagagcccttagtatatcaatcatagttgttctaaattactggtctgggataattctgacatccttaactgtatcagagtctggttcttatgcttgtcttgtcaaagtgtattttttgcttttagtatgcttgtatttttattgttttggatagctacacatgatgtactgggtaaaggaattgttgtaatgtgctggtaaagtatagggggaggagtattctatagacctatggttaggtctcagttttttagcaaatttttgcctccagataatgaacttcataaatactcctcagcccttgcatccctctcctccttagatgggacaaggtggtagagtgggctgcagttgggaatttcccattttccatctggatggctagagggggatggagttggatattttccttacttcacatggaaggctagagctgtctggaattgggtatttcccttcccccaggttagttaggctctgacaaattcccagcagattttgctctcccaaaggaggccttgttaagaacgggacatattggtatagttcaaaacggcttttcctgttagaagcacaaggggatgtttttcctatgttcattgtgagaaacctggtagagctccagaaggttaaactcacaagaatctggggcctctctgatgactgggtctccacagaggtttttttatttttattttttgagatagagtctcactctgtcgcccagctcactgcgacctctgccttctgggttcaagcgattctcatgtttcagccttctgagtagctgggattataggcatgtggtactatgcttggagaatttttgtatttttagtagagatggggttttaccacattggccagggtggtcttgaactcctggcatcaagcaacctgccaacctctgcctcccaaagtgctaggattacaggcgtgagccaccacacccagcctccacatagtgtatctctcagatttgtttacactgaatttccagcaatgtgtcaattatagttcaggttttctttccctgactctggttcccacagagttttctgcttatgggtttctgccctggtaagttgtaattctctctgtgtttgcctgtctctccaattttggggtagtagtttgccctgcgactttacttctcttaaggatctgagaagagttattaattttttagtttgttcagctttttacctgtcgttaggatggagcagtgacttctaagcttcttcacaacagactgaacccaaacagcttttgatgcaacttaaaaagacccagtaatgatttagataacccaatgttcatcattaacacagaattttaaatattttaatgttttctggaggcattttgagtattgtcttgttgacatcttattttaaaatttaatcttgaaatttttatattaacaatagatgaatatgaacgggaagaaaccaggcaagtttatatggatctaaataataacattgaggtgagtgttaatgaaatctgagtattttaaacataggaatttctgagcaaattagagcgattgctacaaagatatggacaactattcttactaaaaagattattatttatttgttgatatattattgtatcactaataaaattcctaaggttctgtactatgagcattaatgttatgtaggagctttttgatttacatgttagtgacatcacttaatttatcaaatatttactgccttttgtcagaaatcagcacattgtgacacataaccattaatttgaaaacatataaagtattattcatctgtgtctggcttctgtttacctttgttttctcatctcctgtcattgtccactttgcttttctgctgtagtcactcttttatgtttctcaaatttgccaagctctttctgatggtggttctttgaatttgtaccctttgcagaacttttatgtctaagatcttatgcacatttctaaacttcattctgcttttttgttattctccccttaatactttatctaaaatttctatttgattattccatatatatccatctcatttaacttttctcaagagcacataaagctgcatggcatgtatttgatatgtgtgtgtgtgtgtgtgtgtgtgtgtgtatttgtattcttttttacactttattgtaaggtccagtagggtagagactttgtcttctttttttttttttttttttgagacagtctggctctgtcgcccaggctggagtgcagtggcgcaacctcggctcactgcaagctccgcctctcgggttcagccattctcctgcctcagcctccggagtagctgggactacaggggacagccactacgcccggctgattttttgtatttttagtggagacggggtttcaccgtgttagccaggatggtgtccatctcctgatctcgtgatccgcccgcctcggcctcccaaagttctgggattagaggcgtgagcccccgcgcccggccgagactttgtcttctattcctattacctaaaacagttcctggcacataataggcactcagtaattaattaattaattaacctgattttacaaagcaagatttgttgaatgccgaatgaacacatgctgccagctgatggaagtgtaactttggattcatggggagaggcctcacattagtggagaagacgtaaataaataagcacaaataaatacaaaattacagattttgatacatgctattaagtaaatggctggtgtaccaacaatccatttgctgctattttgtattgtataacatgttgccagtgcatttaagcatctgggaaactaacataaggccctcttaatacatttttagtaagtaattcaaattacagtgttttagttattccaaattgtgtggttttaaatttaatgatcacatgatacaaatttggtaatattttcatagtttgaagaaagctatttaaaaaaatttaagtatgattcttaaaactttatatttcagaaaatgataacagcttttgaggaacttcgtgtgcaagctgagaattccagactggaaatgcattttaagtgtaggtatagggatcttacttaatttttatattactgttttgctatttatatttttatcagattccgttaatgtcttcatctctttagcctgatgctctgaactattttctattttatttatttctgtaagcccctctaaatcttgtggaatgtggcagggaattaatatttgttaaaaataattttgggttttaaaactacatctttcatgaaatcaaactaattttattttttttttagaaatgtgatttggtctctttttacatatcttggtatagtatgcatgttaaaataattgtatatgtatcatattatacatatttaaaacctgttgtttcagattagtgtgttttagagaataaagttttatatataagaattatagaattttaggttattataactgatattatttatatttactattttactaaacagaaaggaagaaaacagcaatattagctcattacaaacttttagagtttaatataatttagagataaataaagaggtgaaataaactttaaattttgtttgtaatagaaatgttataaaattatgttatgacattacagtatatttgttttatttttaaagtaaaggaagattatgaaaaaatccaacaccttgaacaagaatacaagaaggaaataaatgacaaggaaaagcaggttttttaaaaaaccaactctttgtattctttatatttgctaattcattaaaaacttaaaatttcaaaagaagtttatatttactgaaagtatgataaattcctatgagagaattttaatattatacatatattaatatttagcctttagactcacttaattttcattgactcaaatatgtactcactctagctttttttgggttttaatcaattattcttctataatatttatatcagtgggtaataggatattgcctcaaaatatattattttgtgagaacttttgttcagacaaaaacttcatgaaatgtatagatgatcattgactactcaacttacattttgcagtttgttttgaaatgtgctattcataatatcaatgaagaggaactaaaatattctgttgcatctttcttttttcttttttagcctaagaaaacaagacacagatgttttttatattcatgtcatatagtggaagacttgaaaatgttaactctatatcctttggcattcacaagaatgtttcagattattattatgccatctctatcagtttcaagtcttctgcttcccaaatggaaagcaatatatataatagaatcctcttctatttctcactatatttgcagtttttcttgtctgatttgccacaagatatcttctaatatggttaacaaggatatctacttaataatttaaaaaattaattcacagtacagagaggataataaaaaccacaaaaatagagtgaagtactgaaacgctttttggagttctaggtgcatgggcagagcttacagattgttgggcttccttgtaaaatgatggcatggccagctagtgtttttgctgaggactcctaaatgtcattatttgtaacactttttttgctgggggtttctaaattcttgcttgtggatataaacttggctgatggcattctggagctgaattgggcaggatagcaaagacagactgaatcttaccattatgtatgttgacttttccattatatatacccccacccatccctgtgcctggaataccgatgtttagagattgcctttttcaatttgatatgacactgtctcttacaaagataatagggccagttctctgactacattggctgccagggagtagagaccagggtgggagggttaagtggaccagctgaaaagcatgtagacaagtacataaaataattgtaggtattataaatgttaaggtgtcatatttaaattttcatattgataatgtattatttaaatattttaggtatcactactattgatccaaatcactgagaaagaaaataaaatgaaagatttaacatttctgctagaggaatccagagataaagttaatcaattagaggaaaagacaagtaagagtttatataagataatataatgtgccttatgtattcctcttgttatgttctaaacattgactttcattacaagtttgttgtaatgctttctagtactgtacttctcaatctgagttggttcggttggaggagggcataatagattaacctggggagcttttgtaaaatacatgtactcttcttttcctttttccatgctcttacctttttcaaatgtttcaactatatgctccacagagacagagaccttgtcttttttgttcactgacttggaactgttgcattccaagtgccgagaacaatgcctggcacatataaggcactcaaaattaataatattatttttgttttttgagatggagtctcactgtatcacccaggctggagtgcagtggcacaatcttggctcactgcaacctctgcctcccgagttcaagcgattctcctgcctgagcctccctagtagctgggactataggtgtgtaccaccacgcctggctaatttttgtattttcctagagacgggttttcgccttgttggccaggctgatttcgaactcctgacctcaggtggtccacccgcctcagcctcccaaagttctgggattacgggcgtgagccactgcgcctagcaaaaattattttttgaatgaacaaatcatatgggagcatgatggagagagttactaatttttcccagagagagacctttagaaaggcattagggaaaaactgttgaactgtttaaaagtttactagacagtgaactggagtagacaatacaggtggaataaacggcttgtgcaagtcatggaagtaggaatgttagggtatatttttagtaaactgactggtgtggcaacatcttattgaactcagacagatgaaattgtaaaagatttggatccctttatgaaggatcctgagtgttatgtcatgtttagactgtcttattagggaatatttttcaaacttttttaaacggcaggacacttagaaggcatagtgtttgtgaaacaccatgcaccttccagaacattatagggatattatggcatttgttgtttttctattcttcagaacattctcttgtcttcacatggcaaataattatctggtttctgccaatctatacctgctaatttcatcttactgtcattactatatgatatactccagatatattgaaataatttaacttcatctatattttgtgctctttcaatcccaccccatgcttttggctacttcctgtactcaaaatgaatctcttctctccaccccaagtctgttggctaaattcttagtaagggcataaacattacctgtttgtcccctgtgactaggagtgtattgaggagggattgggtcttaaatatctttgtaactgtagtgcccagtatatggttttgcacataatatgagttcaatagttggatgaatgaaataatatttaatcttatcatataaactgaaaaaattaataaataactgtaattctatatgattcctgtagactcatacccactgaagtgtgttcatttaagtgacttttcattgttttccataagtatgtatcttccacttgtttttctctgtgttcagtgtggatattttttactgatctgttatctaatcctggctgtgatgtgtctaatttgctttaaatctatctactgaattcttaactttaaatgaatcatgtatttttcattttgaagtttccatttgattacttaagagtccaattctgtggttaagttttctcctcttttaaaaatctcatttttcacctcttaaatatatattcgtcattgatattttatagctattctctgtttatttcaatatatgtctcatctgttggtttatttctatcgtttcttttttaaaactatggtaaaatacttgtaacataaaatttaccaccttaatcatatttaagtgtccagttctatagcattaagtatgttcacattgttatgcaaccataaccaccatctttcttctccaagaactcaccatccaagaactcttttcatcttgcaaaatggaaactctgtacccattaaaaaataacatcccattcccttcttcctgcagcttctggcaaccactatttgattttctttctttttactttttcttttttattttgctgtttgggcatttgttgttatcctttggtgtgccctgtaatttttaaaattaaatcctgtgcattgtaataagaaaaatcttggagcttcccgatgatgttgtcttttctctgctggagagaaattgggggtatgttgggctgattatctgattccagttagagactgagctaaatgaaaggaaactggccaagtatataaggtttttcaggttttcaattttgtttcttcagctctttgagacctctcaaaagtaagctggcttttctgtaccttagcaacaggcctctgcctgggttaagacagcatcttagtcttttgcttatgcccagatcggcagatgtcagttgtactttatcagttcactttcagcagttttcttttaagaatcttagcccgtttagtccttttatgtcattttgtcttttctggttgtttccagcgtgagagttggtatgctactaactactccaccctccctagaaatattcatttaaattaattatgatcaactaatttttgttttcctttttaatgtttgcttgttattgcctaatttattttgtcacttgctaataatagttggttcttaaagagtattaattatcaaaaatttaagtagataacaattagattttacatgatttcattatttcttatggctgaacagtattccaatttgtgtatatacacacacacacacacacacacacacacacacacacacatttctttatccagtcatctgttgatgaacactggttgattccatattgctattgtgaatagtgctacaatatgtgtattttagttctatagatggaacattattattactgttttgtacagacaatatttatttcgttttacccatgtatttttttcaatttctttgctcttttttttggtatcttaaacttttcattcagaccattttctttctgttttgaagaggaatatttagaatctcctttagtgagaatatgtttgtgattagctgtcatagattccatttgtctgaaaatttgtttattcattctcatccataaaggatatgtttgcatgatatgtctttctaggttggcacactgtacattatttctagacatttcttttagcacatggaaggtattatccttccttccttccttccttccttccttccttccttcctttcttgatggagtctcgctctgttgcccaggctggagtgcagtggcacaatcatgccctcaagtgatcctcccaacccagcctcctgagtagctgggatacaggcagatgccaccacacctggctaattttaacattttttgtagagacagggtttcactgtgttgctcaggatggtctcaaactcctgggctctagcgatcctcctgccttggcttcccaaagtcctgggattacagatgtgaaccaccacgcctggcttactttgttgattttaagaagtcagtaatatcttttccctctcttatgggttttcagattttcttcatcttcgatttttagcatttacagtataatatgttaactcatacgcttagttttgtttaatagcttcttcaatctgtaaattactgtctgttactattgtttcttggaaattctcaacaataatctcttcagatattgtatttgctctactttctgtttcctcattttctgagtaagaaaaaaacgtggaaaaaacccgtgttgcatcttgggaggctgaggtggaaggatcacttgagcccaggagttcgaggttacagtgagctatgattgctccattgcactccaacctgggtggcagagtgagaccctgtctcaaaacaaacaaacaaacaaacaaacaaacaaaccaaacaaaaccaaacccgaaaccaaaataaaaaccttcattaattttctaactcttctttgactcttaatctcttttttctatttcaacagttttgcctttctataccttatcctaatttctttttacctgtattgtaattcactaattttcttctcttttatttctcacacatcatgaaattcctccattttatttttagttactaagatgtttattttaagatgttattcttctttttctaacctgccattctactttatctagttttcagtttcttcttattttcgaggttgtcttttctttaaatatacaaaccatagctgttttatagtccttttctgatttttttattttaaatgtttgtgattctctttctgtcttgtttatgatagtttttagtcaaagtaccttgtttgcttgtgtgccttattgtttttgactttatgctcattttttttacttgaaaaaaaagattacttgtaggaataagttaaggcctgcttaacatccacctggaaggatttgctttttttccccccatgcacatgatatttctatccatttgggacaaccttaaggcagcttgaacgcttggggtgtcctgaactacgcaggtgatttgaacctgggctgcaaatctgcctgtgagttggtttacttttgtttgctccttacatcaaaactgtcccggcttattgtacaaaagtttacttcttagacaccctctaccttctgtaatctttgggttttcatatatcttaaattctctatcccatcatatttcaaaccaaaagtccaactttgccagggtctgcaaatgccctctgggcacaagcaagttttgtggttaccttacttctataggtttctattttctcttcatttttggcctggcaaattcctatttttgtcaggagcttaatgctttaatattcttaatatttgatcttgaatttttattcccttttacagaagtgtttaaatgacaaagctcatcattatcgctttggagttttcagtttcaattttatgtattacttctagtagttttattgatttactgatatcttcctttagtttacaaagtatgtgataatacttatttttaaatttcatagccaataattctaaaatatgaaatctttgtagatctaagttggccttttgttcattttgctgactctgttcatggtgctttgtttcccattgtgtttgttgattgtgaggtcatgtaactttatttgtggaaattctttaaggcctgaattagcagtatattaggcctgaagaaaatttgcatattccattttctaggctcctggggaaacttaggagcacttcaaattaaattttggcttggagctctttggaaaattctggcagtatacattccgttccgatacatgcctaagggctagtttgtgcttatgatttttcagaggagacatttatcaccagaccataagaaatagtatcataatggacaccacaatcattagtcaacatttccctcaccaggctggagtgcagtggtgcaatcttggctcactgcaacctccgccttcctggttcaggtgattctcctgcctcagcctcccgagtagctgggactacaggcatgcaccaccatgcccacctaatttttgtatttttagtagagacggggtttcaccatgttggccaggatggtctcgaactcctgacctcatgatccacccgcctcggcctcccaaagtgctgggattacaggcatgaaccaccgggcctggcccagatttactttttctattttttccccacagtcggaccaatgaccctttcattctatgtagttttttcagaatggaattttaaaaatataaacttggcacgtacttctgttgcttaacatcctttattgttttgcatggtcttcatgaattatgaaccagaagactctgagcaagttatataagtcctgttatgatcttgtccttgttacgtttccaatcatatctcctgtgacttattcgttatacttcaagccttatgctcctaaaatacattttctctagatgccagaacgtgtcattctatctcttctgtgttttcctttgtatgtgctcttacacttgcccgtgaccttttctctcctaacttccattacctttgctaatttaattcttactgtctttcaaatgtttcaactcagctgctactttcttgaagtctttaaactttttctgtctccctgtacctctaaccttgactgatcttatttggcttaggtgtcccctctaggtaaactcccagaacttccagtgagtacccatcagcacaatcattgtttatttgcctgcctgaccaatatattgtaaattatcatgaatattagtgttcagtttctaccatatatcaccattatcatcatcttaatagcagttatcatttattgattatagattagacactgtgcttaagcattttaagttgcattatcttgtttaattctaacagcaggtgactcttcataatatgaataattatcattattctaacatgccaggtgggaaaagtagtcagactggttaagtatcatgcccgaggccaggtagcttagtaaaaggaaatcgtataatttgaattcagagaatataatgaacttcttttttctcctattgcttttatgatgtttaaaaatgagtgcacaaatataaaacatatagactagtacctgagacttagtatttattaaaaatgggctcttaagtggagtcaaaagcttttatttatcatttaatagagtattttgaaaaataaaaaaatcaagataatcaataatgaaaataaaatcgtgaataattttaccatcgggagataaattacttttcatattttagtgtgtatcttttccttttgcatgcagtgtttaaatattgttttaaacccactctttttattctatgttttatgaatatccaaattaataatcaataaaatttgtattacattttcagtggctacatggtataccatcccatatatgtgcctccataatttgtctacttttggatatttaggtagtttctaatgttttgctattataaaaaatgtaaatccttaaatatttatttttgagttcttgggagataacaatcttgaaaagtcaataaagcttgatggtgaccaatatttgtgtgtctatatttgcatattttcttctcattttggactattatctaacggaggaaaaagactaattgtcacaaataatacttagttttcttggtatatatcttctgctaagtactatctatttataactttctcttttagaattacagagtgaaaacttaaaacaatcaattgagaaacagcatcatttgactaaagaactagaagatattaaagtgtcattacaaagaagtgtggtatgatttaaaaactcattagtgtgtaataagtctcaccctatcaatcagtcaacaaatatttattaaatactaatacaatgtacaaggacctggagtttcaaatagttagagaagacacaatcctagtctgcaaaatgctatagtttagagacattgcataaaaacacatcaaaagtataattaaaatacaagaccctggacaggtgacaacagggtggtttaggtaataaattaatagttctaagaattgaaagaacagtatggctggtttggctaggaaggctccatggaggagctggaactataggtgggatttggagaacagtgaattgaaataagagtagtgggtgggcattccagggtaggaaggaggaataataggaaaatatgagggtgggaaaggggcagtgaatgtatagaagcagataagttcagcttttttggttaaggcctttggatcattgctcttgttttatactttatttcatttagagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaaggtaaaatatttattatttttaatacacaaaataagtgaataaaaacaatttacttttaatattcaatgccattttctttgcattgccaactgatgtgtgtaattcatataacaactgtagtcaggtctcatgtataaagtgggaatacattttaaaagtttctttggatagacagatatcttaggaaaagatgtaaaagaagatgttctctaggatagttctcatgtatgctttgccatagaatttagttatatacataaactcatgaaaggttgatgcagtgatatgatatatttaatgactctgtagattattattagcttcctagaagtagcttccaggctgtcaggtttatcttactgaggtctgtagacctttctgatttataaatttagcagctagcctggcataggtaagtactactctatgtttattaaattaaccaattaatcagtataaatttaattaatataattaattatcattaacttattaaataaatggtttcacaaatgtgattacataaaaaataaactagtattttcatttcatctaaatagcagtttttctaatgcttgagtgttaaagactctattttttactactctatattaaggaaatatttatataaagctgtgttaggaggcctagataattattttttgtctcattagcattagggttaattaagtttggtaggataaaggagaacaggtttctctctgaagccatagccggggcctagcaatagtttttctctgttgcttgtgcatggtgagggaaaagctagcctttctagctcccctaatttatatatttttgattgacctatccagtgatttttcatttttaaaaaggtaggttacctaagattcctctatccctattacctcagttttatactttgaggaaacagaaagccagagaagttaaccaaattatacatgttctcataattatattgttcctaaggcagaattcagtataatagtagttacatactcaatttctttcagagttctaggatgcgttaatctgattatcatcaacagctaagagaaaacttataccataagctttaaggtatatctatgtatattacataaatgtaatatagaattatgtatttataatagtaatatcttattttaaaatgttacactatatggtgcagagtaggtacttaataaatgtttaacaatccagtgggtgaatctattctaagatatatcagttgctaaattgcaccaattttagttatgagatgaattctgactaaaataatattttgtattgaaaatgatatattttacaagattggaaaaaaatgaagatcaattgaaaatacttaccatggagcttcaaaagaaatcaagtgagctgggtaagacttagagaataatgtgtgtactttaataatattaacttattatagaatcataaacactgttttgaaataaaatataatttcccctctgtcatttgccagtagagattgcttgataatatttttatttcaatatttgaaggtagaaaatttaaaccttaagaaagagtgttttattcagttttattatgcagttaatagatatttagaagtgtggggagcctaagagaggtctgagtctcctaacagaatacaactaagagaagttgatattctgttttctttattttaggattcagagaccttaataattcttcgtgagaaatgtctgttattgtttaattgaattttgaaatttcattgctttgtcatgttacattatgtactattcacaggaaaatgtgatcctattttatcataaggtgttattaaaattcaacaactttcatggccacgagagagacattctctacagtagttattttataatttatggccatgtaattcgataattctaataacctatgcttcatattcataactcttcatatctacaaatgtggaaaattgcaaagaataaaatagtttccaattttagtgaaaaaatattttttataaattaaaaatattcatgaattggcaaatattttataaaatattttcattactttatgtaagctttattattagatttaaatagttgtataattaaaataattatcaactaaaatattatctagtatcggaaatgtgtgctttacatttcacaagtagttaggttgtttggttgaacttttggaccatatttatcctttttttctgtgaggcttaattttccactatagattaaccctttatcatgtaaaattgtactatcaaatgcaaataattgtatcttcttaggataactttaaattagaatggttataatataaaccattccattttttattcttccttcgagcataaaatagtgttttaaatcattatatatacctatacttactttttaaaaattattattatactttaagttctagggtacatgtgcacaacgtgtaggtttgttatataggtatacatgtgccacattggtttgctgcacccctcaacttgtcattaacattaggtatttttcctaatgctatccctcccccagccccccaccccgcaacaggtcctggtgtgtgaggttcccctccctgtgtccatgtgttctcattgttcaactcccacttatgagtgagaacatatggtgtttggttttctgtccttttgatatttttgctgagaatgatggtttccagcttcatccatgtccttgcaaaggacatgaattcattcttttttatggctgcgtagtattccatgatgtatatgtgctacattttctttatccagtctatcattgatggacatttgggttggttccaagtctttgctattgtgaatagtgctgcagtaaacatatgtgtgcatgtgtctttatagtagcatgatttataatcctttgggtatatacccagtaatgggattgctgggtcaaatggtatttctagttctagatccttgaggaatcgcctcactgtcttccacaatggttgaactaatttacactcccaacagtgtaaaagcattcctatttctccacatcctctccagcatctgttgtttcctgactttttaatgatcgccattctaactgctgtgagatggtatctcattgtagttttgattttcatttctctgatgaccagtgatgatgagcattttttcatatgtctgttggctgcataaatgtcttcttttaagaagtgtctgttcatatcctctgcccactttttgatggggtttttgtttttttcttgtaaacttgtttaagctctttgtagattctggatattagccctttgtcagatgagtagattgcaaaaattttctcccattctgtaggttgcctgttcactctgatggtagtttcttttgctgtgcagaagctctttcatttaattagatcccatttatcaattttggcttctgttgccgttgcttttggtgttttagttatgaagtctttgcccatgcctatgtcctgaatggtattacctaggttttcttccagggtttttatggttttaggtcttacatttaagtctttaatccatcttgagttaatttttgtatacctatacttattttctttagaattgtttaatttaatgtcttaggctaaggaagaattttgtttcttaaaatgtctttaatggatatttatttgtaataattcagtctaatattgaaattaagtggctatttgtcatattaaaaatgcaattgtattatatgattttctcacagtagagcaatatattttgacaaatttgaaaaaagtattctagaattgtgaaatagaaccatgtgtgttttttagcattgccttagatgttgtaggaatgtatagaagtaacataccatccttttgagaaatctctgattattgttggaggaagcttaaatacataaaacccttagagtaatggtgtccaaaatgaaggggtgagcaaaatttcctttaggaaaagggaagaaaatgttagaatttctatttttatttatttttatgttttaaatatgttttataatgaacactgtaatacatatttatattttataaatttatatttataaacattaatttataactgattatacatttatgtaaatataaatatgcatttgtattttatacatactaatatattttgggtgaatgctcacagatttcttattgatggaggtatgttaatactgataccaagaggaagcctaagatagcaatgtgtactgcatagttggaaaaggctttatggaaaaggtagatttaaatttaaaagtagactttaaggctttggatagttgtagaggatgaaggagtgtacaaaacatcatgtgtaggaaggtagcattaacagtgacataggtactcaacttctttgggtgacaatatggtctcaaaaccagaaatcttgaaggatattctgtactatttattctccttcccttatgctttactgctaattggttatctggtgctccttaacacctaactcataaaatataactaacttagaagttcctcttaactatcatttgaatcttttccttttcttgatttccacagatctagaacagttcaattcctcattttctctttcttggttttagagtttcaggatgcatgtaaagaacataatggtacaaaaattgtatttgtaagattaatcatcaaaccgtgcttcagattacccccatttgtcctaatctttattcatccccccttgctatatttaactaagcttctgtttgctttgcctttctttaataatcttttttcttaccccaacaactctcattcttctttgtttcctggctacactttacattcttccttgatggtattttcttagacttacatcttggttaaagtggtcttccatcatttcctcagcagtctcaatcctcaaaacacttttaacctatgtactgctcagatatagcctgctctactccttgtatcttttaggtcagacgtctttgaccagtgctattatagttacaatagcttgagaatcagtccttttctttctaggatagccaccttttgctcattttctacattgctgctagagtgtttctttaaaaatacaaatatgattattctatgtggcaaatttaagaggcatctcattgcctaagttcaaactacttagatatcagttatcttttcattgttcatttaaagagtgggagtactgcataccaagtgagttgaagtcaactgcaataggaaatctttggcaagtaattttttctcagtttcttaacttgttacagttttctttgctgcttcatgcgttgcccatcttcaattcagtctaatattgctgtaaatgtgtcttattcttgtactcatttttccatatctggatctatctttgctttcaatttggtatgtaacagattcccctcctagtaggttctattgcttctgctttgattatcagatatataatataataactattgaactaaggcttagatgtttattccttatttagccttggatatgtaatgaggaatgtaacagacatggtatttgttctcatgaggtttgcactcttcttggagagacatacaaaacaaataatcacaaataaatatttaattataaattgggataagtgctatgaaggaaataaaaatgatgcaatgcggtggctgcaatggactgtgtgggccagtccgcaggcctacaggcaagcgcatatgggtgagtgccagctgtggtggtagtggcaggcctggctgacccttcatcaggcacccaggaggagtgcttaggtgctaatggtggtggatggggcagtgtgatccctaggctcttggacagtgtactcaggcacttgagggagcagagatagtcctcgtgggcctatcttcaggcttcccagttgtgtttataggtgctggctctggtgggcaggggtggggtgattcctatgcccctgatggagcactcaggtgagtgctgcagcagttgtggtgagctgggagagcctgcccttagagcatgtgcaagtgtgctgcggccctgctgccagggagtgtgcgattgttgtaggtggcagcagctataggcaggcctctgaggagtgtgcgcttcagccccaggcatcagctgtccgtgagcctgtactcagggcatgtgaccccgctgctgggggcagtgaggttgctgctagtggttctggcttcacctggtagctggcagtggcagaggttgtggctgtgagcaaggtagcttgtccttggggtgtttgcaaatgtgtgatggcccttctgctggggtgacatgggattgatgccattggcttatgctttggctccagcagcagcagccagtagtagcagctgcaggagcgggagccttttcctggcgcacgcacgggaagatgtgctgcagtcctgctgttggtagggggcagggttgctgccagtggggtgcacttcagtcttggtagcagtagccagcagtgagtattggcaggtgggggatgtcagtggggctccagggatatggagatgcgggggtttttgggccccagagcaggatgtagtctcctgggggctgggctctcaaaatggtacggggctatagctgcttagaactcagagggtgggtgggacccagcataaattccctctatggagcaatgcctttgtgagatctctaggcagctacctatgttaatctcagggtccaaaggacccttccttgccttaggtgtttcctgacacatctcttttgaattccagtgttctttcttagaggatctatttgaagtgtaatttatctactcactaatttagttattctttgtggaggaggtgagtgggcagatgcctctagtcagccatcttgaagcctttcttgtttttaaactttcgtcttacattttctacctctttgttctttttcctgaattgggaggtatctctatcctatctctgtctgtatctctatctttatctgtatctccatctgtatctgtatctgtatctctatctcatctctatctttatctgtatctccatctgtatctgtatctgtatctctatctatctcatctctatctctatctctctatctaaatttgtttctcccttgctaattcaatctttaaatatgtctgttttgctattttcaaaatctcagttgtcaaattttaaatttctaagagctctaggtaatctatttcagggatctggtatcctgttggaacactatacttagtcaaatatctgtttctgttcactctattaactctttttctttgggttttagtttttttcacagtttaatttggagctttctttttcattgttttgcttttcttcacaaattgttggtacctgattgttgactctctaagtataagtattcttcttttcccacttgtgtattacaatctaattcttctgattatgggagtgagtgggagttgctgtggggaaaggtgggcatagcagcttgtcttttactataggggatgtttatcttgcttaagaataataagctatttgtaacactacctcatctgccacccaaattcctaggatccttactttatcctgaggtgggctttgtggtgagaggtatggtcacttggtcttgttccacatagccttcattgaattagtgtgagttgttttttttttttctccaaggattcgttaattttctggtttgttaatgatagtctcttattttgttaatgttgttcttttatatatattttttctcgtacttttttttctaattttgtgggattggggtgagagaacatatagagacatgctcagtccactgtctttaatcaatttttgagtttttaaaaattaagtatttttacctgaaataacactttctagttaaataagctatgtatacgccaggtttttcttttggattctatattgacattttatattttgttaattttctttaaagactgtggacaattattacaagtgttttaaaaaatgtacagagtttgagaaattttcagtaagtctattacatttccattaatcaataaggacccttaacagtgaggaaggacaatatttcagacacaataaatttttagctgacagctggacatattagggaactctgtaggcagtttcttttttggtttaattttttgtgggcaggttaaaaatataagaaagttgaaaaatgcgggaggcttgggctggaaagatttttcaatttattagcataatgttgaactcatggaactgtagaaagaaaaacattgggctttattttttaggatggcaagaaagaaggctgtcagcaaagaaaacaagaacaggaggtagagaggaaacaggacatatgaatagtgcaaaatcaaagaggaaaaaatggggagaagttaatagtatcaaatagtacaaacctccacaatgatgaagacttaagaattgtatcacaaaatggttattggtgatccttaagatgacaattttattattatggtgataagcattagttttacttggagttcaaaatgaaatgtgtaggtaacaaataggaatttgttggaaaaacaaactaagaaatttgatagctgcttgaaagagcagaaaggtcagatattgttttataatcaaatagaatgtttagacgagataagggaaattaaagattcctctacatagaatctgtgtatattggtagcgtaagggcagagtctcagaggaggtgggaatgttgaatccaaagtacaatgctcagagttagcttgagaaaagagaatcacttcttttaagtttggagtgaagattaaaatgtcagatgtttagacagtgatgagttgaaggtaaatgtacattctgacctcatttcaaatatattttatatagatttattgcttattttgctttatgaactttgggttatttggcaatggcattaactttagagaaacattactattaatatttatcttttattagcttttcatagttagatttggactccctctatgctttacattgctctagttgcatttgtctctcctgatttttcccttttgcgtagtattatgcttgttccttctgtctcttttcctattcttttaatccagctttttaacacattttttttttgctcattttagaagagatgactaagcttacaaataacaaagaagtagaacttgaagaattgaaaaaagtcttggtaagtatagtctttcctattaatatatagcaattacttttcagaagaatattgaatcccttaacttatagactctcacactatagatgttttatactaattttttcagctaaaatgtaaaaattatatttggttttaagtaaagatgcattttttagaccaatttttatataccttgttaactgtcttcatcaagctgtttatatcatttgaatatgtgttgatagcacactaagatcaaatttgcatgttatgtagctgattgtaaatttggtaattttggatgttgtaccctttgaacaataaagatgcaattttgaaaaaggtgtatgatatatattcagtacctatatttaatgttcaggtaaaatcatgtttagtgaagatgtagggtaaaatttcattgtattttaattgattacagtatatagaacatgggtcagcaaactgtctgtagaggactagatagtaaatattttacagtttgtgggccatacatggtctctcttttctccttctctgcctttgcctcctctgccttctctcttttatttttaagaaccttgtaaaaatataaaaaccattcctagcttaagggtctaggaaaacagactgcaggctgaatttgtcttgcatactgcagttttctggcccctgatgtagaatataatattgtttatgatgactgataattgattttgtgtttacctatcacatctctacctgattttgcagctcctagttcttctgtcccttggggagcattattttaaaatatttttcttttctccatttaattgctccgggacaaactctttgtaactaataataatgttttcagtgctttcagatttattaatgcatacttatacaagtcttagcttaaatgtcagtgctttatgaaacctctcttgatactctaggctaggtttaggtctttgtatggcttatttccatagcaccctgaatttttcctttgtaacacttatcacaaatgaaattcatttatttttggtattattatttaaggctttattcaccctttagactccttacctagcatagtggctggcacatagtaggtgctcaataaataaatagtggaatgaatgtatgcttcaataagggttaggagcctttgtgttgtttaccttgtaactctagtacttagcacagaaagtgacactttgtaacactttataaatatttgttgaatgaatactaaagcattggcttttatataacgattcacttctgcatggacaaggactggtttggaggttttgttattgttgtaggaaaaaactaggttcttgtcacatgaccaggaaagattaggctcgcagacattttgaagggtgtgtaaggcaggctttatttggtgaaaagtgaaaaaagggaaacagggactgtcagcaaagtgagagtgctgctagcaagctttctgcctcacagattgaatccccagttaccacacaggaataggaggggtcaggctcctctttcttgcaaatggcatgaacttcccaaggccccagcctgtcctcccagtgcacaggctggtcggaggttctccggggagacctttttacttggagacctttttaccttctccattctaaagaagtacatctaactgccattagaataaggataaggataaggacaaagaccaatcttaattgcttcctgctgacaggaggtgctgttttgggaaaacagcagtcagatctccctcagagacatatctaaggattcctggcaaaaggggccaatgtctgaagctctggttgcatgaccgttttggagtttgtttgatggcctgaaggtgagaagacacaaacagggttattagaaaatatgtatcaaaataaaatgtggggtaggtggtaaggacagctcaaaaatcccaaggccttttaccagtttgcacagggaagggagggccaaaagcctgactggtaagaaaaacttttacccttttgctggtatgtcaggcttctaggttcccttcccctgagcccaatcctaagctgaccagtttaaggtttgagaaattaactcttcccagtttggaggatgcatctgaggggaatctcccatagtacagagacacaattacctatcagcgaagagaggagataggaggaaaaaggaaaaaacaaggtttttttccaaaggagtcccaggagttcaggatgcatttgaaaggggtacagactgaagatgaatggctactcatctagaaaaaggagagcaggcatcactagcaaataccagggatatgtgagggagggaaagtgaggcattcctctttctttcctctgttcttgcatccctgagtcctggcaaccatgacaggtaccacccattggtgttttagtggctttcactcatgttaacaggggagcctagagggtggaagtatctgctcttacccacatatgctatgtctcccctgctgtcagtagcctttgaattccctagacctcatttatgtcatggatgtgagcatagactttatccatgaaatgggaagcttggcttaattggcaggaatcagccacactcacctgcactgtgccttttaacttcccttattgtcagcctctggatccagttttctttcctagtgctttgacccaaagcttggaattgagtttgggaccaaaatgtgtctcaggggtgttgcatggactccttatcgtaagctgaatgctaaggtaacactgtggaactgagttttcctccaacaagggagagaaaaggatgtcttatgacatgcccagataactggtggctatcattatgcttgctaagatttgggtgcattgtgcttggctttggctagctcccttggtcttactttcccaaaaaagaaacctccaggtgatgggcaccttatttattcccatcatctgtccggatttgcaagataattgctcagaactagaatattgatccagatttttacattacccatccccttttcttccttctgagccacatctggagaatgctgcttggttcataggaacaagcaggattagtctaaaatgtaggcaaaaacttaaaaacaactaatgagtttagaaagtaatgacaaatgtatgataaattttgaaacataatttctctctctccagtcctcatttttgctaaaaaaacaaatcatgataggactgagttgtttgcaaaatagactttagtcttatacttggcctgattttttgcataaagtacagcaagaataactatttctacataggacttctagattggctttgatggtactctgttccacaaggaatctcagataagaccttttaaagctaggcccagccatggatttgtatcctcaaatacctctgagttgggtaatcctctccttctaaggtcccaagatatacttggaactcctggcctgttagaaagtgacattctttactgaccacaggtcaggaaccctgtatggggctgtgcagacaacggtgtgaggccagttttttcccaaggggcttttattggctctgcaagtcaagtttgactgcttaaagggaagcatacccttccagtcaaagccttggtaaaacaaccagtttctttaattgcatcctgttgcaaaagaaaatgaattcttattgcactgatgcaaacaactatattgccgtaagttaagaatacacacagatagtttccaaattctagaggaaccaggcagagagaaataaacatgctctaaattttgttcacaagagtataccttactcaattattaaaggctgtaaatagtccaaaatgtttcctttactctgaaaaacaaaacaaggatcagcaatattccaagcaaaagtcaaaaagattgcttcagttttctgaattcattcagttagctcttcttttccttgatattcatgaacattttagctcttcatgaattctgtacatttccctttattccagtgtcataatcttcaaagttatcagacctgtatttgagagcacctgtcaaagttctatagcttattataaaccatcttttgaaaagaattaaaacaagacaacaattgtctgtgaataacgaaatgtccagggtagttacaattagaaacacaattgacaaagaagtttggtacctccgtggtttacaataacttaaccttaattgtgattgatagtatactcagacattagaattttagaaatcccatacaatttgggaacatatattagtattattcaccaaaatataacctaaagaatattgaacaccattttggcaatcctatgtaagtaaacatgtcacataatcctgtttacctcttttctggatactccagaggcccttctgaagcatcggaaaagcctggcgtcaggaaaggcaattttgaaactgaagtttgattttgggaagcctgtaaaatatgttagaggttgaaaacacttaatgttatgaaatagaattccagatgacataaatcatttattttgccaaagtcgtgattcagaaacttttataacctgttacaaattttgcttaagagcagattagtgccttatgaatacttcgttgtgcttttattttaatgctcaatttacagaaaaaccctataatgcctttttgaatttagtcaatatatgcacacacagagtttttgcaagattagtttttacaatccttccaccacttgtttgaacttttaactttattttatctaatttgaaacaattctttaaccttaggcaacaatttacatttttaatgccttcttataacatttttttttttgagatggaatttcgctctgtcacccaggctggagtgcggtggcgtgatctcagctcactgcaacctctgcctcccaggttcaagtgattttcctgcctgagcctcctgagtagctgggattataggcgcccaccaccatgcctggctaatttttgtattttttgtagagatgggattttgccatgttggccaggctggtctcaaattcctgaccacaagtgatccacctccctcggcctcccgaagtgctgggattacaggcatgagccactgcgcctagcctcttataaccttttattaaaaacacattttactgttcttacacacctcacatgtaaatctatttccagtagtctcaattacatgtcataatagtaacttttagcaatttttaacttcaatgtaaaatctggtaagttgttttgagtatgtgctaggagcagctaaggtttgacttcttcctgcataattaagggtgtggttagttccatatgtccccatgccttaccaagttgaacagttctcaaaaaccaaaaagcagtttataaccttaaaacacttaacaaaccttgcatctgacctgcataatttagtccacctatttatattttgatgatatctgctttttaccaataatctttaagtcagtctttattttacaaagattaaagttatatgaactgaaaggtaccacagcttttatcttccctttaaaaaatatttgatccaagcacttatcttcctttaagccaattaattagagctctttttagagacatcacacatatgtaactacataggcagaagaaaccccagttgtcataagatcttttcaaatggggagaggaatctatctgcttttaattcctggggttccatgaggatagcagaggtctctccccactcagatgtgcattaaaagtggcaaggcaaaatcgagaaaaataatttagtcaactgaaaaaaaccttttcccagaaaaacaaggtccaataaaaggaaaacataaaggccttataaatagagctataacttggatatccactttaattaagctgagtactccttaagaaaatccttttaactccattattagccaactttagttgggccaagctaccaatacttctggctttcaaactttactaaaggctcagagaaaggaaaatccaaggcagtgcgtggaggggaagagagtcaataagcagcaaaaggttatgcagatatgaaaccataaaggactcattcgctaagctaggattgaacctggggccaccattgtaaaatggcaaaggctagaataaaacattgctatgtggttacaggtcttgctcccaaggacagcaagatggaggcctgcagcaaaatttgctgaggactatacagaaagtcatgcaaagcacgctagattggttgcagcttaagacgaacctcacaaatcctttctcacaactaaaactacagaaaatataaatagtgatccccatcattcctggcccagcaaaatgtcttccaaaaagaaaaaaacctggtttaaaagttacctgctgacaaggtagagaaaaggatgagacagcttagatgctgggctgtgttaactgctgacagggtgaagagaaaaggatgcctgggggaagaacttattattcttatgcaagttgttcctccactagggagagaagcataattgctgtgggatggagctggactccttggctgggggagggggagactccacgggcgcttggcagggagtgccagccagcctcgtggggcccttgggtcatgcttcccaacggggaggggagggcggcggggaactgctgctcgcccatctgtaccaaaaaaagaaagaaaaggccatggaaaggctgggttggactgaggccgacattccagatctccgggagcaatgggagtaggggtacagtttcctctatcctcagaagaaatccgaaggaaaaaaggcttagaagcgaaagagaaaaagatgtttttttttggtttgcatttcactcaccctttctcaagccttatgtttctcaaacaatatgttgtaggaaaaaccgggttcttgtcgcaggatcaggaaagattaggcttgcagacactttaaagggtgagtagggcagggtttattgggtgaaaaggacaaaaagggccacagggactctcagcaaagagagagtcctgctagcaggctttctgcatcacagattgaatccctggttaccacataagagcaggaggggtcaagttcatcccccaccccgcaaacggcaggagcttcctgaggccccgccctgtcctcccagtgggcaggcttatcggaggttctccagggtgctctttttacttggccgtctcattatatatgaacaacatcaatatctggattctcaggatcagaatgtcttgattggtgtgcagctctttacttgttagctatatgatcaagagcagtttacctaaactcttgatgcctcagtttttccatctatgaaatggaaaaaataattgtacatatttcatagggtgattgtgaggaataaataagacaattcacttactcatttaacaaacatttgttgagtttttcagctgggcatgctggctcacacctgtaatctcagcactttgggaagctgaggtgagcggatcacttgaggccaggagttcgagatcggcctagacagtatggcaaaaccctgtctctactaaaaatacaaaaattagctgggcgtggtggcagtgtgactataatcccagctacttgggaggctgagacagagaatcgcttgagcccgggaggcggaggttgcagtgagctgagattgaaccactgcactccagcctgggcaacagagtggaccctgtctgaagaacaaaaacaaacatttgttgagttttaattatgctaaaactctggggatacagtggggagcaaatggacccatatactgccttcatggaacaacagccatcaagtagtcacacttaaattcaatcactcattgaaatgtaacattacaatggtgacaagggcattaaaggattagttcatagtatgatgaggcctatgataaaaggacttgaactagttaggttaggataggcttttttgaagaagtaaggattgaactgaaatctggagaaaaaatacagcatatcagatagaggaaacatgctaagattcttttcatgggagggagtatggtgagtacatgatgaagtgaaagatgctgctggagagttagataggagccttacaattcatggccttgtaaatcatatcaaaggaattttgtatttatcctaagagggatgggacactccagatgattttagcagggagtgacttgatcagatttgcatttcaaaaagcacatttggcctgaaggagaatagtgtattaaggcagaacagttaagagtagacagacaatcacagtagccagaggagagatgatggtggcttagtctgggaggtcgtagtagtagtgagaaaaagtgatgtaggatgacattaccatttgtttaaaatactctcctttctccattgaattgcttttgcacatttattataaaaatcaattggccatgtttgtatgggtctatttctggactctcttacattttcttggtgtatttgtctattcatttgccaatattgcagtgtcttgattactgtagatttaatactaagtcttagaattgagtaatgtgattcctccaactttattattcattttcaaaattgttgtagctattctagttcctttacatttccatataaattttataattagcttttctttctttcttttttttttttttgagacggagtcttgctctgttgcccaggctggagtgcagtggtgcgatcttggctcactgcaagctccacctcccagattcatgccattctcctgtctcagcctcccgagtagctgggactacaggtgcccaccaccacgcctggctacttttttgtatttttagtagagatggggtttcaccgtgttagccaggatggtctcgatctcctgaccttgtgatctgcccacctcggcctcccaaagtgctgggattacaggtgtgagccacctcgccccgcctagaattagcttttctataccttaaaaaactcttgctgaaatttttattggaattgtgtgaaatatatagattaattcaggttgaactgacatcattagtacgttgaatcttctagtacatgaacgtagtatctgtttctatttttatagatcttctttataatgatttatttcattagcattttgcagtattcagcatacagtactgtaaatgttatattaggtttatacctaagtatttctctttttgcaggtattttaaataactaccaaataggcatttgatttctttttcttgccttattgcatggcctcagactgccagtatgctgaataacagtggtgagcttgtaaatctttgatatcctgatcttaagagaaaaacattcagtgttttaccattaagttatgatgttacttgcaggttttttgtagaaagttctcttgtatttctagttcactgaaagtttatattatgaattgaagttgaattgtgtgaaacgctttttctgtgtcaatttatatgatcatgtggtttttcttctttagaccattaatgtggtgtattcattgatttacaaatattgaatgaaccttgcatttccaggataaaccccatttggtgttgagtattgtactttttttctatttcactgaattttatttgttaatattttgctgaggatttttatatttgagttcataagagatattggtctgtagatttcttttcttttgctatctgtgtctggttttggagacaaagtaatgctggctttgtaaaatgaactgagaagctgtttcacagaggcaggtctttgcaaacctattccaaagttcaaagaagcttagaggctgaagaaagaggcttataaatccagtttcttggaaacatttaatagggacttacaaacagaagccatgtgtgtctcaagtagtggtaagacaagatgatgaatccctgcatcgttaacccccagacccaaggattatataccttagaggaggggtacatgtgcttcagaggcaatactagaaatatgtcctaagggcaggatttacgggaagtaccttcttgtacacaaggaacaatagataaactggaaatcttagaggactttctggaacaggggttaagcagaagccaacatggtagattagcttccaagatagagttgttttatgctccatagaagcttttgtttcttttctgttttctggaagagattgtgtaaaattggtataatttcttctttaagtggtagaattctctagtgaaaccacttgggtctagagatttctttttggcaaggtcttcactatggatttaattttttttattgttatagaactatgcaggttacctgtttaatcttgaatgattttggtagtttttggttttaaagaaattagtccatttcccccaagttgtcaaatttctgtgcatagaattttttgtagcatttcctgttatccttttaaatatctgtacagtctgtaggattaccttctttttgttactgatattggttgttgtgtcatttctcttttttgtctctttttttttggagatggagtcttgttctgtcacccaggctggagtgcaatggcatgatctaggctcactgcaacctacacctcctgggttcaagtcattctcctgcttcagcctcctgagtagctgggattataggcatgcactaccacaccctactaattttttgtatttttagtagagatggggtttcaccgtattggccaggctggtctcgaactcctgacctcaagtgatgcacccgccttgacctcccaaagtgctgggattacaagtgtgagccaccgtgaccggccccttttttattagtctggtagaggtttcttaatttcatagatcttttcaaataattagtttatatttcattgattctttctattgtttttctgttttcaatctcattgttttctgctcatatctttattatttccttccttctgctactttgagtttattttgctctctttctagattcctaaggtggaagtttagattgttttgagacctttcttttttgtaagcatttgcatgctataaatttcctctagtcaccttttcagctgcatttcacaaatttttatgtgttgtattctcatttagtttaaaatagttttaaatttctcttgagggttttcctttgatcccatttagaagtctattgttcaatttccatgtatttggagaatttcctgttattttttgttattctttcctagtttaactttgttatggtcagagaatgtacttttgtaaaaaatttcttaaggtttgttttatgtatcagatatgatatatcttagtgaatgttccatgtgcactgaaaataatatgtattctgctattgttaggtagagtgttctgtaattgtcaattaggctcagttggctgatggtgttgtacaaatatatgtttttaattgaatttttgggtctaattctattatttactgagagaagagttaaaactagtaggattttggaattgtttatttatctatttaattctatcagtgattgcttcgtgtgttttgaacttctgctataaacttcacatttatatctaactaccatatcttcttgatgaattgaccctttgattataattaaatgccctcaatttctgataatacttttttgttttaaagtctattttaacatattattatagccactccatgtttcttatgcttgttgtttgcatgatatatcttacaacctacatttgactttatatttgtacatatgtgcttatatgtagcctgcatataattgggtcttctttctttatgcactccgacaatcactgctaattggagaatttagaccattgatatctttaaaaattgttgtttaagtgttgatgtggcttagattagattcaccatttaaaagttgttttccgtttgctcctttgttttgttcctcttttaaactctctgccttcttttgggttatttgaatattttttggcattccgttttaatgtatctactggtattttatctatacttctctgcatttatttttgtggctgttctaaggattacagcatgtatccattaccttgtctatattgagttaatattgtaccacttcatgttaaatgttgaaacttttttttttttttttttagatggagtcttgctctgttgcccaggctggagtgcagtggcatgatctccgctcactgcaagctccgcctcctgggttcatgccgttctcctgcctcagcctcccgagtagctgggactacaggcgcccgccatgacgcctggctaattttttgtatttttagtagagatggggtttcaccgtgttagccaggatggtctcgatctcctgacctcgtgatccacccgcctcggcctccctatttatgtccttttcccactttgtcctttatgctagagttgtcatatatattacacctacatgcatttacatcttccaagacagtgctataatttttgctttagtagtcatatgttttttaaataacttgaagaaaaatgatcttttatatttattgcaatatttaccagttgtgatattctttattttttcctgaagatccacgtttacctctaatattgttctccttcagcctaaagaacttcctttagtatttcttgtagtgcagttttgctgctgacaaattttcttagtttttctttttgaatatattatttatttactcttcattctggaaggatttttttttttttttgttataggattgtgggttgacagttttgtttctttcagcaccttaaagatgatgtcttattgtctttgatcctccatgttttctaatgagagactcacatgctttcaagattttctccctaactttgattttcagcagtatgtaagtgaagttgaattattatatttgagattcactgcacttcataaatctgtaaatttttaactttcttcaaatatgggaagttttggccatttaaatatttttctgccctatttttgctgtcttctccttctaagattacaattatacattgatttgatctttttatattgttccacgggttcctgaggtgctattcattttatttcaatgttttttctctgtattcttcagactatcgattctgttgttctgatagtcagattcactgtctctttccttgtaatctccattgtgctcccatgagcattcaatgaatttttttttaccagctctaaaatttccatttgttcttattttctatttctttccttagattttctatctttttattcattttaagagtatttcctatacctgattgagcaaaactgaattagctgcattaaagttctcatctgataaagttctcacatcttggttatactggggttagcatatatctgttgccttttcccttgagaatgttgacattttaccagttctttgtatgttgaataattttggattatattcaggacattgtgaaggttatattatgtagattctgttacattcttctgaataatgtaaatgtttttgttttatctatcagtttgctagattcaaaaataaactttatctcaccttctataaatggtgcttcaaatcttagtttaattctctgagcctttggtgtactacttttgactctgtatatgaatgtatgcttcatgggttgtttttaaatttgtgtagtattcatacatagaatcaggagattactttcagtggttctttgttctgtatgatttctcctttatattctggcagctggttgtgggtcccagggctcctttccctggttctaccaggttcctctagcaagagagatggtggggtttctattgtagttttagctgcctataccacactgcttagcagtgacatttcaccattgggacaaagctaccaaaactgacaaactcactcctcttccagccacttgtgttaattttttttttacttgttaaaatccttaggttatatattgtctctctctctctctcccccgccctccctccctccttccttctttccctctctctcccttgctgtacacacacacacacacacacacacacacacacacacacacgtttatatgtatttatgtattttgtccagagtttatagaagttttcagtgggagagttggtctctgggcatgagattatagtgacatactgaaagctaaaagactgcttctattttttgatccttcaaatggagacataaaaatctgacttccatagagtagtgtaaagaatgaaaatatattttaagcatctagtgagggctggtcatacagaagtcatctgaaagcatgaaaccatggttattgttatcaatctgtctccacagtccttgatataatttaaacacttttcatcttgcatttgttttggcacagtagtctcattactggctttcttgtttttaggttcgccctacttaagctttcttctgcactattgctagtgttatcttttaaaatcgcaaataggattatatattgttacagtaacatttatgatgattccacattgtctatagataaaattcaaactccttaactacaattagtagtttttatggttaataatataggaccttttattgtgaggccttttataaaatcattgtgatgtcatgcttgggaagacaaagtaaaaagtgagttcataaatatatgctgtgttggatagtagaaggaatgatgagaaattaatcatctgtaactaaacaattaattattgtgttccagggctgtgtctactgaattgtctgtcatcatgtttagtctttgaatttacttaatattgactaattttctctttttaaagaattttagccagggggaagctcatagttctttccacagctccatttgggcagtttgattactttcactatgtgtatggtttggcattcctgatttgttaatgtttataaatagggagaaaaggaaacacttttatatgaaaataaacaatttgagaagattgctgaagaattaaaaggaacagaacaagaactaattggtcttctccaagccagagaggtttgtttaaggaaacatttttattttaaatattttgttaatagaacatagatttatggattatggtataagtatttcttttgttaaagatttcttcacaaaattcctttccaagcatttattattacattaatatatttatgattgatttaaaacacatctagacaacccccatattataatgtgagaaagatcagcatttaaaagatcaatatgatgcattatgctatggtttataatagtgatatttcttgatgtcttgagtattttttcttttgagacagagtcttgctatgttgcccaggctggagtgaagtagctaattcaaatgcacaatcattgcacactgcagctttgaactcctgtgcttcctggctcatcccctcaagtagctaggattataggggcacaccatcatgcctagccaagtatttcttaattggtacatttgaaatttagacttcattaagttaggttcttagtttatagtactttttatagtgctcatgttatagttttagaatttgtattttaaagtatgtttccagtccatgacagtattacatcttgtctttttacaataataagaacattatagttcttattattttataataataagaacattttagttttttaagacactacctgatttcatcaattaatatatttctccttgataatataacattttaatagaaattagttacttggcagagtgagaatattttatagcatataaatgtttttctggttgaattttacaatatcgagatagaatttacttatactgaatatgtcattgttcattgttttaaaattatagtgattattcactttaaatttactcgtttaaaatatttgacataacctgccaaatttttgccaaatatatgacttaattacacagtgactataccttttaaatgagaaaattcgaaaaacacttgccatagttatatatgtttattttgcagaaagaagtacatgatttggaaatacagttaactgccattaccacaagtgaacagtattattcaaaagaggttaaagatctaaaaactgagcttgaaaacgagaagtatgttttccatttatctaaaaatagtttatgtactcaattcctaagctttctgataataaataataatttagtaaattatatttaatatttatttgaatggatttgaaattgtattttactcttaaggatctaaataatgtgctaatttcattgctaaagaaagtacatatcactgacataaagaaagagtacatcccaaatttgagaaccactttagatcaatgtgttacttttcttagaggtatttagttccccataaaaataatcattttcagttctaactggttgttttggttgttttgctaaattattttataggtttttgctgataaagtgtcaaaataaaaaattatttcttacattatccaaataaaatattgaattggatgattttacctactcagtaagtttaatttggagagaaagcggggaaattattattgtattattactcagagaaaagtaaattcaagtagccagtatagtggtggtgagcatgattttccccttttggtggcttctcagtgctagattaaatatgagaagtaaacagtttatgcagcatcctctcccttcctttttatctaattctctatttctggtaccttttcaatagtacttttttaagggccctaggttaaactcatctattaactaatgtcccttttaatgaatggactggttagttatttgtactttaatgtaaatttgttatccttagtatatttgcttttcaacttttcattggcttagtgaaacactttatctcctctttgatgaatttccagtatcattaagtagaaatagataatagatgctcctaaaatcactctgtagagccacatactcctccgccttcatttaaaattgatattggatgtaagcaatacagcaataatctctcttccaaagtagaacatttgagatcttttaagagcaagttaggtgttgtgcaaaaaagttaaattcagttttttttttaaatactttaagttttagggtacatgtgcacaacgtgcaggtaaaaatatcttaattaaacacagctaatgcttcgtgtactactttaatcaggttataggaagtttgaaataacttctaagagacagtctaatggagaggaaaaaattattgaagaaaataatgtgctcttcaaaatttgtggaaagtatgaaaggatgagcaaacagggaacatgcaaggaaatatattgtatgacatttgaaaatttagtaaagaaaaatttcaaaaatataaaaattagaaggaataatgtaatgatcaacctatcacccagcttcaggaattataaaccaatagtcaattttgtttcatgtttttcccccagcccttcatccctttcccctatcattatgttgaataaaattccatattatgtcattacatttgtaaatattttggtatgacttttttttttaaaaaataggcttaagaatactgaattaacttcacactgcaacaagctttcactagaaaacaaagagctcacacaggaaacaagtgatatgaccctagaactcaagaatcagcaagaagatattaatgtgagttgaaaaagaaagtgctggtgacttagttttcttccaattagcaggttagaatagatgacctctaaagaccctttgacctttaaagtctgattgctttagagctaaaactttgttttagcagaaaaatatgcatattggtcttatagggtggtaataggcaacagaggctaccctctgattaaaattaaaatggaagccattactagaaaaagttaatttaattttaggcatcaagatttttaaaaagtatttagtcaataggtatttattaagtcatacaagattgtggaggatacaatgatgaataaaatgtcaccctttctctttaagaacttatgacttaataaaaaatagtaatttctcacataacttaagcaaaatagtatgtcatatatgttgttagtgggacaaggtgctatcagagtttgcaggatcacttctgctttggataaagagaaggcttctgagagaatatagcattgattttggtcttaaaaggtgaattatgagttcagtaggtaacaatgaatggaaaacattacttgaagtgacaatatgaacaaaggatacagactcaaagtaacgctggaaaaccaaatgatacttgttttgttaactgttatatagagattgttgggagaataattaaagtaaggcttaaaaaagtagtatggaactatacaagttgaaaagcccatttttttgctttatatataactaaataaattttatgctgatagataaaggtcttaaatagtagtttaaattttatttttgtttaaacaaaataattgatataaacaacattatttctttagaataacaaaaagcaagaagaaaggatgttgaaacaaatagaaaatcttcaagaaacagaaacccaattaaggcaagactaacaaattggcctttttttgtctggcaaaagattttgatatttcttttctattaacttgttatcattaatttaaattggactgctgttgaatattttataaagtaaaaattagatataaatcactgttgtggaatcctgcttaaaaataaaattataataatgtctactttatacttagtgttaaaagttagtgagattagacagaaattttaaagcatcataaaccttctaattctttaatatttaattaagaaaatatattaatcacatttaataaaatatagaaatcttaaaaattacttctaatcatatgaactattataatactagagtatttatacccactctatatttttttttttacattttaaaaaattatctttatttaggtttctgattcagcacatgtatcaaagactaatcaacataaaggagtaaataagacattagttgaaggtcttacatctctctaaactctgaccaagaatgtcaagattgccactattaccagaactccaacctagtcaagttgtagacaagctatcatgaacaacatacagtgtgcacagatatgcagaggcaaaaggcatgctagcgcttggctctcctcttttccttgttgacatctttctgttggacagtccacttttgctttctaggctaagttccaaattaagtccaaagaaggctcagggtgaacctgaccagatacttttctggaggaatgcattcttaaactgttgtgcctgcaactttgtttttgctaggatgaagttcagaccgagatgtacaatacaatctagatgatggtgcagactaagtcaagaactaaagttgagcagtaacccgagttaaggcatgaatgcagacacacacatgcacacacacagcatccatgctatcaagacacaggattttttcacgagaggcaacctgggctttgcagttaatcagaaaatgccccccacgactttatgctaacagctgtgtgtatgttttaatcaaaaaattaaagaaagaagaaaaaaaactaaaaaaaaaacaaactaaaaaacaaagaaaaaaacaaacaaaaaatcaccaaaaacctagaaaccccttaatctcttacaatggctcttgagcatggaactcaggtagcagcatcaatggctggctctttaacaatttggaaataaaaggttgtttttttgtatttctttggtagccatcactacaaagttttcagtgttggttacctataagacaagtactagacagaagatcaagttacacagaaatatttcttctgtactgataagatacaaatattgagctctcaaagcacaagttactatgctttttcttgccttattgggcattctctaaaagcaaggctttgtgcaggaaaagttcatgtctacctaacaaagggtgatacgtgttctattttcctacaagtgaacaattaacacaaattcacattatcagttatttctggttgaatccgttagaagccaattacaaagggacagcagcacttggtgtcaaagccactttctggtcacacattcattccatggttgctagtcagtatctcaggagctcagaatttaaaactcttttcagtcaaataaggagtaagttcaattaaagacttccactatctgccaaatttctagaattctgtctagagggctagcatgcttgatgagagaaagcagttcagagcccaaagaggtgtcaggtattaggtaagttaatttggttttgtataaaaggcatggtaatccggcaacagagtacttatcctattagcagcacagtggtagccaagggtctctgtctgcaagacaggaaaatgaagctactgaagcccctgttgtcccgcctgcctgcaggatggctactgattttacaaaggcgttctgggagccaatccagggctcacctgggagagtgggtaacagaatggcaggaaccatgttcagcccccatgagaagtgcccgactgagggaagtcagcttcccataggtgtacccactctatattttaaagaatgtatttggtcattgcttataatcatacatatataattttgtatgtggtttttccatttaatattatttttagcattattaatgtttttatgtgttttcacagtcatctattttaatgcccatctaccagtcattcaagtggatgtaatgacattattttagtcatttttacttttggatatttatgttttttagtttttcattttcatagataatactagtaaacatgttggcacataaatactttttccttattttgaattggatcatagtaataatgatttctatggcttgatggttagtttccaataggttgtatcattgtaaaccatgcaatacaacaaatattatatgaaaatgctggtcctaaaatgttttaattgatattgggtattattaatttattgataatttaaaagataaggataagtcatttttggtatgatttgtgatttttagtttttggataagctttggaagctttcaagtttgattttagaatttcttctttttaaaattgtctgcttatacctgttgccctctaatcttttgaggttttttttttttattgatttgcttaagcttctaaaaatatattaatcttttacctggtttatttatagcacatattttccctaacctgttgttttcctttaacttcagagaactttttattatatgaaaggtttcaattttttattaaacttgattgtcttttgtgattttaccattgcttcttttaaggtttctttttaattttcgatttttaatttttgtgggtgcatagtaggtatatataagtatggggtatataagacattttgatacaggcatacaatgtgtaataatcatatcagagtaaatggggtatgcatcactttaagcatttatcctttgtgttacaaatagcccaattatacttttacttttaaaaaaagtacatgtaaattattattgattataatcaccttgttgtgctattaaatactagatgtgattcactttctattttttgtactcattaaccatctccatttcctcctatcaccactactcttcctagcccctggaaaccctctttctactctctatcttaatgagttcaattgttgtaactttagctccttcaaataagtgaacatgcaaagtttgtctgtctgtacctgtcttattgcagttaacttaatgacctccagttccatctatgctgttacaaatgacaagatctcattctttattatggctgaatagtactccatggtgtatatgcatcacatttttgttatccattcacctgttgatggacacttacatagcttccaaatattggccattgtgaacagtgcttcaattaacagagtgcaaatgtctcttagatatactgatttcctttcttttgggtgtatacacaggagtgggattgctgggtgatacggtagctctatttttgaggaacctccaagccattctccatagtggttgtacgaatttacattcccaccagcagtgtatgagggtttcctttttctctgcatcctcgccagtattttttattgcctgacttttggataaaagccattttaactggggtaagatgatatctcattgtagttttgatttgcatttctctgatgatcaatgatgttgatcaccttttcatatacctgtttgccattggtatgtcttcttttgaaaaatgcctatttagatctttcgcccattttttcccataggattattagacttattcccatagagttttttgagccccttatatattgtgtgtattaatcccttgtcagatggatagtttacaaatattttttcccatgctgtgggttgtgtcctccctttgttgatttttttttttctgtgcagaagctttttaacttgatgtgatctgacttatctatttttgctttggttgtctgtaattgtgggatattactcaagaaatctttgcccagtccaatgtcctggagagtttcctcgacggtttcttttagtaatttcatagcttgagatcttggatttaagtccttgatccattttgatttgatttttatatatggcaagagataggggtctagtttcattcttctgcatatggatatatggatatccagttttcccagcactgtgtatcgagactatcctttccccaatgtgtgatcttggcacctttgtcaaaaatgagttcactgcagatgaatggatttgtttgtgagttctctgttctgtttcattggtctatatttctgtttttatgctaatgccatgctgttttggttactatagctaggtagtacattttgaaatcaggtaatgtaattcctctagttttgttctttttgcccagaatatcttgggctattctgggtcttttgtggttctatataaattttaggattgattcttctatttctgtgaataatgtcattggtattttgatagagattgcattgaatctgtagactgctttgggtagtacagacattttaacagtattgattgttccagtccgtgaacacgtagtgtctttcctttttttgtgtgtcctcttaaatttcattaatcagtgttttatagtttgcattgtaaagatttttcacttttttggttgggttaatttctgggtgtttaattttatttatagctattgtaaatgggagtactttcttgatttatttttcagattgtttgctgttggcatatagaaatgctactgattcttttatcctgaaactttcctgaatttgcttattagttctaatagttttttggtgagatcattaggcttttccaagtataagattatacttggaaatatacatgtttccaagaaatatacatctgcacgcaaggataatttgacttcttttccaatttgaatgccctttatttcttccttttgtctaattcctgtagctaagacctccagtactatgttgaataacagtggtgaaagtgggcatccttgctgtgttccaggtctaagaggaaagaccttcagtgtttccccattcagtatgatactaactgtgggtcagtcatatatgcttttattatgttgagctatgttccttccgtaccccgttttttgagggtttttatcatgaacagatgttgaattttatcaaatgcttttcagcatcaattgaaatgatcatatggtttttgtcctatagcatgttgatataatgtatcacattgatttatttgtatatgttgattatccttacatttgtgggataaatctcacttggttatgattaatgatctttttaatgtattgttgaatttggtttgctagtatgttgttgaagatttttgcatcaatgttcatcagggatattggcctttagtttcctttttttatgtgtctttatttggctttggtatcagggtaatacttgcctcacagaatgagtttagctatattccctcctcctttattttttggaatagtttctgtaggattgatattaattctttaaatgttttgaaaaattcagcagtgaagccatcaggtcctgggtttttctttgctggaagactttttattatagctttgatcttattacttgtttttcgtctgttcaggttttagatttcttcatggttcaattttggagggttgtatgtgtctaggtatttatccatttgttctaggttttccaatttattgatgtgtagttgcttagagtagcctctaatgatcctttgaatttctgtgatattggttataatgtctcccttttcatctcctttttaaaatttattttggtcttctctctttttttcttagttcgtcttcctaaagttttgtcaattttatcttttcaaaaaaccaactttttgttttgttgatgttttgtattgttttctttaatttcatttatttctgctctgatctttattattctcttctactaatttgggtttggtttgctcttctttttgtagttttttaagatgcatcattaggttatttgactttttaaaacttttttgatgtaggcacttacaaacacacctcttaatactccttttgctgtatcccataggttttggtatgttatctttctattatcctttgtttcaagacatttttcagttttcttcttaatctctttattgacccactaaccattcaggagcatatttttaaattttcatgtgtttttacagttttcaaaattcttcttgttattaactttcagttcaatttcattgtagtcagagtaggtacttgatctgatttcaattttttaaatgttttaagacttgttttgtggcttaacgtatggtctgtccttgagaatgttccatgtgcttaggagaaggatgtttattctgcaattgttggatgaaatgttctgtaaatatatattaggttcatttggtctaaagtgcagattgattgatgtttctttggatgctcaaagtctgggtgatttgtccagtgctgaaagtggggtgtttaagttaccagctattattttactggaacctatctctctttagctctaataatatttgttttatatatctgtgtgctccagtgttgggtgcatatatctttgtaattgttatattctctagctgaattcatccctttatcattatataatgaccttctttgtctctttttatagtttttgtattgaaatccataatgtctggcataagtatagctatttctgctcttttttagtttccatttgcatggagtttcttttaccgttcctatattttcagtctctgtgtatctttacaggtgaagaggtgtttcttgttaggcaacagcctgttgggtcttgtttttctatccattcaattgctctatgtcttttgattgaagagtttagtccatttacattcaatgttattattgataagtaaggacttactctagccatttcgttatttgttttctggttgttttgtggtctcttctttctttccttcatgttttccttttagtgaaggcaattttctttggtggtatattttaatttcttactttttcatttttgtttatttgttgtattttttttatttgaagttaccattaggcttgcaaataatatcttataacccattattttaaactgatgacaagttaactgattgcataagcaaataaacaaagagaaaactaataaaaactctatactttgtttccctggttttaaactttttgttgtttttatttatattttattattgtgtttatgtctggaaaaattgttattatttttcatcagttcatctttttgtcttcctacttaagatacgaggccaggtacggtggctcactcctgtaatcccagcactttgggaggctgaggggggcagatcacctgaggtcaggagtttgagaccagccaggccaacatggtgaaaccctgtctctactaaaaatagaaaaattagccgggtgtggtggcgggtgcctgtaatcctagctactggggaggctgaggcaggagaattgcttgaatctgggaggtggaggttgcagtgagtgacaagagtgagactctgtctcaaaaaaaaaaaacaaaaacagatatgagtagttacattccacaattacagtgttataatgttctatgtatttactgttaccagtgagttgtgtatcttcagatgatttcttattgctcattaacattcttttctttcagatggaagaactctctttaccatttcttgtaagacaggtctggtgttaatgaaatttcttagcttatgtttgtctgaaaaagtctttatttctccttcatgtttgaaggatattttcactggatatactattctagggtaaaagttttttccttcagcactttaaatatgtcatgaccctctctgggcctgtaaggtttccattgaaaagtctgctgccagacatactatatgttatttatttcttttctcttgctgcttttgggattctttctttatccttgacctttgtgagtttgatttttaagtgccttaaggaagccttctttggtttaaatatagttggtattctaataaccttcttgtccttgaatatttagatctttctctaggttgggaagttctctgttattatccccttgaatcaactttctacccttatctctgtctctacctcctctttaaggccaatgactcttagatttgcccttttgaggctgttttctagatcttgtaggcatgtctactaggcattcttgtattgctataaagaaatacctgagactgggtaatttctaaagaaaagaggttaattggttcatagttccataggtcatacagaaagcatggtgatggcatctgctcagcttcttggaaggccttagggaaattttactcatggtagaaagcaaaggaggcacttcacatggcaaaagcaggagcaagagtggtggggaggacacacttttaaacatccaaatgttgcaagagttcgctattgcaggcatcaccaagccatgagggatcctcccccacaacccaaacccctcccaccaggccccacctccaatattggtgattacatttcaatatgaaatttgggtgagagcaaatatccaaactgtatcattgcacttccccgcacccaaatctcatgtacttttcacattcctaaatacaatcatgccttccaaatagtcccccagagtctaactcattccaccattaactcaaaaatccaaaagccaaaatctcatctgagacaaggcaaatcccctccacctgtaaaatcaaaacaagttaattacttccaagatacaattgataaatactcccattccaaaatggagaaatcagccagaagaattgagttcaggttccatgcaaatctaaaacccagcagggcagtcattaaatcttaaagctccaaaataatctcctttgactctatataccacattcagggaacactgctgcaaagggtggactcctaaggccttgggcagctctgcccctgttgctttgtattttgatatttagtttctcttttttaaaactataaaaacattttaagccatcaatttacttctgaacacaatgatgaatttatgatatagtgtttgatatgtagtgtttccatgttcattattttctaaacaacttgtttttatattttaagtttctgtttaatccattagtagcctagatgaattccacatatttgggggctcttgtttgtacttatattatgaagtattcagttttggttttttacatttggttaaagaatgtggtctttaagacttccttattttgagttatttgagatcttctataggcctaataatttttagtataatgtcactcttccattttcttttagaaatgaactagaatatgtgagagaagagctaaaacagaaaagagatgaagttaaatgtaaattggacaagagtgaagaaaatgtatgttatatttaataatggatcgtatcacaaaatttcaaattataaaagcaacaccatatgtctaaactaaaataaagggaagtatactgttgtataaataatagtgatctagagactgtcatcagccatcaaccttaaatatctaggaaaggttggattattttactattgatatctatatctagaagaaatagtggcataattctgattttcttttaacgtgttaaatatttaatgtagacttaacattttttaggcaaaataaaaggctcatacttcagtaatataaaatatatggatgacaaattatttaataagtttgtgtcatgctttggtgaatatgatatcaaattaagataataaggtgtttagggaagagtgtcatgaaaatggaatagtacaagatatgtgacatgattatagtatatattatacagattggaagaaaattctgccaaagtggaaaattgatctagattttgaggtctttgattgtgttttttcattcattcaacaaatattgaccacctactatgtgccaggcactgttctgggtgttacgtttggatttcatttatttggtagagagtagtgatctaattaaagttttttattgagcaggtgacaccttttaatatttgagaatggaatggggagagataaaaggcattggaatcagttggaaagctattaaaagtcatcttgaaagttctaaaaaaatcttggagaggactctggcctagttcagttcacacttattcctgagtcaatcactgtggctaggggatagagtaacctggctaagcctgagctgcatgtcgactcatagagatagagttagccagcaggactactgtggattttatagtagaggaattcttgcaagaaagggtgctggccagaccaaacataggttctctatctggatactattagagtctatagaaaggacatctaatccaaacttgagctagggcgtgcttcctgaaagaagtcacattcaatgtgaagccttagattaatagggattagtggaggacaggtggtggatacaagtatagcagggaggataatattctaagttaaaaaaacataaacattatatgggtaagcctgaaagtatcagagcatggcatatttaagtaactacaaaaaattcattgtaactaaaagatggagtttaaggtagtggtggtagagggcagagtgaggaaagatgagggtagggagaggtaagcatggagagatgaaggtggggaaaaatgagggtggatcatttaaggccacctaagctacatttaagagtttgaggtcattgaagaattttgacatgaagattgttaaaattatatttacacttttgagagctgtaaaactattggaatagttcaaggatgaaataaggtaccattttaaagggcttacaatagaccaggtgcattctaggttctttctatgtattatcttacttaactagaagtcattattgctcttattttataaattgggaaatcagacctccaaaggataaaaaccttcaaaaggttacatgactaagaggtagtagaggtggtcttctacattctttaaattataacacattttcctccctgaaaagctatttttcctttagttcatatttattagttaaattcaacctgaaaaaaatgaacttaatgtgctaaatacttggtatgtaattcactactttaaaatttgtatcagaggccactgcagatcattaagcctgttgtttgttaatggagaaaaacatgaatttaatttttaatgtaaaataaaatcctccattaagaatttaagacatactttattttgccaatatagaaaatattagtgacgatttaaggaaaaaaattaaatgcatgacaaatttttagcatatttcagttttccatatttggatttcaacttacctgttaaaacagtttcccagaaagaatccaggttgtaaatatttcccagatattttgtgtgacattgaatttcattacacttttcttcccccaatctgctaccttagttcagacattttttattttatatatattttatctatctgagccttagtttcctcatctctcaaatggagataataccgatcctttctatctcattggattgttgcaaagttcagaattaataaatgtttgtgaaagctatatttaggggattataaacatttatgtacaagacaatttaaaaaattcgagataaactgggaaagctgataaaacattgcaaagataagaatgatgaatgttgacatataagtaacatgaaaatgatttttttaactgagagaaattatatatattaatggtatacaaagtgatgttttgatatatgtatacattgtgaaatgattaaatcatgctagttaacatattcatcacttcacatacaaagataattttttttttaaaaaaagagatactgaggctgagtatagtggctcacacctgtaatcccagcactttgggaggctggggtgagaggatcacttgaacccaggagttggaagttgcagtgagctatgattgcatttgtatttagatgatctttattgaaatttgtgattttagtataatttttatattaatggaattaccatgattttgaagtgacctttatcagtactttatgcaatatttttattagtctgaaattgcctgtttcaactggtatactgaataaaatagctataatttctcacaattttttagtgtaacaatttaaggaaacaagttgaaaataaaaacaagtatattgaagaacttcagcaggaggtatgtattttttataaatattctcaaaatcaaactgatattttcaccacagttttagagaataatgctttcccttcctttagtaatttaagtctaagtcagtagcaaggtaagtttgaataactttagtactaaatataattatttttaattttaacagaataaggccttgaaaaaaaaaggtacagcagaaagcaagcaactgaatgtttatgagataaaggtatttggcatctttatttttgttttttaaatactaatagatagatgagaatttagacattttattccacttgtttatacagtataaattcaatttataccataacagtatcaattgaaaagttgaaaggttgttatctttttaaatagaggagatcaactcttttagttgtaatagagtacacatctgtgatttagcatgcacatatattcttaagcttggattcaagcagcttaagaatatatgtgcatgcatgagctctttgtgtgtggtcatattccctacttccatattaaaaagtgaaattgagtaagtggaatggattcttggaatctacattttaaaaagctctatgtgtgattatcctgctgcagaaagggattgaaaaccatttacttgtataaaacaaattaaagccttacagtgtaagctcctgatattagagccatattttgtaatcttattcctatgtctttgaacaatgactgacagtaagtattcaataaatagtttttgaattatgaatggaaaacagcatttctcattgtattaattatgtgctttttggaaggaaacataaaaatcttataccttattttaataatatttgaaattaaaaatatataaatgtgattaaaaattaagtaaggattttcataaatggttgatattctatataaaagtagcagattcatatatcttataattcagctcttctactcctaggtagagtaaggagaaaggtacaaaaatattcacagcaacattctttgtattatccccaaacagaagacaacaaaaatgtcaaccaatagtataaaaatcagtcaataaaaaataacactgaaataacccagatgttagaattagcagataaagtcttttatgcagctattataaacatcttcaaagacagaaaggaaaatatggtcataatgaaagactagatggggaatgtcagtgaagaaatggaaactgaaaataatcaaatggaagttttagaactgaaaagtaaaatgtctttaaaaaccaaaaccaaaacaaaaaccaaatggtcctaatagtagattgaatacaaatgaatcaagtgtcagtaaactggaagttgggtaagtagaaattacccagtcagaagtacacagaagaagagtttttaaaagaaaggaatagtgcctcggtggcctgtagaacaataacaagtatttttaagtgtgtaattggagtccccaagtaagaagagagagagaatagggcaaataaaattttcgtttttgagacagagtctcactctggcaccaaggctggagtgtgcagtggagtgatcacagctcaccgcagcctcgatctcctggactcaggtgatcctcctacctcagcctcctgagtagctgagactacaggagtatgccatcacatccagctaatttttgtatttttggtagagatggggttttgccatgtttcccaggctgatctggaactcctaggctcaagtgatccacctgcctcagcctcccaaattgctaggattacaggtgtgagtgactgtgcctgacctgggcagaaaaaattaattgagaaatttctcaaaaatttatcacacttaaaacaaacttgcagatccatggccctcagcaaatccaaagcaagataggcacaaaaccatatgtaggcagtcatatcttagtcaaagtgctaaaaccaaagataaaaagaaacttttaaaggcagacagaaaaaaatgtcacattgcacaacagtgacacagatgatggctgaccttgtatcaggacagtgaaggtcagatgacaaaggaatgacatttataaaatgctaacaaaaataaaccatcaacccagaattctgtatgcagcaaaaagctttattaaatgaagacaacatgacttcaaaagctgtaccctaagcaatacttaaggaatttcttcaagttgaaggaaaatggcattagatggaaactgatcaatgaaaagcactggaaatagtaaatattgagatgaatttaaaaggcgatatatttttcttttaattttaaaacggtatatatggctgcttaaaggaaaacaaattgctattatagagtttataatctgtgtgactaccataacacaaaggacaggggagtaaatataactattttgttgtagcatttttacattacatgtgaaatagtacaatattaacacttaaatagagtttggtaagttagtgatacatactatcctccttagagcaacccctacaaaataatgcaactgaagtatagctgtcttagtttaggtttctaaaacaaaataccacagactgggtggcatataaacaatgaacatttatttcttacagtactggagactgggaattaaaaaatcaagtcactggcagattcagtgtctggtgggaccctgattcctggttcataaacagccaacttttcattgtgtctcaaatggcagaagggacaagagagctctctgggatcctttttacaacgtgacactaatcccattaatgaaggctccatccttatgacctaatcacttcccacaggccctaccttctaatactatcacactggaggtaggatttcaacatatgaattttaggggaatacaaatatctagtccataacaatagcaaaaaagtcagtagaggaattgaaatgaagtggaatatgaaaaaactttgataaactccaaagggagggcagagaaacaaaaaaacagatatgaatagaagacaaataacataatgatctgaactcaagcatatcaataattatattaaatgtgaatggacaaatgttttaataaaaaggcagaaatggtcatgctagattaaaaaaatcaagggcaaaccatatactattacaagagatacattgtatttagtataaagacacaaagaggtttaaaggaaaaagatgaaggaaagaaatactatcatgccaatagtaagcataagaaagtggagtgacaattttaataagaaatgacaattttaataacaaatataagacaagtagtattattaaagatcagtaggggcattttataatgataaagttgtcaattcattaaaaagatataacaattaattaggtatatctttgcacctaataataaagcttcaaaataaatgaagcaaaaacttgataaaatgagcaatagaaaatactatactcataatatccccctttcagcaactgatagaacaactattaaaacatctataaggatgtagaaaatctgaacatcactattaactaccttgatttaaatgatatttatagaacactatatctgcaactataaattgttgaaattcacatagaatgtttaccaaaatagactacatgctgagccataaacaagtctccatatatttcagaagactgaagtcttacagaatatgttctctcactccagtagaattgaatcaggagtaggtaagtataagatatctggaaaagcccggatatttgagaattaaacatcagactaataaataattcatgggccaaagaagaaatcacaaggaaaatgataaattattttaaacggaatgatgagatagacataaaacataaaaatttgtaaggtacaaataaaggagctcttagagggaaatttagagttttaaatgtttattttagaaaagaagaagtgatctaggtttttatctagaaactaaaaaagtgagcaaattaaattcacagaaagtagacaaaaggaaataattagaataagacatatcaaataaataggagaaacaattaaatgaagtcaaaagttgattatttgaaaatatcaataaagctgataagccctagcagaactgaccacaaaaaaagggagagaaagtaaaattcactgcaggcaagaatgaaagagtacataattagcatagataatacaagcattaaaaagataagaaaggggggactgtgatggattacttcatgccagtaaatttgaaatgtagataaaatgggcaaatttcttatgtatcttttagggaagttgaaattgtcattaaaatatctcctagagaaaaatccagatctggatgatttcactggtaaattctgtcaaacactttaggaagaaataataccagtcttccacaaaaaatagaagagtgaaaacaattctcaagtaggtttttgataccaaatcctaacaaagacattataataaaagaaaattacagaccaatatccatctgaataaaagaaaattacaggccaatatccctatgaatatgagtataaatataaaattattaataaagtattagtaaatctaatctagattttaatacatgataaaaaccatattacatcaaacaatttatcaggaatgggatttatcagaaatgtaaggttggtttaaaatttgaagctatcagtgtaatttactgtaccaagtaataaaggagaaaaataatataattatctcaatagttgcagaaaggcatttgacagaattgaacacttattcatgattaaaaaaaaaacttccagcaaactaggaatagataaggacttctccaatctgataaagaacatctacaaaatacctacagttagcatcctatttactgatgaaaggcagtgtcaagagcaatgtctgctcttaccacacctattcaacattgtactggaggctctggcaacaaaaataaatatatacaaatgagaaaggaatacataaaactgtctcttcataaatgacatgactatctacatggaaatttccaaggtttctacaaagtcactacaagattagtaaatgaatttgacaaagtcactggatacaaggtcaatggccaaaaatcaattttatttctatatgctaacagctagtaattgaaaaattaattttaaaacatgataccatttacagtagcataaaaatccattaaatagggataaattttacaaaatgtgtgcaagacccatacagagaacagtactgaacattactgagaccaatgaaagaagacctaagtaaatacatatgtaccatattcactgattggatgttttaatgtttttaaaatgtcagatttcactgaattcatctagagattcagtcaccatgataattccagcagtattttttagtagacttttacatactgcttgtaaaatgcatgtgaacatcaaaatacccaacaattttgagaaagtagaacaaaattggaagatttaggttgcctgatttcaagatttgctgtaaagctataataattaagacaatgaggtattatttttaagatagacaaagagatcagtggaatctaatagaaagtttagaaatagactaaatgtacagactgttaattttcaacaaagatgcaaaaaaattcaatggagagaaatgaaagtctttcaacaaatgatttggaataaccagatattcatatgggaaagaaaaaaaacaaaccttgacccttacatcagatcatatacaaacattaattttaaatgggttataggcatacaatcttgaactctgaagtcttcagaagaaaacgtaggagggtactttcatggccaaggtcagcaaagatttcttagggcaaagaaagcaatattcttaacatgtcaaataagttagactacatcaaaacttgaaagatctgtttatcaaaaggcattattaagcaaatgaatagacaaggtacaaagaaaaagaaaacactgactaaacatttatttgacagatgacatgtatccagaatatataaataactcttgaaactcaataataaaaaaataaatatctcaactcaaaataggcaaaagactgtaaaataaactggttaaaatattggcaaagggggaaaactgggttgcaagatggctgaataggaacagctccagtctacagctcccagcatgagtgacgcagaagatgggtgatttctgcatttccaactgaggtactgggttcatcccactggggcttgtcggacagtgggtgcagcccacagagcgtgagctgaagcagggtagggcatcgcctcacctgggaagcacaaggggttggggaattccctttcctaaccaagagaagccgtgactgatggtaccaggaaaattgggacactcccaccctaatactgcacttttccaatggtcttagcaaacaacacaccaggagattatatcccttgcctggctgggagggtcccacgcccaaggagcctcgctcactgctagtgcagcagtctgagatcgaactgcaaggaggcagtgagactgggggaggggcatctgccattgttgaggcttgagtgggtaaacaaagaaaagctcgaactgggtggaacccactacagctcaaggaggcctgcctgcctctgtagactccacctctgggggcagggcgtagctgaacacaaggcagcagaaacttcggcagacttaatcctccctgtctgacagctttgaagagagtagtggtcctcccagcatggagtttgagatctgagaacagacagactgcctcctcaagtgggtccctgacccctgagtagcctaactgggaggcacctcccagtaggggcagactgacacctcacatggctgggtacccctctgagatgaagcttccagaggaacgatcaggcagcaacatttgctgttcagcaatattcactattctgcagcctccgctggtgatacccaggcaaacagggtctgaaatggacctccagcaaactccaacagacctgcagctgagagtcctgactgttagaagaaaagctaacaaacagaaacaacatccacaccaaaaccctatctgtacgtcaccttcctcaaagaccaaaggtagataaaaccacaaagatggggagaaaccagagcagaaaagctgaaaattgtaaaaatcagagtgcctcttctcctccaaaggaatgcagctcctcgccagcaatggaacaaagctggatggagaatgattttgatgagttgagagaagaaggcttcagatgatcagtaataacaaacttctccgagctaaaggaggatgttcgaacccattgcaaagaagctaaaaaccttgagaaaagattagacagacggctaactagaataaacagcatagagaagaccttaaatgaccggatggagctgaaaaccatggcatgagaactatgtgatgcatgcatgcacaagcttcagtagctgattcgatcaagtggaagaaagggtatcagtgattgaagatcaaatgaatgaaatgaagcgagaagagaagtttagagaaaaaagagtaaaaagaaatgaataaatcctccaagaaatatgggactatgtgaaaagaagaccaaatctacgtctgattggtgtacctgaaagtgatggggagaatggaacaaagttggaaaacactctgcaggatattatccaggagaacttccccaacctagcaaggcaggccaacattcaaattcaggaaatacagagaacaccacaaagatactcctcgagaagagcaactccaagatacataattgtcagattcaccaaagttgaaatgaaggaaaaaatgttaagggcagccagagagaaaggtcaggttacctacaaagggaaggccatcagactaacagcggatctctggagaaactctacaagccagaagagagtgggggccaatattcaacattcttaaagaaaagaattttcaacccagaatttcatatccagccaaactaaacttcataagtgaaggagaaataaaatcctttacagacaagcaaatgctgagagattttgtcaccaccaggcctgccttacaagagctcatgaaggaagcactaaacatggaaaagaacaaccggtaccagccactgcaaaaacatgccaaattataaagaccatcgatgctaggaagaaactgcatcaaataacgagcaaaataaccagctaacatcataatgacaggatcaaattcacacataacaatattaaccttaaatgtaaatgggctaaatactccaattaaaagatacagactggcaaattggataaagagtcaagacccatcagtgtgctgtattcaggagacccatctcatgtgcagagacacacaggatcagaataaaggggtggagaaagatctaccaagcaaatggaaaacaaaaaaaagcaggggttgccatcccagtctctgataaaacagactttaaaccaacaaagatcaaaagagacaaagaagaccatagcataatgataaaggatcaattcaacaagaagagctaaccatcctaaatatatatgtacccaatacaggagcacccagattcataaagcaagtccttagagacctagaaaggtacttagactcccacacaataataatgggagactttaacacccaactgtcaacattagacagatcaatgagacagaaagttaacaaggatatccaggaattgaactcagctctgcaccaagccgacctaatagacatctacagaactctccaccccaaatcaacagaatgtacattattttcagcaccacacaacacctattccaaaattgaccacatagttggaagtaaagcactcctcagcaaatgtaaaagaacagaaattgtaacaaattgtctctcagaccacagtgcaatcaaactagaactcaggattaagaaactcactcaaaaccactcaactacatggaaactgaacaacctgctcctgaatgactactggtacataacgaaatgaaggcagaaataaatatgttctttgaaaccaatgagaagaaagacacaacataccagaatctctgggacacatttaaagcagtgtgtagagggaaatttgtatcactaaatgcccacaaaagaaagcaggaaagatctaaaattgacaccctaacatcacaattaaaagaactagagaagcaagagcaaacacattcaaaagctagcagaaggcaagaaataactaagatcagagcagaactgaagatgagacacaagaaacccttccaaaaaatcaatgaatccaggagctggttttttgaaaagatcaacaaaattgacagactgctagcaagactaatacagaagaaaagagaaaagaatcaaatagatgcaataaaaaatgataaaggggatatcaccagtgatcccacagaaatacaaactaccatcagagaatactataaacacctctatgcaaataaagtagaaaatctagaagaaatggacaaattcctggatacatacaccctcctaagactaaaccaggaagaagttgaatcactgagtagaccaaaaaggttctgaaattgaggcaataattagtagcctaccaaccaaaataagtccaggaccagacggagtcacagccgaattctaccagaggtacaaacagaagctggtaccattccttctgaaactattccaatcgatagaaaaagagggaatcctccctaactcattttatgaggccagcatcatcctgataccaaaggctggccgagacacaacaaaaaaagagaattttagaccaatatccctgatgaacattgacgcaaaaatcctcaataaaatactggcaaaccaaatccagcagcacatcacaaagcttatccaccacaatcaagttggcttcatccctgggatgcaaggctgattcaacatacgcaaatcaataaacgtaatccatcacataaacagaaccaaagacaaaaatcgcatgattatctcaatagatgcagaaaaggcctttggcaaaattcaacaccccttcatgctaaaaacactcaataaactaggtattgatggaacatatctcaaaataataagagctatttatgacaaacccacagccaataccatactgagtgggcaaaaactggaagcattccctttgaaaacaggcacaagacagggatgccctctctcaccactcccattcaacatagtgttggaagttctggccagggcaatcaggcaggagaaagaaataaaggctattcaattaggaaaagaggaagtctaattgtccctgtttgcagatgacatgattgtatatttagaaaaccccattgtctcagccccaaatctccttaagctgataagcaacttccccaaagtctcagaatacaaaatcaatgtgcaaaaatcacaagcattcctatacaccaataacggagagccaaatcatgagtgaactcccattcacaattgcttcaaagagaataaaatacctaggaatccaacttacaagggatgcgaaggacctcttcaaggagaactacaaaccactgctcaacaaaataaaagaggacacagcaaatggaagaacattccatgctcatggataggaagaatcaagatcatgaaaatggccatactgcccaaggtaatttataggttcaatgccatccccatcaagctaccaatcactttcttcacagaattggaaaaaactcctttaaagttcatatggaaccaaaaaagagcccgcattgccaagacaattctaagcgaaaagaacaaagctggaggcatcatgctacctgacttcaaactatactacaaggctacagtaaccaaaacagcatggtacttgtaccaaaacagagatatagaccaatggaacagaacagagccctcagaaataataccacacatctacaaccatctgatctttgacaaacctgacaaaaacaagaaatggggaaaggattccctatttaataaatggtgcttggaaaactggctagccatatgtagaaagctgaaactggatcccttccttataccttatacaaaaattaattcaagatggattaaagacttaaatgttagacctaaaatcataaaaaccctagaagaaaacctaggcgataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgaacaggcaacctacagaatgggagaaaatttttacaatctacccatctgacaaatggctaatatccagaatctacaaagaacttaaacaaatttacaagaaaaaaatcaaaccaccccatcaaaaagtgggtgaaggatatgaacagacacttctcaaaagaagacatttatgcagccaacagacacatgaaaagatgctcatcatcactggccatcagagaaatgcaaatcaaaaccacaatgagataccatctcatgccagttagagtggcagtcattaaaaagtcaggaaacaacaggtgctggagaggatgtggagaaataggaacacttttacactgttggtgggactgtaaagtagttcaaccattgtggaagacagtgtggtgattcctcagggacctagaactagaaataccatttgacccagagatcccattactggttatatacccaaaggattataaatcatgctgctataaaggcacatgcacatgtatgtttattgcagcactattcacaatagcaaagacttggaaccaacccaaatgtccatcaatgatagactggattaagaaaatgtggcacatatacaccatggaatactatgcagccataaaaaaggacgagttcatgtcctttgtagggacatggatgaagctggaaaccatcattctgagcaaactattgccaggacagaaaaaccaaacacctcatgttctcactcataggtgtgaattgaacaatgagaacacttggacacagggtggggaacatcacacaccagggcctgttgtgggatggggggaggggggagggatagcattaggagatatacctaatgtaaatgacgagttaacaggtacagcacaccaacatggcacatgtatatgtatgtaacgaacctgcacattgtgcacatgtaccctagaacttaaagtataattaaaaaaataaataaatcaaaaataaataagtaaatacataaataaatttgataaaggaaaaaaaagaatgagtggaaactataccctcctcttcaatattctggaaccatttgtttagaactggtattattttttcctcaatagctttgtaggattcatccataaattcatcttggcctggaaaaaaaaataaagtatgggcaaaggacttgaatagatatttctccaaatatacacaaatggccaataagcacataaaaatgaaaatatgcttaatatcagtaatcattgcaaatcaaaatctcatgagatattacctcatacccattagaatgggtactaatgaaagaacagaaaataacatgttaatgaggttgtggagaaattggaattctcgagcactgttgatgggaatgtcagatggtacagtcactgtggagaacaattttgtggttccccaaaaaaataaaactaaaataactatatgatccactaatttcacttctagatatatacctaaaagaattgaaagcatagtctcaaagagatatatgttcacctatgttcatagcaacattattcacaatagccaaaagttggaagcaacccatgtgtccattgacagatgaatgggtagactaaatgtggcctctacatacagtattccatacagtatggaaaatgttttggtggtttcttctaaaactaaacatgcatctactgtgtgatccaacaattattttcctagatatttacttaaaataaatggaaacatgtccactaaaaatcttgtacaagaatattcatggtggctttatccacaatgataaaaaatggaaacacataaaatgttcattaagaagagactggataaacaaatttggtatattcatataatggaatactactcagaagtaaaaaagacctactgatagtcacaggaacatggatgaatcttgtaatatgctgaatgaataacctatatacaagagagtatgtttgtcatgatttcatttaaatgaagtttttgaatcaacaaaaccaatttatggagacagaaagaacaatggttgcctcagtggggtactattagtttgttaagggatatgagggaactttctgggattatggaaattatgtcttggttggtattgccattacatggttttaaaaacaatttgtcaaagcttattaaactttacacttaaaaccatgcgttttattatatgtaaattatgtctcattgaagttgaactcatcgacgaaagctactgggcctagagttctgtttatgcaaaggcttttaatttctgaagcaatttaatcatagttacagtataacttggttgtcctatttcttcaagtttgataaataatatttttctgggtttcatccagttcatctacattttctacagtttcagaattgtctgtagcatttactgttaaaaacagtaatagcctgtttttaatctgatgttggttatttgttccttcttttgtttttttctttatcagtgtcaccaggagtttgtcaatttgggaagtctttttcctttgttttttgagatggagtctgcctctgtcacccacgctggagtgcagtggctgtgatctcggctcactgcaacctctacctcctgggttcaagcaactctcatgcctcagcttcctgagtagttgggattacaggcgtgtgcctccatgccggctaatttttgtatttttagtagagaaggggtttcattatgttggccagactggtctcaaactcttggcctcaagtgatctgcccacgtcagtctcccaaagtgctgaggttacaggtgtgagccactgtgcccagacctatcttaagatgagttcttagatcattaattttcagtctttctaatgtacacatttcaatgctgtaaatttcccactaagtattgctgtatctgtgtcctataggttttgatatatagtaaattagtattgtttagcccaatgccctcctgtatctcttaatttctaaatttaaggggacatgttgtgtttttgttactgatttctagcataactgaattgttactagagagcacactctggtatgactttagtactttgaaatttattgatatttgcctgatggcccaatatatggggtcactttttgtaaacatcccttacatacatgaaaataatgtatattgtatagttgttgggtgtttcctttatgtaaagattaccagttatattctttatatttgtgtatctttttttcattctgtacctctgcttttttttatttgtgttttattaagtagttgactgagatagatgtgtttaaaaactttacacaatgattgtggatttctgttttctaatttcagttctgttaacttgtctttatttcaaggccatattattgggtgtacattattttgaatatgtgcaactttttattacatacgatagaactttatgtgtatagttgttcccttggtttatacatgggggattggttccagaaccccccaggaataccaaaatctgcgcatactcatatcccctagtcagccctgtggaacccatgcaaactagaagttggccctccatatatgtgagtttcatatcctgtggatactgtattgtccatttaaatttggttgaaaaaaaatccacatataaatggatgcagttcaaacccatgttgttcaaagttcaactgtatacttaatatgtattttacatgtttatatataatggaaattgttgttaaaacaagatacctcctttatctctagtagagataaacttgccttagagcaagtttttatgttattattataactataccattttttattctgtttcatgtttgcttgttatatcttttaaatctgtttactcttatcctctatctttatgttttaaatgactcttataaatagcatgtagccagagtttataattttatgcactctgacaatctttgtctcttttactggtatatttggccttagactacattatctcctttatctcttatgtcttacttatatgttagtatactattattgttgtcatgtactttgatgattttttttcctaagggttttgtattgtccaagaagaaagaaaaaatagagtgaactgggggtaagcagtaattacagggtatttctaatctgaaaatccaaaatctaaaatgctcccaagtccaaaactttatagcacagacataatgccacaagtggagaagtccatgcacaagtacttaacacatactttttcatgaacaaaattattaaaatattgtattaaattaccttcaggctatgtgtaaggtatatacaaaatataaatgagttttgtgtttagacataggtcctatccttaggatatctcattagataaatctgaaatatttttggtcccaagcattttggaaaaggaatactcaacctctactgagaatatttagaattgatgaaagacctgaattcacagatatagaaagagaaatttataccaagcaagaaaaattaaaagaaatccacatttagacttggtataactaaagaatattggacacataaaagtattaaaagtatctggagagaaatgaaagatgaaagtgaagaaatgacatattggccatgaacatctcaacaaacaacaatagaagtcagaaaacagtgagaaagtattttcatgggctaagaagattactgtcaacattaaattttgtccgcaacatacctatcttttaagaatgttggagaaataaggataattttatattaaaaagtgaggaaaacatgcttttcaagaacactcggacatttaacaaaaatgatcatataggccaagaataactaaagcaatctttaagaacaaagtaggaaaatgtgccctaccagatataaagattaattgtatagctaaggtaattaagacagtatgacactggcacagaagttgtcaagtcaattgaataaaagagaagcctagaaaaagatacaggggtacatggtaactagacacaatacagaagtgatattgcagatatgtagtgctagaacatttgactatctatatggaaaaatatgaaagtctacctctacactacatacaaacacaaattccttaaggatataaataaatgtgaagggcagggcttcaaaacatttgaagaagatgtgggacaatatctttgtgacctggtagtaaagaaagatttcctaaataagattaaaaaacacaaccatatttgaaaatattgatacattcatatatactaaaataatttctggttacttggaaagtaaagtaacaaacctcaaaattggagaaatatcccaactttacatatataaagaacaaaggattagaacccattaaatgtaattaagaagaaaatgaagcaccaagtacataaatgagtaaaatatatgaacagagatggtcacagaacagaaaatatgaagagttaaacatgttacataattttctggaaagtgcaaattatacaacaaaacttcagtcaaatacttttgtctgacactatcaactcttggtgaagttgtgaagcaggaaaagtcataaccttgttgctgagaatttaaattggtataaatgcatatggaaaataatgtcatctttaaagttgaatatgtaacctgccctatgacccggcaattccaatcctaggtatatactatagagaaattctacatttgcaccaggaggtgtttacaagaacattcatagcactattgtgtgtgtaccagtcccaaaatggagacaactcagtgccctgaacaattgattacataaacagtgttatattcatacaatagaacactactcagcagtgaaaatgaaagaactgtatttttacacataaatacctcaaacataactgttcaatgagaaaagcaagccagaaaaataatgtactatgaaaacatttatatgaagttcaaaaaaaatcttgaaatattgtttagggacacataattatgcaatgaatctataaagaagagtaagggaatataaattaagaatgttttttatgctcgaaagggcagtaggggaaaactaatgaagagggaggggcatttaatagcttttatcaatattggtaatggtctatattttaaagtcgatgattgactcatggatacaaaatacagtctgattcatcattatattacccataaccctcttcccaattcctgtccctgccgtataacaccttgccagtattaatttagccctaagataaaagtgaatatgaagggtgctaattcagggctttccttccctcttaataatttctatatttgaattatatctacacaactcagtaaatatttatacaaagtatgtgaaaataatataaatggaagttgttgcttctttatagaaaattaatctcattaagaatatgcctttgaatcacatgagttttctgtacaatggaaatacttattctaataaagcgtattaaactgagtgagagtaaccaatgtaaatattgttgagaaattcattaaaaataaatgcatgggtgtttattttatattacttgtcaagaaaaaatacatattttaggggagaagatagattttttgaaaacaaaacacttctcaccatatgaaaatgtaaggaaagtgatccaacctaatttccatgaataagtaatcttctaagattcacaaaaccacaaaatgaatatggaatgttttcaagtaatccatagcatttactaatattcatgctatttttctttacttaaaggtcaataaattagagttagaactagaaagtgccaaacagaaatttggagaaatcacagacacctatcagaaagaaattgaggacaaaaagatatcagaagaaaatcttttggaagaggtgggaaaaacttaatgtattaagaacttattatactaaaaatctatatttttattaggattttaagaggaaagtaaaaaaatcttaactattaaattacaattttagaaaagggttagtaaatttatataagggtcagtttatcagtttttatagaaactaaaagtatccttgctattctaagtatttgagtatataattattttgaaaggattaaatgattgccacagtggtatagtgtcatcttacttcataaaacaccccgaaaaaaccccaaacagtgcattttctacttgtttttccagtttcctggtgtttgaggtttgcttttatttaagtagaacatatactttttacacttgtttgttttttgtgcatttattttaagaaactttttttttttgcttatttgataggttgagaaagcaaaagtaatagctgatgaagcagtaaaattacagaaagaaattgataagcgatgtcaacataaaatagctgaaatggtagcacttatggaaaaacataaggtaatttttttcttcttatataatgaaaattattaattggagccatatttctgttaaataatggtgaaatcaagatagtattcttatttgtcagagaagattattgtctatgcaacagtgactgtctatagctagaatacccttgatgcccatttcttcaagttcagatcttaaccatacaaagttgagcctgtgtgtcacatccttgaggaaatctctctttgttatctgtgatgaatggaagtaatcactctttttctggattctgctaatagtctcttatagcactttctaccttatatatttttaagtacataaccaggataagtatctcattgatatctaacatataataggctaaatcaatttttatcaaaggaataaatagatgaaatacttagtgtttgatgtgtttttgtcttatatttttaattgttgttttagagtatccatttgttaaggaattaagcctcattccccttaagatttggagaagaggtagggtatacctacctattcaattaaaaaaaaaagctgctggaatacgagattattatgagggaagtggtgaggatttaaaaaataatttaaataacattgtgaactcatagatttgaacacatttggtatgtttcaatccagtgcagcatctgtccttattgataactcacattttcccacctttggctagcaggagcctctttaagctgtgtggcaagtccttttgacttaactgtaattttctctgataactttctttgagttatgacaaaatgtttaaggcttctttttttgatgtaataatttttttattatactttaagttctagggtacatgtgcacaacatgcaggtttgtcacatatgtatacatgtgccatgttggtgtgctgcacccattaactcatcatttacattaggtatatctcctaatgctagtttaaggcttgtatttcctgtcccagatttgaaatcagtcagttttgtagaagccctggtgtttctggcaaatttttaaatgttaaaattcaatgtttccaaagataaaagaattatcttttgctctttggttatttccaagactgttgtgtgtttcactattgaggttgtttgaatgaaaaaatataattgaaacattaaaaatatatacccatatatattactgaatttataaacataagtttctgcaaaattaaatactaaataattaattaaatactaaattaaatattaaaatatgttaggataccaatcttataatctattcagttttaatatatctaaaatgtcttctttgtttaatatagcaccaatatgataagatcattgaagaaagagactcagaattaggactttataagagcaaagaacaagaacagtcatcactgagagcatctttggtgagatacagaaaaaattgcagtaacggccagttttcataatgtcagcagtgactggtggtaaagaataatattaagtaaaactaatttttgagctatagaatcagagtcttaactctgaaagggatcttatagatcttctagttacatgtttttttctaatttagtttttgaaatagtggaacaaactattttttcaagtgaaattttataaactccagtaaacaaataagtttggacctctgattgaaattgggagaggagggtgggataaactgggagagaacgaggagagatatactttgtgttgaagttttctttaaagaaaactacaaaaaacttgattttgttttgttttgttttgtttttgttttttgagttggagtctttctgtgtcccccaggctggagtgcactggcatgatcttggctcactgcaacctccacctcccgggttcaagcagttctctggcctcagcctcctgagtagctgggactacaggtgtgcatcaccacacccggctaatttttgtattaatatttttagtagagacggggtttcaccatgttggccaggctttcctcaaactcctgacctcgagtgatatgcctgcctctgcctcccagggaagtgctgggattacaggcatgagccactgcacccagcccaaaaacttgtttaaatgaggtttttagctatgttaagctagcagcctttatatcagttgactttaaaagtatctacattttatgagtgaatttatttctctacaatattaaatttactcagagcactagtttatattttcattgtcttgagaaatacatggaagctcttctaaacttcatgtttctttttctttaggagattgaactatccaatctcaaagctgaacttttgtctgttaagaagcaacttgaaatagaaagagaagagaaggtaggttttttggcattatagataaaatgattacaaggtttaggggcaactttgcatttttagaattatgtcatattataaaataatttgataaattttaataacgggatgagaaaataattttcccccagaagcttttttctagaaacatttagaatatttcctaatgtaaatgcaaaacacacgtaaatataagtgtacttttaagaaaagaacacttttgtggctcatgtctgtaatcccagcactttgggaggccgaggcgggcggatcatgaggtcaggagatcgagaccatcctggctaacacggtgaaaccctgtctctactaaaaatacaaaaaattagccgggtgcggtggcgggcgcctgtagtcccagctactcgggaggctgaggcaggagaatggcgtgaacccgggaggcggagcttgcagcagccgagatcgcgccactgcactctagcctgggagacagagcgagactccgtctcaaaaaaaaaaaaaaaaaaaaaaaaaaaaaaagaaaaggaacccttttttttctgcaaatactgttaacatttttaatgtatatccttctagcatgtttcctttttttttattatactttaagttttagggtacatgtgcacaacgtgcaggtttgttacatatgtatacatgtgacatgttggtgtgctgcacccattaactcgtcgtttaacgttaggtatatctcctaatgctatccctaccccctggaacacttttaaatatactgtatatgagtaatattatctcgtattaaaatgcttatatatttagatatgctttttttgaagctattcatcatgtttcagaaaaaaaggctatctctgtagtgttttacagtttgcaaggtgaattgattcaccctataaatgacaaatactattttttttggtttctatgagatgggaactgtgtttagtaccctacttacatttaatttaatctttacagcaatgttatatcccacaatttattattatctttactttgacagaggttacattatttattcaggattacgtagtaagagagcagaatgactagatttcaaacctaggtctatttttgcatggcttcaaacctattctcttaatcactctgcaacagcttaggtaacatacactttcaatttcaagcctctgagaatttgtttactttgtttcctgcatttaattcctttcatccttttctatcttggaaaatctcacacatctttcatcttatagttgtgagcttactatatatgtgtgtattctcatagcactttgtttttaatgttaaaatggttatttcactctgtgccccctgttatattgcaagctctgcaaggtctaattatgccttatttatctttgttttccctttatctgagtacagggctttgaaatttttatattttcaattaaaggactaacaaaatggctttcccttcatctgcaataataagattcatgcttacctttatcctactgtttcagtagaagaggaattcttctgtggcttaactcttgatgctattaaaccctcagcaatctttactttttactctagtcagtaaacataaataagaataagaattctgttactgtagcttgtatctcaagttctttggctctcacataagtagaaattaacaccaggccaaagagacatttttctcagggaaggtttaataggcttgtggctcaatcaaagcaagggagcagtttacggcaaagggatctccgtgctagctccctgaggctcagctcctgtcattttagaagctgaggcagaaaatgaaatgatgtacaagcatgtttaggcgaaattttctttgtgtttgcgcaatggggcatcatgctctgacatacattgcatgatcagaaaatggtggataagccctgccttgggtggagattttagtattaaaatgatactataatgaggaaaaaatcagtgaaaggtcagtgttggagtctgtcttgtcttcagcagactggatctggtccagttcttatcgggaatgccagagcctcactaaccttgaaagatggtcaggttcttatcaggaatgctagagtcccacttttagtaaccttgggagacattacttcaaggagataaacaattagtttcttcttttgatagttaagaattcagcctagtcagctaagttaggagaggccctccttctgctatgtgacttgggtcagcttattaagggagacaggaaggtaggggagagaatatgccttgatatgtgaggcccatggggtcttgattactatgtctgtggtctaccagggctcaatcccttccctatactgtctcatttctatcatcttataaaaacttaaaccattaaactgcttaagctgctatactattctgttcttttcttaagtattagtctgttttttcaggtcttatctcctcacctattacaatttagctattggcctaactgctttcttgtcttgggtcacactgaactccttattaacaaatttaagggcttcttttttatttgcatatcaaaaataatttaggacctccatttacatcgtattgtgtttctttctgatcatctatgaaaaaatatataaacacaaacatgtgcacacatgcacacacacaaatatgcctgtacatagatagatataaaaaatttgggcttgtgatagattgttttattcaaaatgtatgctgcccttttctattagggtccctcccaaaggaagaattatgtatttccacctcgctgacttcagatttggccaaaggttttgttttgcccaatggaatgtgagcaaaagtggcttttctgagaggatgctttaagagacaccacatcgtcttcccagcctctcttttcttttggccttgagactgacgtagaagttgcttcttcagcctagattcctggagataacaaggagtagggtagaaaccagtctataattgacatgtaatgtggttgagaaataaacttctcttgtaatccactaagatctggggttgttactacagtgtaatttagtctaagctcattgatataaggatttattgtatacctaaatttatattgtttaataaaaacacattatgtttatattttataaaatattaatacagaaaaatacaaaaagggtaaaaatagcctacaaacccatatctcagagtttactgtttttccatctgctttccaactttctatatactgagattggactaacagttatagagataatacctttaggtgttcttcttctatttaaaaaatgtccacttttattgcattgtctatactattgttacttttttgaaatttctttagcattttctttatgctgtaaaatatagtcagtatttatgaatgtacatgaggacataaaatgaaggtataattataatctatagactgattatctagctaatgatgaatgctaattatacatacatatatacataattatgttaaattacactctttttttttttttgagacagagtctcacgtctcactctgtctcccaggctggagtgcagtggtgcaatctcagctcactgcaagctccacctcccgggttcacgccattctcctgcctcagcctccctagtagctgggactacaggtgtctgccaccacgcctggataattttttgtatttttagtagagatggggtttcactgtgttagccaggatggtctcaatctcctgaccttgtgatccgcccgcctcagccccccaaagtgctgggattacaggcgtgagccaccacgcccggcctaaattacacttttatacacattttaagaatgtaagtaatacatacaaatgtaaaggaaaatgttgatggaattctagagcttacatcccagaataacttttatctattttgggcgtgtatcacttcatatggctcctttatgaaaaaacaaaaacataaacaaaaagaaccatagtcagatacacttacacatatcaagaaagataaagaaagaatacctttgaaaaaaatgccatattagctactttaaactaaaatatacatattatatttgaatttatcggaaaaaataatttgaaattggaattgcagaattattattaaacttaagatagatatttctttacaaaatatttaatagttcttgaaagggctgagattctagggtgaagaaaacagactgaaaaacattttgaagagggaggaaagttgtaggtgccagtgtagtttcttttaattaagctttttattttgagataattgtagattcacatgcagttgtaagaaataatgtagagagatcccatgtatcctttattaagtttccccccatggtcacatcttacaaattgtaggacaatatcacaaccaggattttgacattgacacaattaagatacagaacagttccatctccataaagattcctcatattgcccttttatagccacatccacctccctcccccacccctggcaatcactaacatgttctccatttctataattttgccatttcgagaatgttatctagatggattcatacactatgtaacctttgttacagctttgtttcttggagatttatccaagttgttagtccaacctgagtatatagaaagttggaaagcagatagaaaaatgtaaatacttttttttagtttttattgccaagtagtattctgtggtatggaggtaccacagtttaagagtttgcccagtcaagggtacctagttgtttctagttttgagctattataaataaagctgttatgaacatctgtgtacaggttttggtgtgaacctgttttcatttttctgaaacaactacctaagaatacaattgctaaattgtatggcagttgcatattagtttcataagcaactgccaaactattttccaaagtggtggtaccattttacattaccataagcactgtataaatgatccagtttctctgcatccttaccagcagcaacttgctattttttattttagttattcctgtaggtttgtagtcataattcattgtggttctaatttgcgtttttctgctgttgaacagtgtattagtctattctcatgctgccaataaagacatacctgagactgggtaatttataaagaaaagaggtttaattgactcacagttccacagggctggggaggcctcaggaaacttacaattatggtggaaggggaagcaaacatgtccttcacatggcagcaggaaggataatgaatgccaagcaaagggggaaaagccccttataaaaccattagatcttgtgagaactcactgtcacgagaacagcagcatgggggtaaccaacctcatgattcaattacttcccactgggtactctcccacaacatgtggggataatgggaactacaattcaagatgagatttgtatctgtgtttttatttttaactaattttctaattagacttgtttttacctgttgaattttaagaattctttatataatgtaattattagtcctctgtcagaggacttattccatttgtgttgctataacagaatacttgagactgggtaatttataaagaacagaaatgtatttttctcacagttctggaaaatgggaagttcaagatcaaggtgccagcatctggtgagggccttttgtggcatcctccagagagagaaatgacctgtcttcatatggtggaagataaaaaggcaaagaataacaagagggccaaacatgtctttttatgatgggattcctgccacccataagggcagagccctcatggccctatcaccttccaaatgtcctacttcctaacaatgccacaatgacaaccaaatttcaacatgagttttggagggtacaaacattcaaaccatagcatcagatatgtggtttgccagtgtatgctcccagtctatagcttgtctttttattctaacagtttttttgcagaacaagtttttaatcttgataaattttaatttctcagtttttccttttatggattgtgcttttgatcccaagtctaagaactctttccctagccctagatcccaaagactttggcctgtgtctttttgtaaaagctttagaattttattttttatacttacatctgtgatccattttgagttaattgttatataaagcgtgaagttcagttttttgcctatggatctcagattgctctgtcaccagctgttgaaaagactgctttatctccattgaattactttcaaacttttgtcaaaaactagttaggcatgttcttatggatctatttctatggtctttattctgttccattgatctatgtgtctcttcaccaatatcactgccatgcttactttatactaagccttaatatcaagtaaaatgattctcctactttatttttctctgtcaagattgttttagatgttttagtacctgttactttccatatattttagaataaatttatttttacaaaaaccttgctgggattttgatagaaaatttattaaacctatagatcacagtttgaggaaaattgacatctttactttgttgagttttcaaatctatagcatggtatttttctccatttattagatatttgatttctttcataagaatttcataattttcattatatagcctctaaacctgttttgttaaatgtatatctatttcatttcctttcatgcaattgaaaaaaatagacatttgttcttatttttattaatttttaattgacaaatagtaattgtgtacatttatgaggtgcaatctgacatgttgatatacgtacgtgtacgttatagaagattcaatcaaactaattaacatgtctatgaccttgccaacttatcatttttttgacgtgagaacattaaaaatcttttagcaattttaaaatatgcaatatcttattattagtggtggtcatcatgcagtgcaatagattgtgtttttaattttgtttcctatatgcttatcattagtgtacagaaacatgattgatttttgtgtttattttgtatcctgtgcccatgctaaacttatttattagctctacaatgcttatttttattctttgtgattttctgtgcagacatttgtcatcttcaggatgattggaaaggatgaagcactaatattaataaatacaataataattaattatattttattttatcctttccagtcagtatgctttttatttatttatttatttatttatttatttattttttatttatttatttttgagacggagtcttgctctgtcaccaggctggagtgcagtggcgtgatctcggctcactgcaacctccaccatctgggttcaagagattctcctgcctcagcttcccgagcagctgggactacaggcacacgccgccatgcccagctaatttttgtctttgtactagagacggagtttcaccatgttgtccaggatggcctcaatctcttgacctcgcgatccgcctgcctcggcctcccaaagtgctggcattacaggcatgagccaccgcgcctggcctttatttctttttcttgacttattacagtgaatgactagaacttccagtaccatgtggtagactgataagtggcgagagcatacatgcttgcagtattgataaatgtagggagaaaagcattcaattttttaaccaataagtatgatgttagctatagattttttctagatttaaaaaatcaagttgatgtaatctccctgtagtaatttaattagagtttttaaaaatcgtgaattggtactggattttatcagatgctttttctgcattgattgatattatcatattatttttctttttatcttgttgatatggtggattaccttggttgattttttgaatgctattccctagaataaatcccatttggtgtatgacatatacatatggagagtgagaaacagggagagagagagagagggcacttgctagatttaatctgctaattttttgttgaggatttaaaatataagttcatgagaaatattggtctgtagttttcttctctatactatcttgtctggttatgatatcatgagtctggaagtgttttccttgcttctgttttcgggaagagattgtataaaattggtgttaatttttctttctgtttggtagactggtagccttctccagtgaaactatccaggcttgtagatttctgaaaaggacttttaaacaataaattcaatttctgtaatggttaattaggctgtttcagggtcaccattaacccactcttatctcctcaaaacaacaagaattctgcacctatccagtcaaaatctcactttgggagcctcaggactcaagagggagtctctgaaaccctcatggaaccaaagaccttggagggtcattttgagagtgcagactgacagcacttggagggtcattttgagagtgcagactgacagtaggttacaggtggctgacctactgagtttgctcccaggttcaagcccaggaatggcccagtcctctaagtggcttggctatagccctctttgtccctgagcttgcaatcaaaaccatctgccaaagagtccgggggaatcacactattagtgccttgatagaaaggcttgtctgcttgctgatattggttttggcagtgaacataatagttgttttgtggcacttccctagcccactttatctgaggtcccagctgagagctgctaacacaaggacccagagggagactcacccatacctcgcagctgaggagtctaagccatcctgaataggatcaccaacctctttccttgtgctgtctctgagatctatcttgtctgggagatgtgtacctgtttgggctaacaagatgggctctccagcctgtgtcccccagcagatcttggatgggtggtggggggacagtcacaggtctagtccttcctgctgcaatcagggaactatcctgtctgtgcagggccctgctgagagatgtacactcctctaatccaatgggataggcattccaacctctatctcacaataatcctgagggagctaattctcagctccagtccatcctgctacacttaggaaactattgtctgtgcagggttctcctaggagacatgtgttctctcagccaccaagattaggctcttcagcctccaacccacagcagatcctgaggggaactatggtcaactccagcccctcaagctgcacttgacatcctatcttgcccatgcagagacctgctgggaggcatgtccatctcagccactcggacaatcttctgaactcaggtccctggtcagcattcccatacagctctagtaccctccttggatctttcccaggcttatctgggctggaatggcatgtcaaccttggagtccttgcaagactcatggcaagtgtggacttagagcatcctctagtgctgagatggctgcagtggtcacaggctcaggaaacacaacaaccagacttcttagaatcactagaatcactgagaaccacaaacaaaggcagactgtgcctacaattaaatacttaatctctcagtgtgcagacattgtcacacatccacaagcatcaagaacattaagggaaatataacctcaccaaacagacaaaataaggtgccagagactgaccctaaattgatggaaatgtgtgatctctcaaagaattagaaatggccaggttttgttgttgttgttgttgtttgtttgtttttgtagaaacagggtttctctctcttgcccaggatgaagtgcaatggtacaatcatagctcactggaatctccaactcctgggttcaagagatcctgtggtctcagcctactaagtagctgggactacaagtgaccaccaccccacccagctaatttttaaattttttgcaggggtcttgctatgttgcctaaactggtcttgaactccttaagtaaacattaagtttacttagatgtaagacctgaaactatgaaattactgaaagaaaacactgggtaaatgctacagggcattggtccggtcaaagattatttgagtgagacctcaaaaagcataggcaatgaaagcaaaaatggataaaacaggattatatcaagctacaaagtctctgcacagcaaaggaaacagcaaagtgagaaaaatcaacccttggaatgggagaacatgtttggaaactatccatccaacaagagatgaataaccagaatatataagaaactcaaacaattcaatagcaaaaaaccccaaattatctgattaaaaattggacaaaacatttctcaaaagaagacatacagatggaaacaggtatatgaaaacatgctcaacatcactaatcatcagggaaacacaaatcaacaccaccacaatgagatataacctcacacctattaggatggctgttgctaaaagtcaaaagatagcaagtgttgatgaggatgtggaacaaagggaacccttgtttactgttgctgggagtgtaaattggtacagccattatggaaaacagtctagaggttcctcaaaaaactaaaaatagagctaccttatgacccagcaatcccattactgagtatatatccaaaagaaaggaaatcagcatattgaagagagatctaaattcccatgtttactgtagcactattcacaattgccaaaatatggaatcaactaagtgttcattaacaagtgattggataaagaaaatgtggtatacattccatatgcaatggaatattaatcagccataaaaaagaaggaaactttgtcatttgcaactacatggatggagctggaggatattgtgttatgtgaaataagctaggcacagaaaaacagctgttaaatattctcactcatatgtgggagcttaaaaaattatctcatggaggtagtaaatacagcggtggttactggaggctgggaagggtagtggggagggagggatgaagagggattgattaatgggtacaaatatacaattagataaaagatataagttccagtgtttggtagcacaatagggctagtgtaggtttcaaaatattgaatacttcaaaatagctataggagaagaattggaatattcccaacacaaagaaatgataaatgtttgagatgatagatatcctaattactctgattttgattattatgtatcatatacagatatcaaaatatcacatgtactcccaaaatatgtacaactattatatatcaataaaaattatttagtaatttatctttttattattcagttttaaaagttctttatttcaggccgggtgcggtggcccatgcctgtaatcccagcactttgggaggctgaggcgggcggatcacaaggtcaggagattgagtccatcctggctaacacggtgaaaccctgtctctactaaaaaaaaaaaaaaaaaaaaaaaattagccgggcatggtggtgggtgcccgtagtcccagctactcgggaggctgaggcaggagaatggcatgaacctgggaggtggagcttgcagtgagccgagattgtgccactgcactccagcctgggcaacagagtgagactccgtctcaaaaaaaaaaaaaaaagagttctttatttcagatacatgttctttatatgatgtactatttgcagatattttctctcattctgtgggttgttttttcagtttcttgttggtatcatttgcaacacaaaagttttcattttgatgaaattcagtgtatctagatgccctttatcaaactgagaaagttctcttctattcctaattagtttaaaggttgttttgttctcttttgttttaccataaaagggtgttagatttgtgaaatgctttttccatgtctgttgaggtgatcatgtgggtttctccgtttattccattaatattatgtattacagtaattgattttcagatgtgaaaccaactttacattcttggcagaaattctacttggtcttggtatataatccccattttattttgctggatttggtttgctagcattttgagttgagaattttttgcatctacatttatgagagctattgagctatagttttctgtcttttaatttttaatttttgtgggtacattgtaggtgtgtatatttatggggtgtatgggatattttgatagaagcatacattgtgtaataattttatcagagtgaatgaggtatccatcacctcaagcatttatcctttgtattacaaacaatccaattatacttttagttattttaaaatgtccacttaaattattggccataatcaccctattgtgctatcaaatgctatatcttattcattctttctattttttatatccattaaccattctcctttccccacacaccccctcccctcctccctactacccttcccagcctctgataatcatccttctattctctatctccatgagttcaatggctataatttttagtacccacagacaagtgagaacatggaaagtttgtctttctgtgcctggcttatttcacttaacataatgacctccagttccacccatgctgctgcaaatcacaggatcttattcttttttatggctgaatagtagttcagggtgtgtatgcaccacattttctttacccagtcatcaggtgatggacatttgggttgcttccaaatcttggctattgtgaacagtgttacagtaaacatgggagtgcagatatttcttaggtaaatggatttcttttcttttgggtatatacctagcagtgggatggctggatcatacagtctatagcagctgattatttttagtttgcttgttttttttttttttttttttttgagatggagtcttgctctgttgcccatgctggagtgcagtggtgtgatctcggctcactgcaacctccacctcctgggttcaagtgattctcctgcctcagcctcccgagtagctgggatcacaggcatgcaccatcacccctggctaatttttgtatttttagtagagatggggttttgccatgttggccaggcttgtctcgaactcctgacctcaggtgatccactcgccttggcctccctaagtgctgggattacgggcgtgagccaccacgcccagcctatttttagttttttgaggaacctccacagtggttgtactaatttacattcccaccagcagtgtatgagggttcccttttctccacgtcctcgtcagcatttgttattgcctgacttttggataaaagccattttaactggggtaagatgatatctcattgtagttttgatttgcatttctctgatgatcagtaatgttgagtacgttttcatatacctgtttgccattggtatatcttcttttgagaaatgtattatctttttgatatgctgttagactcggttagctagtattttgttgaggatttgtgcatctatgttcatcagggatatttgtctgtaattttcttttttcgttttgtcctctcctggttttggtattagggtgatactggcttcatagaatgatttaggggggattttctcttactctatcttttggaatagtttcagtaggattggtgccaattctttgaatgtctgacagaattcaactgtgaatccatctggtcctgaacttcttttattggcagtttttaaaaattaccatttcagtcttgctgcttgttattggtctgttcagagtttctcttgcttcctggtttaatctaggagggttgtatatttccaggaatttatccatctcttctaggttttctagtttgtgcatgttaaggtgttcatagtagccttgatcttttttatttctctggtatcagttgtaatatctcctgtttcatttctgattgagcttatttgaatcttctcttttcttggttaatctcacaaatggtctatcaattttgtttatgttttcaaagaactagctttttgtttcatttatcttttgtattttttgtttcaatttcatttagttatgctctgatctttgtaatttcttttcttctgctgaatttgggtttggtttgttcttgttcctctagctccttgagatgtgaccttagattgtctatttgtgctctttcagactttttgatgtaggcatttaatgctatgaactttcctcttagcactgcttttgctgtatctcagaggcattgataggctgtgtcactattatcgtttagttgaaagaatttaagaatttccatcttgatttcactgttgacccagagaccattcaggagaagattatttaattttcacgtatttgcctgattttgagagttccttttggagttgatttccaattttattccactgtggtctgagagagtacttgatataatttcgatgttcttaattcattgagacctgttttgtggcctttcatatggtctgtcttggagaatgttacatgtggtgatgaatagaatgtatattctgcagttgttaggtagaatgttctgtaaatacctgttaagtgcatctgttccagggtatagattaagtccattttttctttgttgattttctgtcttgatgacctgtctagtgctgccagtgaagtattgaagtcccccactattatttgtgttgccatctatctttttttttttttttttttgagatggagtcttacctttttgcccaggctggagtgcagtgacacaatttcggctcactaaaaccttcgcctcccaggttcaagtgattctcctgcatcagccgcctgagtagagtagctgagattacaggcagccggcacaacacccagctaatttttgtatttttttagtagagacagggtttcgctgtgttggccaggctggtctcgaactcctgacctcaggtgatccagcccgcctcagcctcccaaagtgctgggattataggtgtgagccactgcacccaacatgtctatctcatttttaaggtctggtagtcattgttttatacatttgggagaaccagtgttaggtgcatatatttttaggtctgtgatattttcctgttaaacaagtccttttatcattatgtaatgtctctttttgtctttttaaactgttgttgctttaaagtctgttttgtctgatgtaagaataactattcttgcctgcttttggtgtccatttgcatggaatatctttttccacccctttaccttaagtttatgtgagtctgtatgtgttatgttaggtgagtcccttaaagacagcacatacttgggttggtgaattcttatatattctgccattctgtatcttttaagtggagcatttaggccatttacattcaacattagtattgagatgtgaggtactcttccattcattgtgctatttgttgcctgaataccttgattttttttcattgtgttattgttttataggctttgtaagatttatgctttaaggaaattctattttggtgtatttttaggttttgtttcaagatgtagagctccttttagcagttattgtagtgctaacttggtagtggcgaattctctcagcatttgtttgtctgaaaaagactttatcttttcttcatttttgaagcttagttacactggatacaaaattcttggctgataattattttgtttaaggagcctaaagataagaccccagtccctactagcttgtaaggtttctgctgagaagtctgctgttaatccaataggttttcctttataggttagcttgatgcttttgcctcacagctcttaagattctttccttcatcttgactttagacaatttgatgactatgtgcctagattacgatcttttgcgatgaatttcctgggtattctttgagcctcttgtatttggatgtctagatctctagcaaggtcagggaagttttccttgattactccctcaaataaattttccaaagtcttagatttctcttcttcctgaggaacacaaattttcttaggttggtttgtttaacataatcccaagcttcttggaggctttgttcatttttttaaaagtattttttcttttttattatactttaaattctgggatacgtgtgcagaacatgcaagtttgttacataggtatacatgtgccatggtggtttgctgcactcaccaatctatcatctacattaggtatttcttctaatgctgtccctccccttgcccccaacccctgacagaccccaatgtgtgatgttcccatccctgtgcctgtatgttctcattgtccagcttccacttacaagtgagaacatgtggtgtttggttttctgtttctgtgttagtttgctgagaatgatggtttccagcttcatccatgtccctgtaaaggacatgaactaattcttttttatggctgcatagtatttcatggtgtatatgtgccacattttctttatccagtctatcattgatgggcatttgggttggttccaagtctttgctattgtgaataatgctgcagcaaacatatgtgtgcatgtgtctttatagtagaatgatttataatcctttgggtatatacccagtaatgggattgctgggtcaaatggtatttctggttctagatccttgaggaatcaccacactgtcttccacaatggttgaactaatttacactcccaccaactgtgtaaaagcattcctatttctccacatcctctccagcatctgttgtttcctgactttttaatgattgccattctaactcgtgtgagatgatatcttcttgtggttttgatttgcatttctctaatgatcagtgatgatgagcttttttttcatgtttgttggctgcaaaaatgtcttcttttgagaagtgtctcttcatatcctttgcccactttttgatggggttgtttgttattttcttgtaaatttgtttaagttccttgtagattctggatactagtcttttgtcagatggatagattgcaaaaattttctcccattctgtaggttgcctgttcactctgatgatagtttctttggctgtgcagaagctctttcatttaattagatcccatttgtctattttggcttttgttgcaattgtttttggtgttttagttatgaagtctttgcccatgcctatgtcctgaatggtattgcctaggttttttttctagggtttttaatgggtttaggtcttaagtttaagtctttaatccatcttgagttaatttttgtataagatgtaaggaaggggtccagtttcagttttctgcatatggctagccagttttcccaataccatttattaaatagggaatcctttccccatttcttgtttttgtcatgtttgtcaaagatcagatggttgtagatgtgtggtgttatttctgagggctctgttctgttccatcctgttttggtaccagtaccatgctgttttggttactgagccttgtagtatagtttgaagtcacgtagcatgatgcctccagctttgttcttttggcttaggattgtcttggatatatgggctcttttttgttccatatgaaatttaaagtagttttttctaattctatgaagaaagtcaatggtagcttgatggggatagcattgaatctgtaaattactttgggcagcatggccattttcatggtattgattcttcctatccatgagcatggaatgtttttccatttgtttgtgtcctctcttatttccttgagcagtggtttgtcgttctccttgaagaggtccttcacatcccttgtaagttgtattcgtaggtattttattctctttgtagcaattgtgaatgggagttcactcatgatttggctgtttgtctgttattggtgtataagaatgcttgtgatttttgtacattgattttgtatcctgagtttgctgaagttgcttatcagcttaaggagtttttgggctgagatgatagggttttctaaatatacaatcatgtcttctgcaaacagagacaatttgacttgctctcttcctatttgaatgccctttatttgtttctcttacctgatttccctggccagaacttcccatactatgttgaataggagtggtgagagagggcatccttgtcttgtgctggttttcaaagggaatacttccaggtttggcctattcagtatgatattggctatgagtttgtcataattagctcttattattttgagatatgttccatcaatacctagtttattgagtgtttttagcatgaaggggtgttgaattttatcgaaggccttttctgcatctattgagataatcatgtggcttttacatggttctgtttatgtgatggattatgtttattgatttgcatatgttgaaccagcgttgcatcccaggaattgatcgcggtggataagctttttgatgtgctgctggattaggtttgccagtattttattgaggattatcacatcgatgttcatcagggatattggcctgaaattttccttttttgttgtgtctctgccaggttttggtataaggatgatgctggcctcataaactgagttaggcaggagtccctctttttctttttggaatagtttcagaaggaatggtaccggctcctctttgtacctctggtagaatttggctgtgaacccatctggtcctgggctttttttggttggtaggctattaattactgcctcaatttcagagcttgttattggtctattcagggatttgacttctccctggtttggtcttgggagggtgtatgtgtccaggaatttattcatttcttctagattttctagtttatttgtgtagaggtgtttatagtattctctgatggtagtttctgtttctgtgggatcagtggtgatatcccctttatcattttttattgtgtctatttgatttttctctcttttcctctttattagtctggctagcagtctatctattttgttaatcttttcaaaaaaccagctcctagattcgttgatttttttgaagggtttttcatgtctcgatgtccttcagttctgctctgatcttaattatttcttgtcttctgccagcttttgaatctgtttgttttttcttctctagttcttttaattgtgatgttagggtattggttttggatctttcccactttctgatgtgggcatttagtgctacaaatttccctataaacactgctttagctgtgtcccagagattctggtacgttgtgtgtttgttctcaatggttttaaagaacttatttagttccaccttaattttgttacttacccagtagtcattcaggagcaggttgtttagttttcatgtagttgtgtggttttgagtgaattcctgttttcttttttctttctttcttttttttttttttagatggagtctcgctctgccactgaggctggagtgcagtggcgccatcttgactcactgcaacctctgcctcctgggttcaagcgattctcctgtctcagcctcccaagtagccgggactacaggcatgtgccagcatacctggctaatttttgtactttttgtagagacagggtttcaccatgttggctaggctgttgttgaacttctgacctcaggtgattggccttcctcggcctcccaaagtgctgggattacaggcgtgagccactgcactcggccttgagtgagtttcttaatcctgagttctaatttccttgcactgtggtctgagagactgtttgtaatgatttccgttcttttgcatttgctgagggtgttttatttccaattatgtgttcaattttagaataagtgctatgcggtgctgagaagaatgtatattctgttgctttggggtggagagttctgtagatgtctattaggtctgtttggtccggagctgagttcaagtcgtgaatatccttgttaattttctgtctcattcttctatctaatattgacagtggagtgttaaagtttcctactattactgtgtgggagtctaagtctctttgtaggtctcttaaaacttgctttatgaatctgggtgctcttatattgggtgcatgtatttaggatagttagctcttcttgttgcattgatccctttaccattatgtaatgcccttctttgtcttttttgatctttgttggtttaaagtctgttttatcagagactaggattgcaatctctgctttttgtttgtttgtttgctttccatttgcttggtaaatattcctccatccctttattttgagtctatgtgtgtctttgcacgtgagatgggtctcctgaatacagcacaccgatgggtcttgactcttcatccactgtgccagtctgtgtcttttaattggggcatttagcttgtttacatttaaggttaatattgttgtgtgtgaatttggtcctgtcattatgatgctagctggttattttgcccattagttgatgcagtttcttcatagtgttgatggtctttacattttggtatgtttttgcagtggctggtaccagtttttcctttccatatttagtgcttccttcaggagctcttgtaaggcaggcctggtggtgacaaaatcccttagcattgcttgtctgtaaaggattttattttccttcactttaaggttagtttggctggatatgaaattctgggttgaaaattcttttctttaagaatgttgaatattggcccctactctcttctggcttgtagggtttctgcagagagagccactgttaatctgatgggcttccctttgtgggtaacccgacctttctctctggctgcccttaagattttttccttcatttcaaccttggtgaatctgacaattatgtgtcttggggttgttcttctctaggagtatctttgtggtgttctctgtatttcctgaatttgaatgttggcctgtcttgctagattggggaatttctcctggataatatcctgaagtgtgttttccaacttggttccattctccctgtcactttcaggtacaccaatcaaatgttggtttggtcttttcacatagtcccatatttcttggaggctttgttcattcctttcattctgttttctctaatcttgtcttcacactttatttcattaagttgatcttcagtctctgatatcgtttcttcctcttggttgattcagctattgatacttgtgtatgtttcacgaagttctcatgctgtgtttttcagctccatcaggtcttttctgttctctaaactggttattctagttagcacttcctgtaaccttttatcaaggttcttagcttctttgcattgggttagaacatgcttttttagcttggaggaggttgttattacctaccttctgaagcctacttctgtcaattcatcaaactcagtctccatccagttttgtttccttgctggcaaggagttgtgatcctttggaggagaagaggcattctggtttttggaattttcagcctttttgcactggtttttcctcatcttcatggatttatctacttttggtctttgatgttggagaccttcagttggggtttttgcgtgggcatccttttagttgatgttgatgatactgctttctgtttgttagttttacttctaatagtcagggtcctcttctgtaggtctgctggagtttgctgggggtgtactccagaccctgttttcctgggtatcaccagcggaggctgcagaacagcaaatattgctgcctgctccttcctctggaagcttcatcccagaggggcactcgccagataccagctggagtcttcctatatgaggtgtatgttggcccctgctgggaggtgtctcccaaacaggaggcacgtgggtcagggacccacttgaggaggcagtctgtcccttagcagaactcgagcactgtgctgggagatcctctgctctcttcagagctggcaggcaggaacatttaagtctgctgaagctgcacccacaggtgccccttcccccaggtgctttgttccagggcatttctctcagagatgccctgcccagagaggaggaaactagagaggtggtctggctacagtggctttgccatgctgtggtgggctctgcttagttcgaacttccctgtggctttgtttacactgtgaagggaaaaccgcctactgaagcctcagtaatggtggactcccctccacctcccccaacaagctcaagcatcccaggttgactttagactgctgttttggcagtgagaatttgaagccagtggatcttagcttgttgggctccatggggatgggatctactgagcaagactactcggctcccaggcttcagccccttttccaggggagcgaacagttctgtctcattggagtttcatgtgcaactggggtacaaaaacaaacaccttcagctagctaggtgtcttcccaaacacccacccagttttgtgcttgaaacccagggccctggttgtgtaggcacccaatggaatctcctggtctgtgggttgcagaaaccataagaaaaacatagtatctgggccaggtagcaccatccctcatggcacagttcctcatggcttcccttggctagtagatggagttccccggtcccttgcacttcccaggtgaggcaacacccacccctgcttctgctcgccctctgtgggctgcacccactgtctaaccagtcccaatgagatgaactgggtatctcagttggaaatgcagaaatcacccaccttctgcattggtctcactgggagctgcagaccagatctgttctatttgaccatcttgccagccccctgtccccatattttctttgtctttgttggattggattaatttgaaagccttgtctttgagctctaaagtcttttcctttacttgttcggttctattgttgaaattttccagtgtattttgcatttctgtaagcatgtctttcatttccagaagctgtgatttttttttatgatatctgtttcttcagagattttttttcaatcatatcctgtattattttttaagtttctttaagtttgttttcacctttctctggtgcctccttgagtagcttaataatcgaccttctgaattctttttctggcaattcagagatttctccttggttttgatccattgctggtgagctagtgtgatcttttgatggtgttatagaaccttgttttgtcatattaccagaattgttttttttttttctagtttggatagactatgtcagaggaaagatctgggactcaagggctgctgttcagattcttttgtcccatggggtgatcccttgatgtggtgctctccctcttcccctagggatggggcttcctgagagcatgactgcagtgattgttattgctcttctgggtctagctacccagtggagctatcaggctttaggctggtagtggggagtgtctgtgaagagtactatgatgtgattcatcttcaggtctctcagccgtggctaccagcaccttctccagtggaggtggcagggcagtgaagcagactctatgagagtccttggttgtagttttgtttagtatgctggttttctcaaatgctggttatgctggcagtgaagttgtgatgtgaacaagttcaggacctctggttagccagggtgttacagccggtggaattagatgttgttttccccttccttggagtagggttggtctgttatgagttgctgtaatgccttgagttggttggcttccagccacatggtgttgtctttaagagagcaacatcgatggtagtgtggagggatacaaacttggcctaacatcacctggataagtattcaggtttctcaggtaatgggcagagccatagagctcccatgaatttatgtcttttgtcttcagttactacgtcaggtagagaaaaaccatcaggtgggggcagggttaggcgtttctgagctcagactttccttgggcagggcttgctgctgccactgtgaggggtggggtagtggttctcaggccaatggagttatgttccaagggggattatggctccctctgatgctttgtacagttcgccagggaagtagggggaaagttggcattgacaggcctcacccagctcccacacagccagcaaggccagtttcactccctctgtactcccacaacagccaacagagccaaatttatatccagacctccagtgtgtagggctgagatcttgctccagcagctttcagtacttcgccattcagtatgatactagctgtgagtctgtcatatacggcttttattatgttgagatacattccttctatacccagttttattgagggtttttatcatgaagggatgttaaattttatcaaaagctttttcagcatcaattgaaatgatcatatggtttgatatgatatatcacactgatttatttgtgtatgttgaatcattcttgcatccatgggataaatcacacagccatgatgaatgatgtttcaatgtgttgttgaatttggtttgctcgtattttttgaggatttttgcatcaatgttcatccgggatatgggcctttagttttctttttttgatgtgtctttgtgtctggttttggtttaagggtactactggcctcatagaatgagtttggaagtaaccccctctcctctatttttcagaatagtttgagcaggggtggtattaattcttctttaaatgtttggtaaaattttgcagtaaagccattgggtcctaggtttttctttgctgggagactttttattatagcttcaatcttgctagatgttattgatttattcaagttttggatttcttcatggttcaatctttgtagattgtatgtggctaggaatttatttatttttaggttttaaaatttattggcatatatttacctcatagtaacctctagcgatcctttgaatttctgtggtattgattgtaatgtctccttttccttctctcattttatttatttgaggcctctctctttttttccttagtctgcctggctaacggtttgtcattctgtttatcttttcaaaaaagtaaactttttgtttcgttgatcttttgtatcattttcttcaatttcatttatttctgctctgatctttattgtttcttctactaactttgggtttggtttgctcatgcttttctagttctttaagatgcatcattaggttatttgaagtttttcttcctttttgatgtaggtgtttatagctatatacatccctcttagtactgcatttgctgtatcctttagattttgttgttgtattccaattatttgtttcaataaattttttgattgccattttaatctcctctttgacccactggtcattctggagcatattgtttaaattccatgtgattttatagtttccaaaattccctttgttattgatttctggtttatttcattgttgtcagagaagatacttgatgtgatttccatttttgaatgtttaagacttgttttgtggctagcatatggtctgtccttaagactgattcatgtgcttaggagaagaatgtttattttgcaactgttggatgaaatatttataaatatctattagatccatttggtctatagtgcagattaagtccagtgtttcgtagttttcttgttatgtatttccctcaggcttcagatctttttaccagctcagtgtagagccctggggcctgtgtgtctatctgataggataagccgtggttatttatttttgccattttacgtctcttcaagctcttgttatgtcacttgcacagctttgtgagtgaaaagatataaatatgatttgggatattctgcttacagggtgatgaaaggagcccagagaaaaagataaaatttacctggtgctcttagtgagtctctttttgtgctttgtattcttttagaggaatcttctgtttaagaagtttatcttttgactttatgtctagtatgttctgtttattggcaaggataactaattctttatggttgtggttgtgcttcctttctccaatcgagagagaccaaaatataaacttaagtggttttttcctgctgatcactcattatgcattttctaggcatctttttcctggattgcctatttatgtcctcaaatctcttcttacaaaattcaggtatattagtgacctttactttcattattatatgttttcattttctttcaccaatactatacaagtagtaatagggtgaggagccacagtgagtagggtgaaatgagcacatttgtatattgtggctctcttactgagcctcactagtattaccgattatagcatgagattgtatgtttttgttgttgaatgtatttttgccagtttttaactacttttgtttctttcctctcttcctgtcttgcttttttgttgttgttgttagtttaggagaaggaagattttgtaagctggctttaccatctttaccaagaagtttgatttactgtattatttcaattatgtgtacttcaaatttcttatatattttttctgtttgatcagtcatgagctaaaaggagttaagggttctattactattatctttctcttccttttgaattctctactaattttgcattgcatattttgatgaatactatttgttgtataaaagtttatactaattcattgttttttttggaaatagtatactttatttttgtatttttgccccaaagtcagctttatctggtattcatattgtgaccctcactttcttcttgtatttgtctcctgtgtttttgtctactttttattaaccttgattgaatctgtaatccaagagtctttttttgactaataggctagttttcctgattgtatttgttgatatgatatgtatcagttttgatttattcttgtgtttctgtaataaactctatttggttatgatgtatttttaaaatgtgatgttagataatgctggccaatattttatttagcacttttatgttgatatgcataagttgaatggtttgtactttaactttgttattgtgataaaaacatataacattaagtgcaccatcttaacactttttaaatgtacagttcagcagtgttaagtatattcatcctgttgtgcaacagatctctagtagttttccatcttgtaaaactaaaagtctatacccattcaacacgaattcccttttcctcttcctcccagtccttggcaaccacctttgcacatcctgtttctgattttgaatactttatatgagtggaatcatacagtatttgtgcttatgtgactggcttatttcacttagcataatgtcctcgaggtttatctatgttgtagtatgtaacaggatgccctttttaaaggctgcataatattctattatatgtgtataccatcttttccttattatttttcttttgatggacatttgagttgcttctacctcttgctattgtgaataatgctgtaatgaatgtgagtgtgcaactatctctttaaaatcttgctttgaattcttttggatatatttccagaagtgggattcttagatcatatggcaactgtatcattaattttctgagaacctctatattggctgtagtgactgtaccatttgacattcccacacagcagtgcataaggattctaatttctccacatccacatcagcatttgttatttcctattcatttgatagtggccatcctaatgtgtgtaggcaatatctcatgtggctgtgatttgcatttctcatatgattagcaatggtgactatttttaatatgcctgttggacattgtatatcttctttggtggtttgattattcaagtcttttgcccatttttgaattgggttaataataattttaatccaatttttgtgttgttgagttgtaggagttgtttatgattctggatattaactcttcattgattatatatcttaataatgtttttgtcatcttatttttcactacatattcactacatattttctttcttattctctaaagtaagtgtgtgtgtgtgtgtgtgtgtgtgtcttactttggttgatttggaaggtatatgtagtcttttaaattagtttattgattacctttatattttaaaataatgtatctaatactgtctcctgtttcatattgccctacatatacaattttagtatttattattttacattgtcaagattgataaaaatgtatattctattatttcactatgattcctgtatctctttaacttgagctttatatttacatagattcagctcatcttttatatgcaacttttttccaagttctcagtcaatatgacaatccccactttacctataagcccattggtataggaaactgttactagatgactgtcttaacttctaattaaaatagattggctttttgggattatgataaatcatttttcctatatctttcattaatttgatggggccttaatctctgcctagcaatgtgaaatttgtttactatcttgatatggagagagagattcaaagttggtcctttcaactttaaaatctcttactctgtgactctgtggtcagaacaaacatggggattattccttttattgagtttgttcaaactatattcttagaatctaaaaaaatgagcacaagataggtttatggttccatgggctcaccatgaagtagactctgataaaattctaattattgcttgatgctgatatgcttgcactctgaccagtgaaaaaatagtggcattatagattcccaataattaatgttagttgatgtgcaattacccatgtcttaatattttaatccttggtgcacaagatagtaggaaggatgcagtatgtatttgtgatattatttcagaacttttccactagagtaccaggcttcctttttattcaaaaggctataggctgatacgtttatttagatccaaaatttggttacaaggttgtcattctctactctggtgatcaagtcaactctctgtttgccaggccgtattataggaatatcttacttattcagattaaataggaaccttagtggtctggccatctctttggtttaagggaactgatgattatttagctaccactaaagatacgcattcttgtatgagctgtttcataccttggaaacatatattatattagaagagactttaccaagatctccagacgaggaaaagtcagaattgcagagacagtgcagttgtaggcgatggtttctcccgtctgtcctctagaagccaagatacatattctgagagtcattacgatattgctggtttagaaaatgtgctttgtcctaaaagacagcattccagccccttagagtagactccaattgtcactataactgaagatcaaccattggtaggttataggatacataataagaacagtaaatactattgcatcagtttacagccagcttctttcatagtgaagtgagttctgtgattaggagcaatgctatgggagagataacatggtgtatgcaaggtattcagtgaggatagatactggcatagacatcatgggcgagttttactgcctaaaattctgcacacttggagatttttactttctaagacctctaatactccctggagttgtaaaaattttgtgcttcagatggttgtcatattacaggcaccctacatattcatttatgtaggccaggcttttcttttatcttactgaataaattctatctaatgatattagcatatcactctttccattctgaccacagctctcctttccatttttatcttgactatacacatacccaaagtctaactgaactgcaccttttctcaacatgcatagaaaaatctaattctgcctgtaaaggctcacaatattttagatctttttgcaacttttcacagcttagttacttgtgcgtatctctcattctgtaatttgttccattagctttattttacaaataagaaagctgagattcagagttttaagagacttattcaaaagtccacagatatacactagagactgattagaataaaggaagagataatcaaaaccaaataatacctctgtagaaaggaactaacttttcttttttttctttttattactttataagattgagaggttcgtcatctttctttgttaatacttactaggaaagattttgataatattcatttgtgatcattgtgatgtttatgttacttgtacttgatatttatttttaataggaaaaactcaaaagagaggcaaaagaaaacacagctactcttaaagaaaaaaaagacaaggtaagagcatataattctcatagttttaaaataccaattcattttctaacttctacttagaaatgattttttgtttataagtaggaaaataacattttacatatatcatacaatttcattttctaaattgtttcttgctatttattaattcaaaagcattttagctaaaaatttcaaaattttgtcatttggagatttggagaaggtttcagtctaatgcagaaacaaaaaagaagaaaaaaagaaggtttcagtctttctctacaattcttattatagttttaatttaattaggtacctctgtgtttctctcttaagaattttttaatgttagaggcaaaatattttcataaacaattctaaagtttatttagattatgtctaattttgggttttgagggggcttaataaatgacatcctgttttcctcacttatattctgaaccaattgagaaagacaagggagaataaaaataatatttttattattgaagactttattaaaaagtatcaatattttaaatactggagaatgcagtttatatttgaaggcaataggatctcttaatcttgaaatcccaaattagacaaatttatcttctgccacaagtagagcttgactagcataggtctacccacttgatcatctgctcttgtaaaacttagggtataaaggagaagagcagaatttatgtgtaattctaatagttctcaaggggagtaataaggaagaggctgagctgtatgtgtccagcttctccttttctttaaattcaccaatcacattaagtaattttttctcccctaaggaatcaggaagaggtttggaatgttaccctagtggtactccctacatatggaaggaaacatcagtcatagagaagaagaatacccctcagcttctaacctatttgataatataggatcattgcagaagaattttgatttagcaaatttttggttaaaatgattaagaattttctttacatatagtgatataatctcctaagttcccacagaggttgctctgattatagttaaactggaaggaaatgacactcagagtagtttgagaacagttcattatattttattacacttgagttaaaagagaataaaggaaagatgcactgaacctgtgagtgaatactgagtgctttgtatgttccagacactgtgctagacacttgaaaacattatatctgaagaaattataatcataataaaattatgcagaatggttagatatagacttaaggaagtatctaatgaatataagcaaattggttaatctccaatattcttttttaaatttagaatgtcttcatattatgaaagtatgtatcacatattcttatagagatattttgattcatgtacaattctatatgtttccattatcaagtagattagcaaatgccatatattttatctgagagtctagatatatatgttggaaaatgaaccatatatatgttggaaaatgagaaaaatgatgaatgaagaaatttaactaggctttttttttttttgctgtgctttattccaacactactgaaacataaggcttgttaaatttaccaaacgtttctgagtttggacaagttacttaacttcttcgtgtttcaattttctcatctataaagggataataataatacctatttcctaaagttgttatgaggattaaatgagatggtatttgtaaaacatttaaaatagtgcttgggacatagcacatgccttataaatgtttgtttgaaaaatacaacagagaaaattgtgaattttctggaaagggatagttcagtattgtcacatgagaattttctttaggctaccagcgaaatgtcaaattccagatatggccacaaggtggtgcagtgaccttaaattgtcattctcctacctgtagggaggaacaatttgtccattaaagcagttacattttggcggttccaaagtttacccctgatgaatccagagagcagtaaaaaaattgctctcatcaaaattttgtcatcaactatgatgtataaatatgtagggaaaaggatacagaaatgcaattctgaaaaaattcatacttgctagaaaaaggattatgaaatgacagatcactagaattacgcaggaaagatataagccatctcatttagcctcttgatttatagatgaataaatttaagcttggagatacttgaagatttacttaaataatccggaaagataggaaagatctaggagaaaagaccatatgatgtacctggctcctagttcaatgatttttttatagtacatgtagttgcctctttatcctatactctaatttaaacgcactgaaagttcagccaccatgctttcaaattttgtccttgtattccctttttgtgtgtgtgtgctctagagaattcagagaaaggagagatgttctcagaagaacatggtcctgtaaaggagggctctacaatgaaaggcagtaggagaactgaaagaacacgattctagaaaaaggggaatttgagtttcacagctaactagctgtggaattgagtaaattaacatgcctcaatttccttacaatttccttatgaataattgccacgattgtattcgtggagatggtggtgaccaaagaaactgtaaaatagaaagtgatgagcatgagtttcatgtagaatcccactaaagcaactattactagcttttactagaaagttaggtcaggtgctaaaagaagctgtatacaaaggtagagtgaaagagaactgaggaaactgagttgaaaaaatgtcaagtatttagagtaaacttgcaatttatttatttagaattgaagcaaatagccattttctcagtttttttccctgaaaatttttctcattctttactttcataattattctccttgcttttggaggcaagttaggctggtggataggaaaaggctgatatttttataggtgaaaaagaagaagtatcaatgtatgaaagagaacgaatgaaagttagaatagatttccttctgacttttaggctattgtaatgaaccatagattagggctttttgccaccaggagtaaagatttttttttattttttaaagagaatcctcaacttttggtcagagagttgagatatcttatttgttttcatttttaaaaatttaacttttattttaagttcaggggtacatgtacagatttattatataggtaaacttctgtcatgggggtttgttgtacagattattttgtcacccaggtattaaacctatacccgttagttatttttcctgatcctcttcctcctcccatcctgcatgctcccataggccccagtgtgttttgttgtctccctctatgtgtccatgtgttctcatgatttagctcccacttataaatgagtccatgtggtatttggctttctgttcctgcattagtttgctaagaataacgacctccaggatatcttatttgttttcatagaggctctgtgaagacaggcaggggcagataacatttgcatcttaaatggacaagtaaagtgacaaagaagataactgtaacttattcaaacttatctagtcagtgataaatttagggataaatttgcttattttgttgtgaattctactagttgctgcactttaattaaagaaataaataattaatgtgacatttagtgatggttttattcattcttgttgttcaatgcagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggtttgtgtctaaattttccatgttagtagtaattttttaaataaataaataaagttctgttatcaccatatatctggcatcacgcacacatatataactagtttcttgaaagtttcaattttttttgtggtatcagcatgaaatgtaaagacaaggtcttgctgtgttgcctaggatggtcttgaactcctggccttaactcatcctcctgtcttggcctcccaaagtattgggattataggtgtaagccactgtgcctggccttcaacatgaaattgtttcatttttttcgatcactgtccacaacttaatgtcatcttgggcagatttcataacttaatagttatttatcagtgtttaaggccctgacacaggaaatctgattctgacttgacattttatagcatcaccacagttactacttccctttgctgtttaccccaatcatcttgcatctgtagtccttggcagtcatcttggagcagatgcctctagcaaagtggctcagttctgactgtctttcatatagccacttaatccatggggaattcatacaacttttccatgctaaatggcagtgcagatgctttacttttgatctctcttacctctctctcgtttccttttcctctcctcagctagatacaaagacaaacaaatttgctgcctacattcatatctaactagggaatgagatgccagtctttctttcttggaagcactcctaatattctttataaagatgctcttggagttcctgcctcacttgtcttgggagttgaaaaggatctcaattgtctccatcccactaagtttaaatgttacgccttttccttctcagtttcccagttgtgtttgatggtgtctgcaaggtgtctgcaagtctctgagactttgtttttcttcattttttttctattccatatcagttgaattatattcaggctcatggattcttcttctgcttgcccaaatctgctattgagcccttctagtaaatttttcatttcagctattgtattttttaattccagaatttctatttggttcttttgataatttatttctttttattgatattccatttagtgagatgttgttttcatgcttttcttcatttctttgacataattttctttagctctttgaacatatttaaaatagctgactttaaatctttgtctagttaagtccaatgtcaaggcttcctcagggagagtttctgttgtttgttcttttacttttctatttgggccatactttcttctttctttgcatgtctcatattttttgtttaaactggccatttaaaaatataacaactctggaaatcagattctctcctattcccatgatttgttgttgctacttgttgtagttattgtttgttttgtgacttttctagactaattctgtaaagtttgtattttttgttgtgagtgccactaaaggttctccttgattagcttagtttttagctaatgtttggacacaaatttcttcaaatgcctagaatgaataaatttcccaatctttgtcaaaggtctctattatatgtgtataagggcatgctttcaacacttagccaggtagttgacaactctgccttagctttccattcctgcttgtagagaatctcaagattagccagtggtgaaaacttagggccttttcaggaccttcctgagcctatagatagccctacacatatgcgtggccttctatatttccaggaatatatcaaggcttttcaaagcttccccatggatatttcatttcctagcttttctttcaaggtttttggttagtcttttgtttgtcccaactattcatcactgcttcacgttgctgcaaagttaaaacgtttgttgtttttgacaaattctgccccctacttcacacacacaccaaggagaaggcattttttcactagtgagccctcaggttgaatgtaatcagctatcagccttgtaagtgggatcttgcagagactcaccagacaaatcaaatactgacaattctttgggaataaagctttgaaagagcttcagttctgttctgttctgttctgtctggtggttgccaggctgccccaggaacgtgggctgttattctttaaggataacatagagctagagcaggggatgggactggggaagttaagacaccacgaagtttgggtttcctaaagaggtttagccattttattttatttttttaaagaataagcactctccaggtggctgcaagcctttggttaatttccagagttctgaaaaaaactgattccgacaagtttttaccaatatttttatggcttttatggaggagtgaatttttagagctcattactctgccatttgtactgatgtctctgaccttaactttttaaattacatttaatttaatttttgtttttgctctgttgcctgggctgggctgcagtggcatgatcatggcccactgctaccttgaactcctggctcaagcaattctcctgcttcagcctcctgagtagctgaggctatagggatgggccaccatacctggctatgtttttttaattaaaaaaaattttagagttggggtcttgctatgttgctcagtctagttttgaactggcctcaagcaatcctcctgccttggtcttccaaagtgctgggattacaggcataagccactgtacttggcttttgaccttactttttaaagatacttttacaaattataaaaattacaagatagtatagaatgtgaaacattgactaatgtgaattactttaccaatataaaaataagcaagcatattttctcacaatgtaataaggtgttttgtagagagagcaaagctcactcagttatttttttcgatcatgattagaaatattaaggcccctaagattgttgattgctgaatctggagtgtgtctgtctctctgtttcactctttctctttcttattttcttcagcaagttaaaggaaaggcagagaaagtctaccattgtaaatttttgaagaaagacaacttatagtatcaaaaacatttgaattaaattcttatccaaaatttttgcctcatatacttgccaataataatggaggtttctgattgctaaggactcaaattgccttaaaattatttgtgaaaccctttattaataatgcatattttatttgatatgataatgtatggttttttatttttggataggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttggtaaaaattttacaaataatatttagtatttatttatattacttatttgtatactattttccttgatatacatgtataatatatttacatagtacctaccattgcaatactgatatacagtggagctctgctaaaatgcagatccttgtgcttttgcagcatttcagaaaaattagggttcaaataatttccctgtaaatttcagaaaacctggcactttgaaaatacttgatatagcacaatgggcatacgatatgattaatcattgtcttgttttctagaagaatgtcataaaggagttcttactatatttttaaaaagagagatggagtgaatattttactgtgccaaatctgttatttaggcgtcccctctattttgcatattatacatgctccttttacatcactggttgatatttatatcaaggtattggttgacaactataacatttccatcactctaaagaagttaatgtattaaggacagcatgtttaagcaggctatttcctctagcactttgtatcactaattactcccattcacatataccactgttttctgaaggcataataatggtttattgagaataatgaagcttagattcatttaatttttttaaaaaggtgaaccataccagagtaaatggagcaatgcaccaaaaattcttaatgacaaaatcccagttaaattcatttgttttattattcccacttataactagaagatccttcaagcttttctactactttgggaccttctattttcatttttttctggaataatgagtagttgaagtcttaaaaccctaaatattgaagttaacatatagagtccctacttcagaacccctttgttttatagataattatcaacatcttaacaattaaaactgtgaaccaggtactattgtaaacactttatacaacgaagattactttaattatttcttataacaattccagcctttagaaatacagttggccttctgtattcacaggttctacatctgtgtattcaaccaactacaggccaaaaaatttgaaaaaaaaaaaaataaataacaattcagtagaaaataatataaataagaaagcaatacaacataactatttatatagtgtttacattgtattgggtattataagtaacctagagatgattaaagtatacaggaggaagtacataggttacatgcaaatattatatcattttacataaacatccacagattttggcatgcatggagggatcctggatccaatcccccatggatactaagagatcacagtatatactgttctttccagtttacagatgaggaaactgagtcacacaagtatatttttcaagatcacatagttagtaagacatggaaccaaaatttgaacacagtctggcttcatagactatgtaagtcattgcacatgataactgccaattcaaaatgtagtccagatatataaaaatgtaatgagaattagaaagaaaatgagctttagaattaaacattctaggattgtaatccctgttattattctagcagtttgagtttaggccaatttcttagctgatctgagattcagaatgattcaacatgattcatttcatttctaaaaggagcatcacaaacttgcaacacaataaacatattacagtattatagaattgcacacaattgttcaaactagtctaaaaacacatttcacaatcagtttcctggttataattattatatgaacctattagtcattttgtaattttcttagcttatgtagttaaattttgaacattcaaattataaaaattaagatttaaaaatgggttgttgagcatgacctcaggaagatggtggagtaggaagtgccaggaatccatctctctacctagacaaaaagtatactggcagaaactgtctgaagtaactattttataagtatgcagtcttatttgaatgtttatagcttccaggggaaaggttagctggtaaattgcagttaatttaggttgatttcagcctaaaatatgatagcagctaccagtctccccagcctacagtcctgtgtcaggaagccatgctcatgttccctgagtgacttgctggtgccagagggggcaataggacttgtccttcaaacatcagagttcagtgtttcaacccccactggctgaagcaacttccaggaatttacatgaagcacatctatctttttttttttttccttttctctttttccatctttaccctttgggaagccaggcatttaaggattaggatattcaaaagcaaagcaaaaaggaatttagctatagcacatgtttaagcaaagaggcttaaaaaagacgggagaagaccataagcttttatctcaggctgatccctggcacagactttcaacagtaaaacaaaagaaaacagaacacaaacaaaaacagaaaatcccggggaagagggaaaatcttatttccagagttaccaaagtataatattcaaatgtccagttttcaacaacaagggccaggcacaatagctcacgcctgtaatttcaccactttgggaggccaaggtaggaaggtttcttgaggccaagagtttgagactaagttgggcaacagtgagaccctctctatacaaaaatttaaaaaattagccaggtgtggtggcacatggcctgtagtctaactactcaggaggctgaggtagaaggatcacttgagcccaggagttcaaagttatagtcagctatgattatgtcactacactccagcctaggtgacagagtgagaccttgtctctaaaaatttttttaaaccaaaagaccaatagtaacaaatcataaggcatacaaataaataggaaaatatgatccattcaaaggaacaaaacaaaccaacagaaattatccttgaggaagctcagacattggaattactagacaaagacttcaaaacagctgtcttaaagtagctcaaattgctaaaggaagacatggacaaagaaaaaaaaaccctaattttgtgtgaataaaatgagaatattgatagagagttagaaattataaaaagaaccagaaaaaaactctggaactgaaagtacaataaccgaaatgagaaacccactagagggatttaaaagcagatttgagtaagcagaaaaaagaattggtgaacgtaaagatagacaattgaagttactgagtctgataaacggcaaaaaaaaaaaaaaaagaaaaagaaaagaaaagaaaagtgaacagagcctcagagtcttgtagcacaccatcagctgggccaatatatacattgtaggaattccagaaggagaagagggagagaggaagaggtgggggggtagacagagagagaaaaagagagagagaggtggaaagagttatatgaagaaataaatgctaaaaacttcccaaattttgatgaaagacatgaatatacaaattcacgaagctcaacaaactccaaaaagcccccatcaagacattttataatcaaactgttgggagaaaaaatgaatcttgaaagcagcaagagagatgcaactcattacatgcaagttattctcaacaaaattatcagctgatttttcatcagaaatgttagatgccagaagacagtgaatttatatattcaaagtgctgaaagaccaaaattatcaactgagaattttatatccagcaaaactgtcattcaaaatgaagaagaaattgagatatttccagataaacaaaagccataaagagtctgttaccactaaacctgctcttcaaaaagtactaaagggacatcttcagatggaaaggctgctagacagtgaagctgtatgaataaataaatatctctggtaaacgtaaatacatgggcaatttataaaagctagtagtattgttattctggtttgtaacttcagtttttattttctatatgattttaaagacaaatgcatataaatggttaatttatgttactaggcgcacaatgtataaagatgtagtttgtgacatcaataacagaaaatgggctgggcacagtggctcacacctgtaaacccagcattttgggaggctgaggcaggtggaagtttgagaccagcctgggtaacacaatgagatcctgtctctacaaaaaatatggaaattagtcaggcattgtggtgcacatctgtagacccaggtacttaggaggctgaggtgtaaggatcatttgagcctgggaggtcagggatgcagtgagccataatcacaccactgacctccagcctgggtgacagaattagatcctgtcaaaacaaaacaaaacaaaaaaccaaaaaaaaccccaaaaacaaaacagggaagatggagctgtgtaggggcagagtttttataggctattgaagttcagttggtataaatttgaattagattgttatagcattaggaagttaaatgtaatctccatggtaactacaatgaaattatataatatacacaaaaagaaatgagaatggaatcagaatgttcaagtacaaaagtcacctaaatggaaaataagacagtaatggaggagacaaaaccctataataatggagacaaaaccctataagacatattgaaaacaaatagcaaaattcagagctatgtccttccttatagatcattactttaaatgtaaatagattatactctcctatcaaaagatatagattggcagaatatattttaaaaacatgaaaactatatgctgttttcaagacactcattttagatccaaagccacaaattgataaaacgtgaaagaatggaaaaagatattctgtgcatatagtaaccaaaaaatagctgaagtgtctatactactatcagacacaatagactttaaattaaaaagtgcaagaaacacaaaggacattaataataaaaagtttaatatagcaagaagatatgacaattttaaacatgtccacgcctaataacagaccttctaaatatatgaagcaaaacttcatagaattgaagggagaaacagacagttctaaaataattgttggacacttcagtaacccactttcaataatgaatagaacaaccagacagaagataaggagatagaggacttgaacaacacaataagctaattaggtctaacagacatgtataacattctacccaacaacaacagcatacatattctttcaggtgcccatgagacattccccaggatagatcatatgttaggtcacaaatctcataggttttaaaggatagacattacacaagatattttatttgaccacaatgggatgcagttagaaatcaataagataaggaaaactggaatatttacaaatttgtggaaattaaacaacacactcttagccaatcagtgggtcaaagaagaattcacaagggaaattagaaaatacttagagattaatgaaaaggacaacacaatatacctaaacttatgggatacagcaaaaacagtgctcagagaggaatttgtagttataagtgcctattaagaaagatctcaaatcaataacctaactttataccttagtaaagaactagaaaaaaaagagcaaactaaactcaaacctagtagattgagggaaataataaagattagaacagagctaagttagagaatagaaaacaagaaagtcaatgaaaccaaaaatagttggttctttgaaaagatcaacaaaataggcacacctttagctagagagagagaacaaaattaaaaatgaaagtggggatactactgaccgttcagagataaaatgaatcataagacaatactataaataattgtatgccaacaaattagataacccagaataaatggaaatattccttataactcacaaattccttagatgaactcaaaaagaaatagaaaacctctatagacctgtaacaagtaaagagtttaaattggtaatcaaaaacctcaacaaagaaaagttctggaccagttggcttcattgataaattctaccaaatatttaaagaattaacactagagcttctggataactgaacacagggaatttcccacagggtggcacacccaagaaaggcatgaaagtgccatgcaccttcccccataccttgccctacgcatctctttatctgtatcccttgcatacagataatattagtaatcacctcacggctttttgagaataagttaaataatgcttataaaatgtttagcagatcatctggcacagggcaaatgatcaattaatattaaaattgtgattattattattggaagcttgaatccaaatacactgatagaggagtataaattggtaaaaacttctcagaataaaaatttgacatatatgttaagaccttaaaaataattaacatcaattcttcttaaattcttccaaaaagttgaagaaggaacacctcctaactcattgtatgaggccagcattaattaccttgataccaaagcatataaaggcaccacaagaaaggaaaattacggaccaatatctcttatgaattagatgtaaaactactcaacagaatattggcgaatcaaattcaatagcatattaaaaattatttgccatggccaagtggaatttatcccaggaatgccagggaggttcaacataagaaaataaaacagtgtaataaaccacattaatagagcaaaggaaaaaatagccatatcatcatcgtgatgcaaaaaaaggtacctggcaaaatccaacatgcttcatggtagaaaacctctcagaaaattaggaatagagggaaatctcctcaacatgataaagggtatttatggaaacccctagctaacatcatactcaatggtgaaagactgaaagacttaccccctaatattaagaatgaggcagggtgcccactttcactgctgctattcaacattgtactgtaaattctaactagagatactataaaagaaaaataatagaaggcattcagatggaaaggaagaggtaaaactgcctctcttcacagatgacatgatcttatgcatagaaaattgcgaagactctttaagaaagctattagagctaataaataaattcagcaaagttgtagggtacaatatcaacatacaaaaattgattatgtttttatataccagcgatgaacaatcaaaaaatgaaattaagaaagaaattctattcacaatagcatctaaaagaatttaaatacttaggaacaaatctaaccaaggaagtaaaatacttgtacactgaaaattacaaaacactggtgagagaaattttgaaagacctaaataaatggaaagacatcctatgtttattgatagaaagactaaatattgttaagatgtcagtggtacccaaatctccagattcaatgcaatttctataaaaattccaacaattttttttgcataaatggaaaaaatactcaaattaatgtggaattgcaaagggccccaaaaggctaaaacaatcttgaaaaataaggatagagttggaggactcacagttcctaactttgaaacttactacaaagctagtaattaaaacagcatagtacttgtataaggtcagacaggcagaccaatggaatagaatagagagcctagagataaaccctcacatacatagtcagttgatttttgacaagagtgccaagaccattcaatggggaaggaacatttttttcaacatatggtgctgggaaaactgtccacatgtcaaaagaattaagttggatcctttatatcatataaaaaatgactcaaaatggatgaaagacctaaacttaagagctaaaactataaaactatagacgaaaacactgtcaaaatcttcatgacactggatttggcagcaacttttatggatgacaccaaaagcacaggtaatgaaagaaaaaaagataaattggactgcatcaaaattaagaactgttgtgaattaaaggagactatcaagaaagtgaaaagacaaggtaaatagtgagaggaaatatttaaaaatcatatatatgacaagggattgatatctaggatatataaagaactcccacaattaataaccacaaaaagtcccaattgaaaagtggggagaaaagattcgaatagccatttctccaaagatgaaacataaatggcctataaacacatgaaaagatgaatgctatgaagagtcatgaggacagatgataaggttttgttgttttaaattgaattaacttattaatcatttttatatggagactcatgatgaataatcaattaccttgcactaagtaaaattgtaatgatagtttaaaccacatgattttaaagataatttatcttgtttaagctggtcagttggtacacactgattctgagtatatctgcaaaggtagctctatgacttatttattgaattctgttgaaatcttagatttataaaaatctgtttgaaatttctcatccacaaagcttctgaagtttttgttaaatgtggctttaatgagcatgaaaaaattgtgtgaactgactgcttacatgactaaattgtgtttcatattcattaagagaagggattctggagccagattacctgaatttgaatttccttccacctcttcctagctatataatctagggtacattacttaatatttgtatgcctgagttttctcacttgcaaaatggggataatggtatacctactttataaaattgttatgaagattaaaaggaattaaaatatgcaaagtgattaaaatagagactggtactagaaagtactaaataagtgttagctatcattatttgggagaattacaataattgtaaattaagtgacaacattatatttatttcttattttggtataatacacataaaacttaccatcttaactctttttaattatatagttcaatgttattaaatacatttataatgttgtgtaaccatcaccaccatccagctccataactcttcatcacaactaaaaccttctacccattaaacaataactctttattccactttcccccaggccctggcagtcaccattctactttctgtctctatgattttccctacactaaatatctcatataagtagaatcatacaggatttgttcttttgtgaccattttttttttcatttatgtcctcaaggtttatctatgttgtagcatatatcagaattttcttcctttttgaggctgaataatattccattgtatgtatacaccacattttgcttatttattcatccacggatggatacttgggttgcttccatgttttaactattgtgaataatgctgctattaacatgggtgtacaattatctcttcaagactctgctttcaattctactgagtatatatccagaagtggaattgctggatcatagataatattataagtttttttagaattataaatacttgttataagctataaatgtgagtttgaataaacggggtcagggaaggaggacaagatggcattataaagactctgaaactgaaatagaaatcagtagagaaatgctactcgctatacatgtcttgtatttcacatagcctttcagtaatacagttaatagaataaaaatctaggtcctttcttggccaattgatttattttgttactgttttctttgtttggtcttctttcttctctctataatcttctttctctttcctcctccctttgcccttctcccttctacatccttcctctttctactctttgttctcctcacatgtgatatgttgacaaaatgttaataatataatattaatgatggtaaacccaacatcatatttttttatttttcttcaagagcatggtttcagaagaagagacattgaaaacactgtataggaacaataatccaccagcttctcatctttgtgtcaaaacaccaaaaaaggtagcttttaaattttatttcagaaagcaaattttaaaagctgcacttaaaaaattaaacatgttatgatttttaaattttattttgtactcaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaaatattttggatgcaaatacgtgcttcttattgattctgttaggtcctataaacagctcatcattataattttgagggaatattattcattgtaaagtcttgagagcattgtagaggagttttgtacttctgaggcagctttgacttttttattttatgaaattgagaaatggcttttagtggcaggaaaaagtggctataccagtatgacttcctgaaatatttaatttatacaacatttattaagcaaatatttattaatgtttactaagagtcaaacagagttctagatactggggatgtaatagtgaacaaaacagaaaaataacttgtgttttcctagagcttacattctggtgagggaaatagacaattaacaaaataaataaaacacagtatattagttaatgataactgctaagaagaaaaataaaacagggaagagtattaaggagtataaagaaggctatattttaggtatgatatcccttactgaagtgacatttgagtgaagatatgattaaaacagcaactgagcctggggttacctaagggaataacatttctcatagaaggaataggaagtacaaaggcccagaggtgggagtgtgcctagcatatctgggaagcagcaagagcccagtattgggaaggatagtgaggaaaaggaagagtagaaggaagagaaggcctaatagttaatgggatgaggattttgagtgggcagattatgtagcactttaggccactgtaagaactttggcttctctgaatatgatgtgacattagtagatgattttgagcaaggaagaaccatgatctgacttatgttttaacaatatctttctggctgctatattgggaacagattgaaaaagggacataaataaacaggagattattttagtaatgcctgtgaaagatggtaatggcttaaacaggagcaagagcagcagaggagtaaagtagttaacttttggatatattttgaagatataggtagaatatgaaagaaagagaatgggcaatatttttgtcctgaacagcgtagttttgcacatgttaggtttgaaatacctgtgagacatccaaatagagatggtaagcaggcttagagacaagtccagactagtgatataaatttgggagtcaacatcatatttaaagttatcagactggatgagaacatttacagtcatgggagtgagtgtacctaggaaagagaacaggtcagagagatgagaaggggccatcaaaggactggccagagtggtagtaaaaaaagtaggctatggtttcttggaagccaagcaagaaagtgtttcaaagaagagggagtgaaaaattgtgttaaatgctaatcagaggtaaagtaaaattgattaatgtgttattaatatgaaggtcattggtaatcttaatgtcagttttagtaaagtggagcttgattggaagggcttaaaggaaaaagggggagagtaagcagagacagctatctctatcaggtgtaataaactcaagaagttgtacttcacatgaagatgataaatagggaagttactggaaagggaaatggatcaacagaaggtttttttgttaagacataagaattaataacatatctaaataattagaggaagattcagaatggggaaaatgatgatgtgggagagaaagggaaattttttgtagaatgtcataacagggaagagggatggaatttagtgggtaattaaacctgttgggccttcagtaggagaatagacacttctgccatagcaacaggaaaaaaggaagagtatatggcgcaagaagatggtaagtgtatgggagtttgtagaagttttggttccataatttcagttttctcagtgaagctggaattaagatcatgcactgagaatgaggatagggaagacagtgttggaggttgtggagagaaaagtaagtatgaaagactcagagtaggaaagtaaatgggctttatgaaaacaatgaatacatgaataaaaatggttttagagttatctgtaaataactatagtgaagtaaaattagaatcctcttatggtatagattatgtttgtaggaaaggctaaccaagaaaaaatggaaatgcaataacattacagaaattattttgttcctcctttaatttgtgtgactacaactatactctcttaactggccatggtcttgtgatttctagcttttgatctcttaattgaaactttataataagtctcctgagcaagcatttttggagaattattggtcttgaaaatgtgaaatttcacatttgaagctatatattttcaaatattaaaaataataatataaataaatatattttcaaattaaaataactaatatattaatctatacatttaatgtagttttaatttaaatatttacaataagactagtctgttaagctatatattttcaagtatttagaataagactagctgctctggctaactatagatttacttctaacttacctaaagtccaacataatgtttctgtttagtgagaaccattcctctaggcagtcattcaggaaccctggctcctttcaacttctaattctgccatcttcaggagctggcttccaggtttatgctaaaagggaaacaccatggagtatccatgtgggaagtttctaatgacctagcatgaaagagattatatagcacttccacccacatttcactttctagaaccaagtcaatatggccacacctaacttcaggggagactgtgacccatgttccagttatctctcaggagattagggaaaagggtaaacaactagccagtctgccacaattagttcacagtctttaaattttcaaatattgttcttccttgcttttagttaaaacaaaatgagttagttaaggctcctaagttttggaagattgcttctccttgctgttccttgaacattctgggtgtcttcctgctttataacgcccctccttcctccagcatttcttatttatcttataccttctaacatactatataccttatttggtatgtttattattcattgtctctcctcacaagaatgtaaacttcacaaagggatttttgtttcctttgctttggctttcctttccaagtggctagaatcatgcctggcccatagtaggtactcaatatttgttgaataagtaaaatattaatacatatttaagaaaaacatacatataccatattagtgattcttacaataagtaaaaccttacaacctaaatgttgagtgtctgatttaaaaataagattagatgttggaaactagaaaaatcatgaaattttctaaaagcatattattatagtatcctatatttgactcttctttgcactctggagagttcagtttttacaataaagtctcccccaaaaatttataactaatattattgtttttacttttaaactactcctttaaaaaccactagtcttaatgaacaattggcaaattcataatttgattatttaattatgaaaattttgtaagctaaatacgagattattaactaatgcctttttaaacattgaatgcattttggaggttattataggaagcagcttttgaaaaagcctatttttaagttggtaggaaactcttcctgccttttagccactttttgtgagattgacttaatctgatacatttaggatcaatcagatgtgtttagaagtaggcatatgggatacacactattctctgtctctctcttgagtgtggagcttcctacaggaatcacatgatcatccctatgctgcaagttttatagggcgggtggaagagtggtcctgttgtgaggggataaattcaataaaataaaaattcagaagaatatttgcaagttccagtattttgatgaataggctgggcactttgagaaggaaatagagtggcattcagaggaattaacatacaaatattgaaactctgatgtggctttggtggcactaatctggaaaatagccatataggaattttcacttgttgggtctttatagcttatggtagtcttatctttacatgagttactgtttttacagaaacaggctgcaagttctgggtgttaagtgaatagtgcataagctttatctgaagcaaaaatgagcatttaatatgtctgcaggccataaacttcagaagatgcatggcctgaaggggcctcagccaaattattggctattaaaaaacaaatattagccacgctagactgggcaaagaggtgagactcagtcagagataatactttgtgtatattttgatgatggaaccaaaaagatttctggagataagaattaagtgagggaaagagaagggacaaagtttggttttgaagtacggttttgggcatatgtaatatttgagatattttagatacccaagtggagatattgagtagaccattggataaatgaatctagaattctccagaagggtaagtatttagtaatcattgacatataggttctatttaaagtacagaactgaatgcactctttttacagtaataaatgttagttataaaacagaaaggaattagtaccaagccttgaggtaaaggaatatttgaaagtgaagcaataaaggaagagccacaaaaaagctaagaaggagggactgctgtaggagggaaaaagcgagtgtaagggatgatggaagcctaaagaacaaagtgattcaagaagggaatattcccctgtgtgaaatcctaatgagcatgaaagcagaaaataaataattggacctatggctatatgtatgatataatctctgctctcaatgactcacagtcaaggagcaaaattttatatgtaaacaaatgaatcaattgtaattaattggaccgtacacacatgtaagagctacagagaagtgaatgataatttcatgacataaatgcaggcatcagagaaggacttctgggttttggacataaatgggagtgctataggtgtataaggaggacaagagacaaccaagacataagaaatcgcaatataaaggatgaagtgaagaatagttaggagaaccaagccatggtatcttcatgtaggattttatgtgttatattgcaaagcctggacttttctggtgtgggaaatggaaagagaataagcaaagaaaatcagactttattatttaaatatggtattaaaatgtttttatttcaataagctttggggaacaggtggtatttggttacatggataagttcttttgtggtgatttgtgagattttggtgcacccatcacctcagcagtgtacactgtacccagtgagtagtcttttatccctcaccccctcctatctttcctccgcgagtccccaaaatccattgtatcattcttatgcctttgtgttgtcatagcttagctcccacttattagtgggaatatacaatatttggtttttcattcctgagttacatcacttagaataatggtctccaattccatccaggttgctgcaaatgccattatttcattcctttttatggctgaatagtgttccatggggctggttccatgtttttgcaattgtaaattgtgctataaacatgcatgtgcaagtgtctttttcctataatgacttcttttcctctgggtagatacctggtagtgggattgctggatcaaatggtagatctacttttagttctttaaggaatctccacactgttttccatagtgattgtactagtttacattcccaccagcagtgtaaaagtgtccccttttcaccatattcatgccaatatctattgttttttgattttttgattatggtcattcttgtaggagtgaggtagtatcactttgtggttttgatttgcatttctttgataattagtaatgttgagcatttttttcatgttggttggccatttgtatctcttcttttgagaattggctattcatgtccttagcccactttttgatgaagttgttttttttttttttctggctgatttgattgagtttcttgtagattctggatattagctctttgacagatgcatagtttgcgaatattttctcccactctgtgggttgtctgttcactctgctgattatttcttttgctgtgcagaaactttttagtttaattaagtcccatctatttacctttgtttgtgttgcatttgcttttgggtttttcttcatgaactctctgcctaagccaacatctagaagggttttcctgatgttatcttctagactttttatggtttcaggtctttgatccatgttgagttgatttttgcataatgtgagagatgagaatccagtttcattcttctacatgtggcttgccagttatctcagaaccatttgttgaataggatgtctttccccattctatgtttttattttctttgtcaaagatcagttgggtgtaagtatttgggtttatttctgagttctctattctgttccatgggtctatgtgcctatttttattaccagttgcatgctcttttcatgactataaccttgtagtatagtttgaagttgggtaatgtgatgcctccagatttgttctttttgctcagtcttgctttggctatgcgggctcttttttgcagtctacatatttagtgcaattcctatcaaaataccaccatcattcttcacagaactagaaaaaacaatcctaaaattcatatggaacaaaaaatatagtatttttaaatttaaattttacaaaaggttataaagtataaggtctcctaactctatcatcaatgccccaacttgaggaaaatacttttcttttggaagacaactaaggataattggaactggataaagcaattgcaactattgaaatagtccagttaagagataatgtaaccaaaatgcagtttagttgcttgccgcatccaaacaacaaatgggaggtctgatgcatatgtcttgccatactgcttcactttgggagtagaaatcaggcactttcataaggtaagggaggaaatgagcaagggcaagtgtccccctgctagctcagtgccttatctatctggcagttgaattggtgctgtcctgggaagaactaagttgtaaaagtggccaagtgggcatgcttttgacatgccctcctgaggtgacctcctggaggtgagaattccatagtggggtgcaaggggcaggctttggtctgcaaattgactgtcaactctcaaggagagatccatctaagagcacatacatgaacttcccctgtagggaatgtctggtgagtgggagatgaaaggttatatttgtgtttctaaaggactaagtaggaagtagggaacaggggaaatgagaagagaggaaaaaaaattaaaccacctcttaggaagataggggtattcgattacaatgggaaaatttcttaggttgaaagcttaagttccaaacttttggattagatctaatacctgtcctgagaaaaatattcataactttatcactctaacagtaataaaatgttttctacttcatgtaaatttaaattaatgatgtcaaagagcaagttgctttggttgatataaaggttagaaataaattattaataatttaggtaacctgaattcagtataattaatactccacagactattgtagtacatcaggaactttaatcaatgacaggtcaaccatgggttagaaatacaaaatgacaaacaagagacagataagacaacattatttaagttacaaaatcagagtttagagatgaagggaaccaaaaggatcatttaatttcaaaagatcagtcatttgagtcctataaaagcaataaaaatgaaaaggatagttttaaaaaaaatgactctaaatttcagtatacatatacataatttacactaatgcataaatatgagcatataaaatcttagtgccctccctttttttcttttgctttttccctcaacctctctcttccctgctccacatacttgagtccccctcggttaacttctactctcttaggtaaccctcgacaagaacctactgtgtaaactttcttatttttctccatgacagaaagacagttataatgtatttagtagtttgtcatatttttacacatatatacatacacataggattttctggttatggttaaattacaaacatgggataatatgtatacttttcagagtcttgctttactcagtgtcatggaaatctctctaaaacgtggtaaatctctctacacatgtggtatggttgcagtttattctttttagtggctgtataatatttcatgggtgtataacaattcactatttctctattaaaaggtgtggtagagaccttgatcacttatatctaatcttctcttctcccaggcacatgagaagattatacttcctccctccttagtgatactatgttttagcaaatgaattttaagtagaagtgatgtgtgttaattacttctgtggtgtgagaccctctatcacacccttcttctgttgcagcaatttgtggtattatagatgacaaagtctctgtcaccctcagttcctgaagtgaaaattgcatggaacaaagttctcccattaacccactgtggttatgtagtaatgaatttgattcaccatataaaactgaaaattcaacaggggcagtgaaataggaggactgaagttccctagctacaaattagtcctgtgtgctctctccatcctcagaaacctctctcctgtcctagaaggacgtgcaatgtaagtagaacccatattaccagattggtgtctttttttctttttttttaaggttggaggttggtgtcttaaagtagccattataattacctacttgcttctcccaggttctttaaaaattgcagtacagagcccagcactgtcccagccactccagaggctgaggtgagaggatcacctgagcccaggagttcgaggccatcctgggtaacataatggaaacttcatctctaaaaaaacacaaaaggaatattggcatacttggaggattggttccaggaccctctgttccctgctgatataccaaaaatccatgcctcacaattcaacctgcaaaacctgtgtatacaagtctcagtatatgtggttgtgacagaattcatgggatacagaaacccacaaattatattttttctttttctttcttctttcttttttttttttttcgagatggagtctcactcctgtcacccaggctggagtgcagtggcgtggtttcagctcactgcaacctccacctcccaggttcaagcgattctcctgcctcagcctctggagtagctgggattacaagcatgtgccaccatgccccgctgaattttgtatttttactagagacggggttttgccatgttggccaggctggtcttgaacccctgacctcaggtgatccacccacctcggcctcccaaagtattaggattacaggcgtgagccactctacccggctgaattatgtattttcaatccatgtttggttggaaaaacatctgcatataaatggacccaagcagttcaaacctgtgttgtcaaagatcaactgtagattgcaggctgtagttcccatgaattaacacatgagagctatcacagggaggctctggccagtgataggtagctatagtatatgacatgccagatgggcatgatgggccaagaaagtagatgggtcatccttggacccatctactttcttggcctcatctactttcttggcctgtcaggttcatttggcctgtcatggatcttgagattcatgtttgggtctcaagatccaaaaaaaggttatgaatgtggcatggtctcacccttcagataccctgtggcagggagaagtcagtaatgagatttttgtccagtgaatttgtatcctgcaactttgataaagtcaatatattagtcaaggttctctagaggggcagaactaataggatagatgtatatataaaggggaatttgttaaggagtattgactcatatgatcataagatgaggtcccacaataggccatctgcaagctgaggagcaaggaagccagtctgtgtccaaagctgaagaccttggagtcagatgtttgagggcaggaaacatccagcacaggaggaagatgtaggccagaagacaaaaccagtctacccttttcacattcttctgcctgcttttattttggctgcacttgcagctgattagattgtacccaaccagactgagggtgggtctgcctttcccaacccactgactcagatgttaatctcctttggcaacatcctcacagacacacccaggaacgatatttgacatccttcaatccaaccatgttgacaatttttttttttttttgagacagagtctcactctgtcacccaggctggagtacagtggtgcaatcttgcctcactgcaacatccaccacctgaacgattctcctgtctcagcctcctgagtagctggtaccacaggcgcacgccaccatgcccagctaatttttgtatttttagtagagacagcatttcaccatgttggccaggctggtctcgaactcctgatctccagtgatccgcctacctcggcctcccaaagtgctgggattataggcatgagccaccgtgcccagcctgacactcaatattaaccatcacaagtccaccccttgtcaacttgaatccatacacatctcctgaaatcacacataatcttcaaataaaggcagtaataaggtcataattacacctaacataatacaactatccttcatacaatgggaaatgcacaatccccaacccaaatgctattacataaagttaacacttaaatgctgatgtgaagtcaataaatcttatgtcacatgataaaggaaaaaggaaataaaatgatcttttcttagtacaagtgtacgcatggacaaacatgttcttaacaaaagaaggaggaaatattcatgacaattacagtcattgtttctgcaactggtcatgtggtcatagctggtattgatgactaccttcttttactacccatgctatattccctttgccttcagcaagcacctcagctggttgtggtttttttcctggtggagtgacacaaaccttcattcctgaagggtctgtcccatttgtagtcctgcctggatcgggctattgtagcttcccattgaccttaatcacagggcatgggaatactaagagatgccctaagggatctcctgtattccagacatactcttccttacctccattgtggagtagtagactgatttcatcttgatagtccaggtcaatcaccccagccaacactttaactcccttcttaggctgttgacttaaaggtaggaagagcccaaagtgtttaggtggcaatcttaacttccagtttagtggaatcattgttgtgtctcctggtggcagcattcctccctctggaatctaagacatctaggccagcagaacataatgttgcaggaacaagaagcaaaaattttgctagtgggtcactaggggtgatggtgagtggtgccagttccacttccacccattgatttctggacccgtgaatcctggctatgggagaaacagtaccatatattggatgctaattcagagtatacacagccttctggagaactttgccgcagccttgcaaagtattattacatagttggtgttgtaattgtgacttcaaaagcccattccaccgttctatcaatccagctgcttaaagataatggggaacatagtaagaccagtaaattccataagcatgagcccacggctgtacttctttagccataaagtgagtgccttggtcagaggcaatgctgtgcagaataccatgatggtggataaggcattctgtgtgcccatggatggtagtcttggcagaagcattgtgtgcaggataggcaaagccatatccagataaagtatctattccagtgagaacaaactgctgctctttgcatgatggaagaggtccaacataatcaacctgccaccaagtagctggataatcaccccccaaagaatggtgtcatatcaagggctcagtgttggtctctgcttctggcaaattgggcactcaccagtgggtgtagccaggtcagccttggtgagtggaagcccatgttgctgagcccatgtgcaaccttcatccctgccaccatggccactttgtttatgggctcattgggcaatgataggggtggctggggaaagaggctgagtggtgtccactgaaagaatcttcctatccatttgattattaaaatcctcctctactgaggtcacccgttggtgagcactcacatgggatacaaatatcttcacaatcttcgaccactcagagaagtccatccatatacctcttccccaaatttctttgtcaccaattttccaacaatgcttcttccaagtctctgaccatccagccaaaccattagctacagcccatgaatccatatataatcgcatatctggccatttctccttccatgcaaagtgcacaaccaggtgcactgctcaaacttctgcccactgggaagatttcccttcaccgctgtccttcagaaatgacctggaaaggggctgtagtgctgcagctgtccacttttgggtggagcctgcatattatgcagaaccatctgtgaaccaggccctagtcttctcttcctctgtcagctgatcatagggaactccccatgaggccattgcttcaggctaggggagagaaggcagggtggcaggagtggagaccatgagcatttgagccatttcctcatgcaacttacttgtgccttcaggacctgctcaagcctgatcatgtgtataccacttccatttgatgatggagtgctgctgtgcacaccccactctatggctaaacgggtaaaaaagcacaattcatgataggcagttcaggttgcatggcgacttgacccgtagtcaaatgttcagtttccaccaaatcccagtaacaggacaagagctgtctctcaaaaggagagtagttatctacagaagatagcagggccttgctccaaaatcctagagggctctgcagtgattcacctgtgggagcctgccaaaggctccaaacagcatccctatctgctgccactgacacctcaagcaccattggatctgctgggtcatatggcccaagtggcagagcagcttgcacagcagactgaatctgttgcagacccttctcctgttctagaccccactcaaaactggcagcctttgaagtcccttgataaatgggccagagtaacacacccagatgaggaatgtgttgcctctaaaatcctaataggcccacttggcattgtgcctcattcttggttgtaggaggggccaaatgcagcaacttatccttcaccttagaagaaatatctccacaggctccataccactggacccctaggaattttactgaggtagaaggtccctgaattttagtcagttttatttctcatcctctggcatgcaaatgtctcaccaataagtccagggtgtttgctacttcttgctcactggatccaatcagcgcaatgtcatcaatgtaatggaccagtgtgatatcttgtggagtggaaaagtgatcaagatctctctgaacaagattgtgacacaaagctgaagagttgatataccctgaggtaggacagtaaaggtacattgctggccttgctagctgaaggcaaattgcttctggtgggccttatgggcaggaatgcagaaaaaggtatttgccaatcaatggctgcatatcaggtaccaggagatgtgttaatttgctcaagcaatggaaccacatctggtacagcagctgcatttggagtcaacacttggttaagcttacaataatccactgtcattctccaagatttatctgtcttctgcacaggccaactaggagagttgaacaggggtgtggtgggaatcaccacccctgcatctttcaagtccttgatggtggcaataatctccacaatccctccagggatgtgatattgtttttgatttactatcttcctaggtagaagcagctctaatggcttccatttggcccttaccaccataatagctttcaccctaccagtcagggagccaatgtggaggttctgccaggtgctaagtatatctatgccaattatgcatactgacactgagaaaatgaccacaggatgagcccagggatgcactgcacccactgtaagtcagacctgagctaaaactccattaactgcttcaagttttaaatttatataagcagaaatctggagaacagacaaaggaatggatattaagggtttgggataatgataaaaggaacataggattgaatcaggctgaatttattgatttgggcccactaagtagggactctgcatttaatgttgcagcttggggagctgaaaaaggttctaatagtttatttgcttggttagctaaaatacggattaaaagaaagcccactgtgtgcaagctggaaaagcctgatctcttttggttgaatgtagaggatccaaacgcttagggagattgggatgctggagtagattagtcactttagaccccctcatcccacctgggagggtctagaagatatacccttgaccaatactttgtaaaacagatttgtgaggggagcacttgcatccttgaagggctctgtaattgctcttctctgtgtgccagatgttacagtaggaactgcagtcattcaactacaaaatttaaatgagaacacttggattccaaggtggcaggggctaagtggcagcagtcaactgtcaaaggtaaggtgagtgtagctaccacaatggacagcagaggcaaagtagcaatcagaatagtctgatgcatgtagagttctggcattggctaactaatcatgatgtagctagaagtgaagtttataggaagcctactgcatccttacttaatttatataagcagaaaatttccaggtcaaatggacaaaagaccaatttgaattataaaaacagaatcacagcccctcaatcaattttcagacttgaaccagtttacagacccagaaccccttgaggaaggaccccactacactacaaacaatttatgctgttaatctttctcccatccttccccaaggagaccttcaacctttttttttgttttttgtttttgttttttttttttgagacagagtctcactctgtagcccaggctggagtgcagtggcacaatctcggctcactgcaacctctgcctcctgggtcctggttcaagcaattctcctgccttagcctccccagtagctaggattacagacacatgccaccatgcccagctaatttctgtatttttagtagagacagggtttcaccttgttggcctggctggtcttgaactcctgaccttatgatctgcctgcctcagcctcccaaagtgctgggattacaggcatgagccactgtgcccggcctgaccttcaaccttttaccagagtaattgtgcattaaggaaagggaaatgatcagatctttcagggaatactggacactggctctgagctgacattgattccaagggacccaaaacatcactgtggtcctccagttaaagtagtggcttatggaggtcaggtaattaatggagtaaattaaacctcttttcttcataaattactcactctcaggtagttctttctagcaatgtgagaatggactaatacagaaaattggtactagaagagtgggacactgctataaagatatttgaaaatgtggaagtgactttggaactggtaatgagcagaggttggaacagtttggaggactcagaagaagacaggaagatatgtgaaagcttggaacttcctagagatttggtgaatgcttttgaccaaaatgctgatagtgatatggaaaatgaagtccaggctgagggtgacatgcttggccatgtgaagagaccaccaaacaggctttatgtgagcaacaaagctttttaatcacctgggtgcaggtggactgagtccaaaaaaggagtcagcaaagggagatggggtggggcagttttataggatttgggtagatagtggaaaattacagtcaaacaggggttttctcttgtggacaggggtgggggttatagggtgctcagtggggagcttctgagactcattgtccaggagaaggaatgtcacaaggtcaattgatcagttagggtggggcaggaacaaatcacaatggtggaatgtcatcagttaaggccggaactggctattttcacttctttggtgttcttcagttgctttgggccatctggatgtatacatgcaggtcataggggatatgatgccttagcttggactcagaggcttgacagagggtgtctcaaatggagatgaggaacttattagaaactggagtaaaggttactcttgctatgctttagcagagactggcagcattttgccccagccctagagatctgtgtaagtttgaacctgagagagatgatttagggtatctgatagaagaaatttctaagcagcaaagccttgaaaatgtgacctggaggctcctaaaagcctatgctcatttgcataaagaaagagatggtctgaaattggaacttatatttaaaagggaagcagagcgtaaaagtttggaaaatttgcagcctgaccatttgatggaatagaaaaatccattttctggagaggaattcaagctcaagctggctgtagaaatttgaataagtaaagaggaactgaatgttaatagtcaagacaatggggaaatgtctctggggcatttcagagacctttgaggtagcacctcccatcactcaggaggcctaggagggaaaaatggtttcctgggccaggcacaaggccctgctgctctctgcagcctcaggatatggtgacttgcatcacagccattccagctccagccatggctaaaaggggccaaggtacagttcaggccattgcttcagagagtgcaagccccaagccttggtgacttccatgtggtgttgcaggggtggagccctcatgaagaacctctactagggcaatgtggaaaggaaatgtaggattggagcccccacacagagtcttcactggggcactgcatagcagagctgtgagaagagggccaccatcctccagaccccagaatggtagatccactgacagcttgcactttgtgcctggaaaagctacaggtactcagtgccatcctgtgcagagccatggggtggagctgcccaaggccatgggcgcccaccccctgcttgcttcagtgtgtcctggatgtaagacatggagtcaaatgaaattatttcaaagctttaagatttgatggctgccctgctgagtttcagacttgcatggagcatgtagcccatttgtttggccaatttctcctttttggaatgggaatatttacccaatgcctgcacccccaatgtatcttgaagtaactaacttgttttttattttacaggctcatagatggaagagacttgccttgtctcagatgaaactttggacttggactttcaagttaatgctggcatgacttaagactttgggggactgttgggaaggcataattggttttgaaatgtgagaaggacatgagatttgggaggggccaggggtggaatgatatggtttggatttgtgttctcacccaaatcacacattgaagcaaaggaggaacctagtgggaagtaattggatcttgggggcagaattcccccttgcaatcataagttctcacaagacctgatggtttaatagtgtgtggcacttacctcttctctttctcactctctctgctgccaccatgtgaagaaggtgcttgcttccccttcaccttctgccatgattgtaggtttcatgagggctcccagtcatgctttctggtatagtctgtggaactgtgagtcaattaaacctcttttcttcacaaattaccaagtctcaggtagttctttctagcagtgtgagaacagactaatatatagtgtaagaaacttacttacagaaatatatttctatttcttattcctattctctcttttattcttgacatactatttacttctacaaacaccacaataattactaattttgctttaagctgtcaattttctttttaagaaaattgaggtaaactttacacaaggaaagtaaccattttaaagtgaagagctcagtggcatttaatacattcacaatgttatgcaaccacaacatctctctagttccaaaacatttttatcaccccaaaagaaaactctgtactcattaagctgttattttccattccctactctctccagcctctggtaaccaccagtcagctttttgtctccatgcattaacctattatacatatgtcatataaatgcactcatacaatatgtgacattttgtatctggcttctttcacttcagtcatcttttgccaatattagaaatgataacaattttatttgctcacatatttactcatctcttcattgagtagtatcacattttctcctgtttatttttttctcaaagaacctcctttaacatttcttgtaatacagatctgctgatgatgcaatctgtcacctttgttttatttattttattattttttaaaattttattattattatactttaagttttagggtacatgtgcacaacgtgcaggttttttacatatgtatacatgtgccacgttggtgtgctgcacccattaactcatcattttgcattaggtatatctcctaatgctatctctcccccctccccccaccccacaacagtccccggtgtgtgaggttctccttcctgtgtccatgtgttctcattgttcaattcccacctatgagtgagaacatgcagtgtttggttttttgtccttgcaatagtttgctgagaatgatggctgccaatttcatccatgtccctacaaaggacatgaactcatcattttttacggctgcatagtattccatggtatatatgtgccacattttcttaatccagtctatcgttgttggacatttaggttggttccaagtctttgctattgtgaatagtgcctcaataaacatacgtgtgcatgtgtctttatagcagcatgatttgtaatcttttgggtatatacctagtgatgggatggctgggtcaaatggtatttctagttttagatccctgaggaattgccacactgacttccacaatggttgaactagtttacagtcccaccaacagtgtaaaagggttcctatttctctacatcctctacagcacctgttgtttcctgactttttaatgatggccattctaactggtgtgagatggtatctcattgtggttttgatttgcatttctctgatggccagtgaggatgagcattttttcatgtgttttttggctgcataaatgtcttcttttgagaagtgtctgttcatatccttcgcccacttgttgatggggttgtttgtttttttcttgtaaatttgtttgagttccttgtagattctggatattagccctttgtcagatgagtaggttgcaaaaatgttctcccattctgtaggttgcctgttcactctgatggtagtttcttttgctgtgcagaagctctttagtttaattagatcccatttgtcaattttggcttttgttgccattgcttttggtgtttaagacatgaagtcgttgcccatgcctatgtcctgaatggtattgcctaggttttcttctagggtttttatggttttaggtctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatagttgtagatatgcag

SEQ ID NO: 1766 - DNA, 59278 bp, Homo sapiens
  FLJ25124 gene - 143038288 - 143057565 of chr1; NCBI Entrez Gene ID: 148741; Build 35; sequence includes 20,000 bases upstream of initiation codon and 20,000 bases downstream of termination codon of the gene
acgcaggaggattgcttgaggtctggaggtttgagaccagcctgggcaacatagagagaccccatctctacaaaaataaaaaataaaaaaattagctgggtatggtggtgcatgcctgtggtcccagctactcaggaggccaaggtgggaggatcacttgagcccaggtggtccaggctgcagtgagccatgattatgccactacactccagcctgggcgacagagtgagactctgtctcaaaaacaaacaaaatgggccaggcgtggtggctcacgcctgtaatcccagcactttgggaggccgaggccagtggatcacgaggtcaggagatcgagaccatcctggctaacagagtaaaaccctgtctctgctaaaaacacaaaaaattagccgggtgtcgtggcgggcgcctgtagtcccagctactcgggaggctgaggcaggagaatggcgtgaacccaggaggcagagcttgcagtgagccgagattgcgccactgcactccagcctgggcaatagagcgagactctgtctcaaaaaaaaaaaaatgttctctacccacatgcctttcctaatattctcttctccttaaacattttcagtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtaagagaaggcaatatgagctgggcacagttgcttgtggcacctacttaagaggtggaggtgggaggatcccctgaggccaggagttcaagactagcctgggcaatacagtgagacctcatctctaaaaatatgaaagaaaaaaaaaatagccaggcatggtggcatgcgcctacagtcccagctactcaggaggctgaggcaagagatcagttgagcccaggagtttgaggctgtagtgagctttgatcacacaactgcactccagcctgggtgaaagagtgagacctcatttcttagagagagagagaaaggcaatatggatgggcttggaaggggagagacagagagagaggggataaatgtaggtgttgtcttcagtagtatccaggtgttcatctctcctctcttatatactttcttcttcctcctctccccccatctcacatacatacatttcatttgaatgcgctttattcccaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctggtgaggcattgggaagacaggtgtgggaggctagagcaatgaaggcttagaagagttagggcggggccaggcatggtggctcacgcctgtaatcccagcactttgggaggcaaggcaggcggatcacctgaggtcaggagttcgagaccagcctgaccaacatggagaaaccccatctctactaaaaatacaaaattagccaggcatggtggcgcatgcctgttcagaggcatgctacttcggaggctgaggcaggagaatcacttaatcccgggaggtggaggttgcagtgagtcgagatcacaacattgcactccagcctgggcaacgagagcaaaactccatctaaaataaaataaaataaaatgaaatgaaaatctttcccttaaaaaaaaaaaaagaagaagaagaagagttagggcaggtttggagtgcagtgtgtatatcccaagatgtcttgcatactttctttgtatgtacactaatggtacaaagaggaaggctaagtgggctgtcattgtactccctctcactgcatttctacaaagtatctatgtctgtgtctctccatatttcacagacagaagtctctttctatccctccactccaacaatgatcctggcccacaggttctccactactgatgtcctagcccacgttccaaacatgatccaaaactcatctctaggggcacggtggtaaaattgaaacaaaacaaaacaactcatctctgggaggagtccctgcccagatcattcttttccgttctatatttcatcgatatttcccctcccaagtgcaatatttgttgaatgaatctgagtgtatgaacgttgtacttatttggactgataagctactctgtatgttctatgaccttcaaacatttgagctctcactccatgccatctccatgttaaatactcaggaaatggcctaaaaggcaagatgcttgacctcagggaagtgctgatgttaaatcctgtgtgtgtgtgtgtgtgtgtgtgtgtgtgtgtgtgtgtgtatgtgtgtgtgtgtgtgtgtgtctgcatacatctgatctcacctcactcctttctcttctcagcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtgagaattcaccctggatctggaagagttggggagtggcaggggggcagtgtcttgtgaactgtccaaggactgggaacttgaggaaaacaagggcattaactacttcccagacttcagccacagcatgttagttggctgtgttctgtaccaactctaatgcctcattccttgatcttatgacctcttaggtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaaggtgaggattactctggagaaatggacagggcgggagaagttctggagtgtaggtggggctctggagtgagttcagtaggtcaaaggggaaactgtcttcccctgatattgtctcaatgttttctcatgaccaagggtcccatgcagaaaacgaaagctcctttgggctggaaatgtctcagattggtttctccactcatcggctaaaggttggacagattgaccccttcattacttctcccattctctgactcagataacttcaaccacagggccctccagattcctcctttaaccagcctccatgctcaccttcccatgcctttccaactgagcccagcagaccctcagtgatcttttcactcctggaacgttttttttctctttattccccactgtcttctcagtgaccccatctgcttctgtcccacaggatgggattctttttgggatggtgggggcctatgactggggaggctctgtgctatggcttgaaggaggccaccgccttttccccccacgaatggcactggaagacgagttcccccctgcattgcagaaccatgcagcctacctgggtgagcagcagagagttgcagaggacttacagggtaggggaggaaatacatccctagtgggggcgggtatgaaatactccctcttaactcatgcggtttctcactgacctctggttacttcccttgggacctcctgctatgcctttagggaacccccctactctggaccccatcttcttttcctttacctctgttactttgcccacttctaggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcaggtagggcatccaaggaagggtgggacctttggattcccagggacctctgggctgttggggaggagtgtgaagtgggtaagagagaggcctccaaagtctgtgcggaattctggttggcagagtctgtcagggatgtaaggagcagactagcaggctggtgagtgcttcccactgagtccacttgtctacagttaccttcccttttctctggggtcatcatcacccaccattccccagattggttcatactttggcagtgagctctgcccattggatacagatagggatggaacaactgatgtcttacttgtggctgcccccatgttcctgggaccccagaacaaggaaacaggacgtgtttatgtgtatctggtaggccaggtgagacttgctgggaccccctgccctggacttgcattgtgggggtggagggaggaaaggagggaaggtgcacatatttgagggtttgctgagaggttgggtctgccagattagcatcttctatcttctctcctccaccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccaggtcaggagtacccaaataaagcaggggcacggttgtaggaagaggaatagggggatgctctttgcttgtcaatagtctccttggcttgagacccaaactgaacaagtgcttttattagtaggcaaaaacataaggcagtggacaggttgctgaactaagaactcctgaacacaggcaagtttctcttattcccaggactgacgggagcattataaagagcaaggcatggccgggtgtggtggttcacgcctgtaatcccagcactttggaaggctgaggcaggcagatcacctgaggtcaggagttcgagaccagcctggccaacatgatgaaactctactaaaaatacaaaaaattagccgggcctggtggcgcacacctataatcccagttactcaggaggctagggcaggagaatcgcttgaacctgggaggcggaggttgcagtgagccaagatcacaccattgcactccagcctgggcaacaagagtgaaactccatctcaaaaataaataaataaataaaaagaaagagcaaggcaggaggcctgagaaactaggtgtatgggtccctgcctcagtattctctctcttcctctcagaggattgctgctgcctccatgccacatgccctcagctactttggccgaagtgtggatggtcggctagatctggatggagatgatctggtcgatgtggctgtgggtgcccagggggcagccatcctgctcaggtgaggggtcccagctcaggtggtggtggacagcatagcatagctgttaaaggcaagggccttaaagtcacagatggagatttggttttcttggtcaacttactctgtgcctccattcttagtttataaaatgacagtagtaatagtacctaccttataggtttattgtgaagattaaatgagataatccatataatgatttgaacacagtgcctagcatgtaagtgcgtattgaagtgaatctagggctgggtacagtggctcacacctgtaatcccagcactttgggaggcgaaggtaggaggatcatttgaggccaggagttcaagaacagcctgaccaacatggtgaaaccccgtctctactaaaaatacaaaaaaattagctgagcatggttgtgggcaccagtaatcccagctactcgggaggctgaggcaggagaatcacttgaacccaggaggcagaggttgcagtgagctgagatcgccccactgcactccagcgtgggccacagagtgaaactccatctcaaaaaaaaaaaaagatcaatgacatgaatctattatcttacttctgtcagagggttcggggtagggtgacatgtgcattcagcccctccttctttgttttgaccatggggaagcaaacactgggcttgcacttctcagagggcttacctcctactgctagaatttcttttccacactgttcccagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctgtgagtgactaaaatgcattacaggcaactctcaattccttgcatgccttcctcactagacccctttccaccctcactcttgcctccttcattcagacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggtaaggagagggcagtaactgcttagcatcagggcctgagaatgaggagaaagctgggtcagaggaggaattttagctgaatcagcaagaaagccaaagccgggaaaatgagatgattcagactttggagtcagggctgatctgggtttgaatcctagctctgccatttaccacctatgaattctggcaagtccaaccctcagttttcttgtctgcaaaggggtgataataataactgtatcataggagttgtattaaaattaaatttagccgggcgcagtggctcacgcttgtaatcccagcactttgggaggccgaggcaggtggatcacaaggtcaggagatcgagaccatcctggctaacatggtgaaaccccatctgtactaaaaatacaaaaaattagccgggcgtggtggcaggtgcctgtagtcccagctactcgggaggctgaggcaggagaatggcctgaacccaggaggcagagcttgcagtgagccgagatcatgccactgcactccagcctgggcgacagagcgagactctgtctcaaaaataaataaataaataaataaattaactaattaattaaatttagtaatacagttaagatcttaggacagtgcccagcacacagaaaatgcttcataaatgatcactacaattatcacaagatccttgactctgtgactctgtgactctgttttccttcaggatacatcagattacctccggccagtggccttgactgtgacctttgccttggacaatactacaaagccagggcctgtgctgaatgagggctcacccacctctatacaaaagctggtcagcagtgccatgccctgccccttgctcccaacactgccctccttcaagagaaaagggagggagggagaagacatgagatcatggtgaaatctgacctgggctcctctaatcaaaatatacccacttttgtcttttcactttccccctattctattcctttcctccttgctttcctctcaacccttagccccttccctttcttccaggtccccttctcaaaggattgtggccctgacaatgaatgtgtcacagacctggtgcttcaagtgaatatggacatcagaggctccaggttggatggacatgtactaggcaaaccagggtgacctgagacagactggaagggactcgaagggcgggtagggggttgtttcttacccatgataacaaaagtgagacttttggcactcccctccttcaactcctggtctctccctcattcatcattcccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcaggtgcctttggaggagggggtgtgggagaaggaaagaaaggaggaggaagaagattggggtattggcctcagctgtgaggtcctctagagaaaggctcagtgtttagaggctgtgggtaggacagcagttgcagccccagctccagcttctatctccattcccctgccctcagagagagagcccaataaaggtggaatgtgccgccccttctgctcatgcccggctctgcagtgtggggcatcctgtcttccagactggagccaaggtgggttggggtctaggatgaaaagagggctctaggagggcagaggctgggatctgagggtcctgggacttcagggaagggggcgcacaagggctcctgttcctctgtagttgttccatgaggaagactctaccattaccctgtgtcccctgcccctaggtgacctttctgctagagtttgagtttagctgctcctctctcctgagccaggtcttcgtgaagctgactgccagcaggtgagaatgaagggaactttcttccagacctctcctcctactgagtcttgactggaggggtggggaggaacaacattgattcctctattaacagagaagggtgtcttctgaggaggggttgagatgtgagcctctcccctctgaccctacagtgacagcctggagagaaatgggacccttcaagataacacagcccagacctcagcctacatccaatatgagccccacctcctgttctctaggtatgcccagcttctagggtgggacccagttctgacctcagactcatacccttatgctgcttccctccccttccatgtgcctcagtttttccaaaaacccaagcccttgcggctgctcagtctttttgccctcaatcctattcatgctgaatcttcccttttaagcatcttactttcctaggtatagtgttttgccaggccttgggcactggagctgggatgaggggatatgggatgtagccataaagcttgcattgtctgtgtcatgttctacttctgtcttctccatgtacccccacctctttatccatgtgctggccctgcctcctctgaatccacgtctgtgtgctgatcatatgcccctgtgtctgtgttatggctgtgaccatgtacttcctgacttggtgttcacacagtgagtctaccctgcaccgctatgaggttcacccatatgggaccctcccagtgggtcctggcccagaattcaaaaccactctcagggtgagaagctggaggggtcttggcatgaggagaatgtgggggaacaacagctttgtgggaaaaggatgggaagggtctctcttggattttaatggtatctagggtgaaggggaacaaatgaggaagggtcttctgtctcccacttcttcctattcccaaccttcctcttaggttcagaacctaggctgctatgtggtcagtggcctcatcatctcagccctccttccagctgtggcccatgggggcaattacttcctatcactgtctcaagtcatcactaacaatgtgagtctggtctaggagggcatggaatcctgccaccttgagctggtggactcactgaagctggacaccacaccagctccctatctgttgggcctctgctcttggggctcttctctctggggggctttctttttacacatgtggcttattagagagaagaaaaaggtattataaggggaagaactacaagggtgtaggtatgttccaactcagccttgagtggctagcgccaccccatcaggagggtctttcaagttggatcttcctctaggcaagctgcatagtgcagaacctgactgaacccccaggcccacctgtgcatccagaggagcttcaacacacaaacagactggtatgagtcacaaaggggtgtccagagtgggaatgcaagtggagttgggtgacttgggacaagagggtaggaactggagtggggaagaagggatctttccaccccagggtcctgatctggagtgggaatgaaaatggagtcaggtgccttgggacaagactgtgtgaactagaggtggggaaagaggatgtttctaccccagagtcctgatctgtctctctctgtctcttctgttagaatgggagcaatactcagtgtcaggtggtgaggtgccaccttgggcagctggcaaaggggactgaggtctctgttggactattgaggctggttcacaatgaatttttccgaagagtaagcctttccttttctagtactccccacttctgctcctttctggaactttagcataggttttggaggtagacagacccacgttcaagtttcacttttgcctcttactagctatttgaccatgagcaagttatttcatctctctaagcctctttttcctaatctctaaaatgggaagataataccaatttcatggggttgttataaagaataaatgaataatgagctggacatatggtgaacactcagtggaagctagttattatccttgtattttcctccactgaccattacttttttttttcctgaccattccttagtgctgtatcaatcaacatttgcaggatacctaaatttaatcagttaagaatccatcacgttcctattacgtaaaaggccctgtattaggttgacactgagaatatctccaacatttagcctcatgcctaactcattgtaggcgcttaacatatttttgctaaatgaatgaattattgatattacatgcaggatttgtactggggagtggtgggaagtaagattgtataggtgagagggatctagattacgaaaggcctctgaagccagggagaaactgaacttaatatgacaggtagtgaggagtcagtgtgagttcctcctgggcagggaaatggcatcttaattgtaatggctgtttggcactaaggtcaatgttgtgctttcccatatctacctggaataacacaagatccctgggatgtcatcatatgttttagggaagttaagtccaataaaccacccttctccaagtctctgtccttctttggtatctttttttcactagtctattcatgctttcaacaaagatttattaagaaaccactacatggccgggcgcggtggctcacgcctgtaatccctgcactttgggaggccaaggtgggcagatcatgagatcaggagatcgagaccatcctggctaacacggtgaaaccctgtctctattaaaaataaaaaaattagccaggtgtggtggcaggcgcctatagtcccagctacttgggaggttgaggcaggagaatggcattaacccgagagatggagtttgcagtgagccgagatcacgccactgcactccagcctgggtgacagagcgagactccatctcaaaaaaaaaaaaaagaaaccactacatacttggtactctgctatctagtaggcactaaggacacaaaggttagtaaggcacagcctttaacctagaggatcttatagttcaggagtgaaaaacagaagtaaacaccagtgttggtgggggttaggaggaatgatttccctaaatcccagaggggatgacatctaaacttcaatctaaaggaggggtagaggtcagccaaaggaaagaggagtagaatgcatttcaggtaaagcaccagatgtattgattgtccttggaaaacaaacagcagcagcagatgtgaccaggggttttccatctattacccttcctctcttttcccattggtcttcagccttttcttctggtcttgagagccctcaacattatgcctctcagcctcaactttgctgttgggattccaaagaactatatcacctgataatggctcattttaaatgtcttcctatccacttgttccataggccaagttcaagtccctgacggtggtcagcacctttgagctgggaaccgaagagggcagtgtcctacagctgactgaagcctcccgttggagtgaggtagggctggagaccgagtctgagagctgtgaaaataatgatgatgggtatgtggtagggccacccgtgggctttttcagaacgaaggcatctccatcaggcagcaggatcctagtgttccactgccgccattcctgcctcagtttctttcctttaagtagcaggaggttatttattctatttgggggctggctttgatataatgtggggtgaggctagctgggttataggatgcatgtagaaaactactcttctgtccacgcagagcctcttggaggtggttcagacccggcctatcctcatctccctgtggatcctcataggcagtgtcctgggagggttgctcctgcttgctctccttgtcttctgcctgtggaaggtaagcactgctttagtggggagtgtggagcatgatgcccatgagttgagggatccttgattatagcagagagaacaggatttgtgctgggcagctaaccaggctgtggatgtcatgcccagatctccttcactgtaccccacaaatgttggttaaattattctaagccaaataaaataaatttgaattccatttttggaaacagaacaaaagtgaagacctcagataagtctgagagctactggcaaggttcccagtctaggcatttggcagtgacgcttatcttttcttctacagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgacttttggctctatatgtattccctaggatatagactgctcagtaatagtgagaggtagatacttgttttgcctgggattttacagagtggagtccctggaaggcaaagttaagaagtattttaaatgttttctgtggctttcccacaggagatgtattctagcctcctgtaattctcacctgcttaagtgaccagaaagtataaaggtctgggaagcacagaggtttagattgaaatcctatctgccatttattagctgtatggccttcagcaaatcataacttccttgaggctcagataataaaaggctgtgtattacagtggttaacaatgaaggcagatttgggtttaaatctaggctacacaacttaaaaagtctgtttgacctaggacagacttaacttctctaagtcttggctttctcatctttaaacctattagggtcatgaagacaaaatgaaataatccaagaaaagtgagcatttagtaaatgctcagtaaatggtaactattattataaaactattttgtcataaaataatctaccatatcatgccttgtgaggattaagggagaaagtatactggagcaccaggtggtggtgttcctgctctctgacccatctcccagattgtgaagatgtgtttctacgtgctgttgtctcatccactaaatcttgtcctatgcctcatcttttttttttttttttttttttttttgagacagagtctcgccctgtcgcccaggctggagtgcagtggcacgatctcagctcactgcaacctctgcctcctgggtccaagcaattctcctgcctcagcctcctgagtagttgggactacaggtgtgcaccaccatgcccagctaatttttggatatttagtagagacagggtttcaccatgttgaccaggctgatcttgaactcctgattcacgtgatctgcctgcctcagcctcccaaagtgctgggattacaggtatgagccactgtgcctggcctgcctcatcccttttgaaataagctctttgagccctctaaggtgataattagctgaagaatttaaggttctaatggtagagatcaaatctatttgattccattaagcaggtatcttctaggctcctcttgagacacccagagtttttccattatcctgagagaacacgtgcacttaagcaatggccttctagagaccgagtctctgcctctattgcctaaccctgagaattgtggcctgtctggcctatttggcatgaacaccattctgtgtcaacctgctgagttgttttgtgacaggaaagggtttccattgtgaccctcagtgcacttcatacaggctgtaacttgatcagcctttatggagcacacagtttctagggctgagaccgcaaccagattatgttgacagactctcctctcctctttaccctcagtcagcccccaaatggaggtaggtttccttgagtactggttcatctaatgctcacacatatatacatatacacacatatatatgtgtgtgtgtttgtgtgtgtatacatatatatatatttaaattttttttagagagggggtctcactatgttgcctaggctggtctccaactcctggcctcaagcaatcctcccgtcttggcctttccacatgctgggattataggtgtgagccactgtgactgacctcatgtaattcttttttttttttttttaggattaatttcttttatttatttatttattttattttacttcaagttctagggtatgtgtgcacaacatgcaggtttgttacatatgtatacatgtgccgtgttggtgtgctgcacccattaactcatcatttacattaggtatatctcctaatgctatccctccctgctccctgacctcatgtaattctttatccatatgattaagagagcacttttaatatatttttccaactagagattcccctcctatccatcgtcagctccagactggggctttctctaaacccaatcttgttacccctttctttgcaatagtattagtttaagaagcaactgtgtattgttccttcctttccttgttgttgctcctttgcttcttcattaatttttttcattcatttattcatcagatatcaagcacgtaatatgtgcttgacaatggcaataatataaaacacaactaccatcaaagagtccagtccagtagcagaaacaaacatgtaaacaaatagtggcaaatacagcctggacgcagtggctcacacctgtgatcccaggactttgggaggtcgtggcaggtggatcacttgagttcaggagttcgagaccatcttggacaacatgtgaaaccctgtctttaccaaaaatacagaaacaattagctgggcatggtggtacgcacctgtagtcccatctacttgggaggctgaggtgggaggatggcacgagcccaggaagtggaggttacagtgagccgacatcacgccattgcgctgcagcctgggtgacagagtgagacactatctcaaaaacaaaaaaaaatggcaaatgcaaagaggtggttgctatatatcaacaagcactaggagtatgtcatacaagaggcatactttgttgggcggtgggggtggcggggttgtaagggaaaactttatagaaaaaagaaatttggctgcggggttgttctgtgcaggaaacgcacaaggggagaagaagagacacacacaatacctttaagggtaaacaagctttatcccatgtaaatggcaatggagatataataagcaaatggtacaagcaaattaatataataagcaaattatataataagtaagcaaatgatataataaacagattgatataataagcaaattgcaatgggaaggggagaagggaaaagatgtttacattcaccagactatggaggatttaccaccagactggaaagcaacagcctgggttccagagttgaacaccgcactcataagactatagaggattcaccaccagactgagaagcaacagcctgggctccagagttggccactcatccatgcacagacgaggagaggtctcatgaagttttggcgcagtctgggaccctagctctttttgtaacgagttgtttggcatgaggcccagtcacggggcccttggcgactgggctcaaggaacacaaaacattcaacttatttttgcaattgtctattgtttttcaataactaacgtgtaggaatagattgaaatagagatttctccaaaacagtgctggacgaacacctcaaggggctcacacaacctgttctgggacttggtgaccattgtttctgtccacgttcaattgagttcaaatttaatatttaacttttccaccgcagggatcaaatgtgacaggaggcattcttgggaggattaatcaccagctgcaaagggaattgtaaattagaacagtttgaggcctggtgctctgggagttgaggtgaggagaatcgcttgagcccaggagttcaaaaccagtctgggcaacatggtgaaaccccatctctaccaaatatatgaaaattagctgggcatggtgatgtgcacctatagtcccagctactcaggaggctgaagtgggaggatcccttgagcttaagaagtcaaggctgctgcagtgagccccgatcatgctatcacactccagcctgggtgacagcgagaccctgtctcaaaacaaaaaaaacaaggccaggcatagtggctcacgcctgtaatcccagcactttgggaggccaaggcaggtggatcacttgaggtcaggaatttgagaccagtccggccaacatggcaaaaccctgtctctactaaaaatacaaaacttagcgggcgtgatggcacatacctgtaatcccagccacttgggaggctgaggcaggagaattgcttggaccgggaaggcagaggctgcggtgagtgagccgagattgtgccactgcacttcagtctgggtgagactctgtctcaaaaaataaaaataataataataaaaaaagaaacagtttgagtggctcttttgtgtgaaagtaatgagagatgggactgggaaagagggcggcagcgtatgactcctgaagagccttgtaaaccacttaagaactttgggctttaccctgtaggttttcatatgcattttagtgagctctctccggcggggagaggagaaaagaaagacaggaagaccagttggctgcgactgactgttcaagaattaccaagagcctgaacttcaagggcagtggaaataatgaagacagttttttgtttggttattttttgtttctatgcgggggcgggggcggggggggcagcttaaaataaaattgctctcctcgctctctgctgttttctaattcagatgtgcgtttaaaaattgagcctgggccaggaatagtggtggctcatgcctataatcccagcgctttgggaggctacggtgaggagaatcgcttgaggcctggagttgaagaccagactgggtaacatagagacactccatctcttaaaaaaaaaaaaaaaaaattagccaggcgtggtggtgcatgcctgtagtctcagctactcgggaggctggagtgagagaatcccttaagcccacaagttggaggttacggtgagctatgatagcgccatgcactccagcctggccgacagagggacagattagagacactgtctcagaaaacagaaagaaaaaataaaattgaacctgatcacctttccttaggttttgtcccccaggttaccgtgggccgcgcattatctctgctctgcttaacactacaatctcctatttccgaactgctctcttcaaatgctcttttttgcttgggtttttggccggggaatagtggcgggggagaggcggggggagttggcgggggcagaggtaactttaccagtgattaaatgcaaatgcgacagtccgtgagaccgaagcccctggtagaagccgggaccctcctgcctctggctgccgctctccgaggggcggggctgaggcggggcttggggcggaggccccgcctggaactgagggtggggcgggtccgggtccgggaggagtctcagctggagcccacccggttcctttcctgattgagcaggtcggatcccagggtgggttcagatttgaagggcgaggttcgaggccaagcccccgtcgcagcctaagactgcgggcttttctcctctgcagggatggggtagggcagggccaggggcggagttttgagcccagcccttgggttcttgcctctgattgagcagggcgggttctgaggcggatcgtggggcggggcccgctctgctttttgacagctgtctcttgcacagccgcagccaagtccggtgggttcgggaacctgtggcccggctctctgcgcgtccccatcccccgtggccccgaccccggccatgaagcgtatcttctcctgctccagcacacaggtggcggtaggtgccaaaatgtgtgggaggatggggttgggatcccagctctgtggtgacagaagtctttagtcccgtctcaatgcatcatcgccttttctttttatcagtctttctagctcttctagtcttgcaaggaagcccgccagctttgccttcctcaagaccctgccctgcagcttctgacttgccctgctcacctctgccatccccaaggccctttccccggcccctttcttgtcctcctagcatctacacccccgatttctggttcgttttctgcaactctgtccccttcccatggccctgaccctacttctgctccgtctcccagtaccaaacctcccccaagcatcttcctcagcccctgcctggcctcaagctccattctacaccaccaagtcatgccccagagccccatatttcatccctgccctgtccccgcaatcttgccttccacgtagctctatccttgctgtttcctgttagttcaacaagcactcccagccctgtgccttctgctaaccctttttcacaatctcctctgtcattgcttccctcctgccccatgccactttcactcccatctctcaccagcactgctgttcctcaaacatcactccaaacctttttccaattgatgctcccacaacagcaaccttctgttctcccctccaacctctgccctactctgcccagtggtcgccagtcccacttttcctcctgcctgcttgctgtgagttaatattgcagtctggtcagcctcacaggcactgccagaggatgcacagttgcctgactgctccccagaggactgggtgagttgcctgcagagtccaccccagccagttcactgcagtgtctgatcatcagactggttcttgggccagtcaaggctcaaggcctttctgcctgcttttccccagattattcatttcctgaacccttgcccagttgcttaggaatgatactctctgtttcctttggttgaggtgggggaaagtgatgatgagagaagaggatagagcagactcagagttcccagcagaagtcactctattccccatgttctcccagaaaaaaaaaaacataagattatagaaggtggtggcttagggagggtattgcttcttcttctctagagatctcttacagagagcccccttatttggaaatggaattttctgtagaggttggggttacggctaatttagaagcaaattagccagctacttgtagcaatattgctttgctaacttgacttagtagtatcgttcataagaaaatatcagaaatgttcaattagctcattctgcatgggcaggttacagaatcctggaagcaagctatgaggcaagagtatgaactctgttgaggcctgtccttgtcccacttacatttgcatctctacttagtttccacacattgatcaaccaatcaaaaggtatttactattatatgcaccagaaactgaggctgcccagactcagtcttaactcataatgactttttagaaattcatatggactcttccttagttactgaaagtattcaatgttgcctttcccttacaggtttgtggagtctgcctgcttcttaggaatggggaaactatttcattctttctgatcccccaatccttgggcagtacctcctttccaaggtgctggaatgagtgggctggcttttggaatttggaaccatccctctgtcctccttgattctagctgtacagaggtttgaccataaagaatgaccacccattctaaacttttagtataacaagatcttactataatgagattatgggaagtaagttggatgggtttagaattatctagctggaaagaaaactgtttcttcagacagattggagtcatagaaagcttgcaaatagggcagtttcagctgcagattggttcctcatgaaatttccccacacttctcatgataaattcctccactgttttgggtggcaaactactctggaaccatttgtcagagaagtagtgtggcagtctttatggccactccaaaagcctggcttcccagtcacactggaagactgcctctacccatctccactcacacatttgggtccagggccagagccctgcactgtcagtctgagtaaggactgaaaaagcagtgatcattttaaagctaatctaagttaccagtatataggaaaatccacacacaaaaaaaccccaactcctataatcccattttattttagtcaagtagaggatatccttgagggtatcttacctatgagcttactctgcctaggtagaccagaagtagaccagaagagagctttaaataattggcactggatcatctgggcgcagtggctcacgcctgtaatcccagcactttgggaggctgaagcgggtggatcacctgaggtcaggagtttgggaccagcctggccaacatggcgataccctatctctactaaaaatacaaaaattagccgggtgtggtggcaggcacctgtaatcccagctacttgggaggctgaggcaggagaatcgcttgaacccgggaggcggaggttgcagtgagccgagatggtgccatcgcactccagcctgggcaacaagagcaagactccgtctcaaaaaaaaaaaaaaaaaaaaaaaaattggtactgtctactgcaattacaacgttgagaattaggtcctggttcccctttctgtttccactcacctgacctacagcagaagtcattccttctctctctacttgctggtgtgcttccatgttataggatgcttataggtacacagccagagatataaggagaaggtacaattacttctacaaaagtcctctaatctcagctatggaaatacaaagcttatacttattgagtctgctgattaatttggtgattgctcccttgaggctgtgatggtaatctagtgcctcctttccaaggtgctggggtaagctacagactggatcttgacatttgaaagcatctctctgtcctttacttcagctctgcagaggcttggccatgaaaagtttctacccattctaaactctacttagtataatgagattataggaagtaaattgggtggatttagaactatctagctggaaagaaaagtacccaggccaggcgtggtggctcacacctataatcccagcactttgggaggctgaggtgcggaggatcacttgagcccaggagtttttgagaccagcctgggcaatgcagtgatacctcatctctaaaaaaaaaaattacctgggtgtggtagagcatgcctgtagtcccagctactcagaagactgaggtgggaggatcacctgagcccagaggtcaaggctgcagtgagccatgatcatgccactgcacttcagcctgggcaacaaagcaagactctgtctcaaaaaaaaaaaaaaaaaaggaaagaaagaaaaagaaaaaagaaataaaaagaagtggaaagggccaggcgcggtggctcacgcttgtaatcccagcactttgggaggccgaggagggcagatcacgaggtcaggagattgagaccatcctggctaacatggtgaaaccctgtctctactaaaaatacaaaaaattatccgggtgtggtggcgggcgcctgtagtcccagctactcgggaggctgaggcaggagaatggcgtgaacctgggaggtggaggttgcagtgagccgagaccacgccactgcactccagcctgggcgacagagcaagactctgtctcaaaaaaaaaaaaaaaaaaaaaaagaaggggaaagaaaagtatctatattgctaagaagcatctttaccatctgtacagcttggctgttattcgctggctagtatcagcaagatcccttccactctcctggctggagaattctgagcccaggaacatctaaaatgtgctcaggaaggatggattgtgcatctactatgtggcagacaccgagctagatgccttataggttgttatagtattaggaaactgaggttcagagatgttgttacatgcctaaattcacagaggcagacagtgttagagtcaagacttgaaacatttcgagaactgcaggttgacgtcagctgatggcagcaccctgtcgtggggcatagttctagctctctgctttcctgggggtgacctggtctccaaaggccattagaaaatgcgttcttacatgtcagagtctgttagtatgtgaaggagtcattttgcttattttgtcctttgagagttaacctgtttggagactccatgagacagtagagtctgagggtgggtggctttgccctggaggcaacttgagactgtttatctggaaataagtaaacctgtttctatagcttgtagtagtgtggtctggtggggagagctaggatttggcatcaggtggactgggttctttttttgtttgtttgtttgtttgagatggagtcttgctcttgtcacccagactggagtgcaatggtgcaatctcagctcactgcaacctccacttcccaggttcaagcaattctcctgcctcagtctcctgtagctgggattacaggcaccggccaccacccccagctaattttttgtatttttagtagagacggggtttcaccatgttggccaagctggtcttgaactcctgacctcaggtgatccacccgtcttggcctcccaaagtgctgggattgcaggcgtgaaccaccgcacccagccatggcctggattctaattccaattttgccactctttttcgtgatcttgaatggttatctaatcttggtatacttctgtttcttctgtcaaagagatggaataatagccctagctactttccagggatgttgagagactaattgaaatagcatgtgaaaggactgtgagaagttacaacttctgtacaggagtattacctcagaatccatctaccttagataattttatggtttggatatttagagctttcctgtggttgattaataatttgccctggctacgtaaacagtgtttgaaaatgagttactgggcttccacagaccctatttttcttcacccctttctatagcctcttgttgagattataccttataaaatgctatgtgccaccaccaacaccccactacttcctgttttgttacaaggatgccatatatttgtatggctctttacagtttataaagagattttgtatatattagcttgtttaatagtcacagcatgatgaggtagttgttattagccgtattttatagaagaggaaacaggttaaaggtgtttaatggcttactttaggtcacatagccgagaatgtagctgaactaggtcccaaactcaggccagccagcgaaatatttgtctggcagcctttacatcagaccacagatctttgcatctgtctcttccttttcattcccttctctggacaaaaccaggcttttctgtactttcagccctgggtgtttttacatagctgtctcttttatgccctataacacttcaattattataattaccctaccacccacaaaacccaagctggaatgatagaacaatgcatgcccaggtgtggctgttgtctagacagctgctccctgccagggaaactgggagggaggagaaggggagctacctcttgctgcttcctcaaacataactagaaacctctttgccttttggttgttgttgccatggaaaggagagagacggtcgccaaagggcctagatatgatatgggaaaacagaaactctagtttcctcttttaactgtggggcccaaagccaatgaaaagaggtggaatggttaggtattggaactcctagctgtaacctgaagctcggtcggtgccttaatgtacttctcaaacaactgacaacaaaaagcagagcagcagggtttcaggggtggaggcggtggtgagaggcaacatgagtcctcaaaagtggtcacgttggttccatttgctccagcaagacctagagagcaaaagggaaaggattgctctgaggttgggcactgaacaacaactctaatcatgatgacaaaaggacatttgaaatactgtgcattcagcactcaaatgatttttaattcagtggtccagggtccttctggctcagggctggaaataaccagcaatagttcttggtggcatattagctggttaagatttagctaggcccacctaagaaggactaaatgatctaggatgtgtgacttgtggaagagaaaaagggatgttccttttctctcatttggcatcctaaccatttgcctcttttctttctccacactacccccatgccctatattcacacaacctgtggctctggaccaggtggagagatggaaccgccatgatcagaagctgctggaggcagtgcacaggggggatgtgggacgcgtggctgccctggcctccaggaaatctgcccgacccaccaagcttgactcgaatggccagtccccgtaagtcagtcctcctgcccctgccccttacatgtggctcccttttgaagcccccaaatccaatataacataggaccagggaatgcctacaacttcagagctcttttcattgtcttaattagcaagtatatcaatagttttttgctacatataagttctacacaaagtgaggaaagaaaatattgttcctgagctccatccattgcacaacccagattgacaccactgacttgtaaagtacataaagcccattaaacaaacagaaaatgaatatatacactaagtagagtgtttcttcattgcacaagtaggagggtgtgtatgcatgggaaatttgaaatgaagtggtagcatgggagtcacatggctagagggagtagtgattaagtcaaaggaaatgttatcccttgtctctacccaaagccttcgaatgtccagccttcactctgctctggctgactctttctgtgacacttccacttccgctaaggttctgtgctcagagaggcaggtaattatgtgttccctagacacccctgcaatagtctgagattccttgagacctgtagctcttatttcttccttgcttttagcatcctttgtgattggaggccatatagacttctctttctcagaaattcaagctaggggagcttcttttcctgcttttaggattggctttggggtagggagcatagcaagaagggcttatcaagattctcccattcctcatccctggtccctttatcctttggcctctcggccttgattctggcaggtttcatctggcagcctccaaaggcctgacagaatgtctgactatcctgcttgcaaatggggctgacatcaacagcaagaatgaggatggtgagtgagccggagcactgggccacgctgcttgcttgcccctggtacagcagcagtcgggggcggtgctgggccctgctggacattcctactgtggccccttgcttctctccttagtaagttctggccagcatccttccaggagttcccctccccgtaagctgggcacacctcacccccactcccaccttcatcacaggtaccaggcacttggggaacaggaatttctggccccgtgtggctgaaagcttctctccctaatctcctgattatctgtgcgtctcttgccttccctccctgtgagtcatcagcatgcatggggccacctaccctccttctccccttctttctgttccaggaagcactgccctacacttggccaccatctcctgccagccacagtgtgttaaggttctgcttcaggtaagagcagtcccttgataccactcttatgaagggaagaagtggtcccagagttttctaacttcatttcatacttaaaaggaatagttggccaaatgtactcgcctcatccccaataggagggctgataatcatttgtttgccaacatttatttaactactatgtgcaggcaccatgtttgatagtgcctttgagggcaggttataaagcagagttgccaggcactatcgattttgtcattagcagagccactgcagagacttcctgctatgatgaggggcaagaggaaggaggacagagatgttcaaattaaaccaaagccctactgtctgtttctgaagagtttatagtctagtagtataaagagaaatatacatgtaaaatgacatgtggatcatttataaatgagtctccaaaagcacaaaaggcagttactggccgggtgcggtggctcatgcctgtaatcccagactttgggagatggaggtgggcagatcacaagatcaggagatcgagaccatcctggctaacacagtgaaaccccatctctaataaaaatacaaaagattagctgggtgtggtggcacgtgcctgtagtcccagttactcgggaggctgaggcaggagaatcgcttcaacccaggaggcggaggttgcagtgatccaagatcgcaccactgcactccagtctgggaaacagagagagactctgtctcaaaaaaaaaaaaaaaaaatcagttatcttaaccggccatcaggcaaatggatgttctactttcgttcttcctaatcctttccaaatttcacaattatgtttctaaagtaccagccacggggacattgggtgtcattttccctaacacgtttattaccatctgatttttcttagccccttggtttagaaaccagggctgatattcaaggctgcctatcatcagcaatggatgaactgggcttgcctagtagatagccttctccaaagtggacctcctgcccctcctcatattaccatggaaattggtgacccaatgggggtatgggatgaggatgttaacaccaagctccatgctgcttccctttgtggccatttgcagcatggtgctaatgaagatgctgtggatgcagaaaaccgtagtccattgcactgggcaggtgtgtgcaggggactcatgggaacagggctgcagagactacagggtgggaaaggggaggcgtgaggagggaagggcagccagggccaaccaatgaaatggtcggaggggatgttgggtcatagtctgagtaggctttcttcatgcttccccttaacccaaacatcttctccccagcctcctctggctgtgcctcaagtgtgctcctgctgtgtgaccacgaagccttcctggacgtgttggataatgtgagtgtcagatgggcaagtgggcagtgtcctacacagaagggctgctgctctctctcagcttgactggccaacttccatgacctagggctgtgttagcaccacccttctcttccttctcctcctgcttctcctcttcttcctcacagagaggttaagccttatcttctggagagcttctaaccctccaaaagggagtgttcagacccaagatctgggcttttattttttttggacaggtgtgaggggaggggagccggtaggattgtcaagcctctgcagtccctggctgctcatgaacctcttcctacaatctgtgcaggatggacgtacacccctgatgatcgcatcgctgggtgggcacgcagctatctgctcacagctgctgcagcgaggcgcccgagttaatgttacagacaagaatgacaagtgagcccccctcgtctatgcaccccaattcccatgcctgaccaatttagaaagaagccagtgggcaacgtgtgtgtgtgtgtgtttgtgtgtgttggggaagaagtcaggttggtctttgtgttcttgggaacctcattccttcccagtggaggttctgaagagctctgcctgctgccaccaccatcttcatagatagatgaccccagaagtagaatcgacacttctggacccgttggctgaatttactggttgtcaaattatcttttatgcaagaggatccttttttccaataaaaaatgtatgtagaatccctgtgatcccagcactttgggaggccaaggcgggtggatcacgaggtcaagagattgagaccatcctagctaaaatggtgaaaccccatctctactaaaaatacaaaaaattggtcgggcatggtggtgggtgcctgtagtcccagctactcgggaggctgaggcaggagaatggcatgaatccgggaggtggaggttgcagtgagccgagattgcaccactgcactccagcctgggcgagagaggagcgagactccgtctcaaaaaaaaaagtatgtagaaccttgatatacagagcagataaaaatggagctcatccagttggccccctaatttctgttcctgcagctctaaggaatggcatttgaaaagcctagtcctggcctggtgcagtggctcacacctgtaatcccagcactttgggaggctgtggagggtggatcacctgaggtcaggagttcaagaccagcctgaccaacatggagaaaccctgtctctactaaaaatacaaaattagccgggtgtggtggtgcatgcctgtaatcccagctactcgggaggttgaggcaggagaatcgcatgaacctgggaggcagaggttgcagtgagccgagatcatgccattgcactccagcctgggcaacaagagtgaaactccgtctcaaaaaaaaaaaaagagaagtctagtctggtctaatgttggtctgttgttctcctgaccccactgaatgagagcttaccctgtgagtggaatgtctggaaccaggacttctgggttccatgtggaaagtctgtgctcagatttgtctcaacccacagatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtaaaggcccttgtgtaacttccacgttctctaagaatcagagaagtttcttagagtcccatttgtttccatggaagtaatctatctgacaaataattgtcacctgggttgagagtttacgtatttattgctgctactgtgagaggaccccaaatccccatcccaaaagtatgatcacaaaattctttaatgcagcctggtctctcactgaggacagctctggctagtgttgtttctggcgtttgtgagttgtaattgtacatctatttgtgtgatttgttggtcactctctctttcctctaccagattgtaacccccttaggtgacaggccatttctgttttgctcaccattgaagttccagtgcttattaaagtgctggacatagtgaccaataaataaatgagcgaacaaaatgaatgaagtggcccatttctgggataggaaaccaaagttgctggatagttagggatccactaaacaagattggcttctggcaccaggaagatgtgcagtgagattgatcacagagaggccactcctctcagaaaaagtctgaagataagaatgtgggctggaagtacatggaacctgtcttctctctcattttcctcatatcttttcttataggtcagaggctagtccagcacccagatctcgcatcccaggtaagaccctaagtgcctcccccttttgcttttgacacaccccaggctatcccactgtgactattcctagtggtccttggggtgtcaagacatttaagagaagaaaggcactcctagggctcagttcgttgcctagtggccacactttactattctgtttccaacataggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaaggtgagcagctgaggtagccctggggagcactggggaaagtttctgtgtatttgggagtttactaacctgaatccagcaacctttattgcagcagtgggtcagattaataccccaaacggagcaccagtcctttgcagggaccacactactatgttctcgtgggtctgagggggttggtgagattggaggtgaggtaaggtataagtggaagagagaagggggcttaggtactaaaatttggcacccagattcagaagcagtgtgctcagggctgccaccagtgcagcaccatcgtttattagcatttggacttgaattgcatattagcctgggaagaggcctaatagcatgatgggttgctgtggttttactgaagttctgaggaggtcactcaagaactaatgagttaagaaaagtagacccagcgagagctgctcttctcgcctccacttcagggtgggttctacaaaacgatgtccattggcaaagagggcaccaatgcaaagaaaaaaatcttgaggccgggcgcggtggctcacgcctgtaatcccagcactttgggatgccgaggcgggtggatcacctgaggtcaggggtttgagaccagcctgaccaacatggtgaaacccggtctccactaaaaatacaaaaattagctgggcgtggtgcgggcacctgtaatcccagctactcaggaggctgaggcaggagaatcgcctgaaccagagaggcagaggtagcagtgagccaagattgcaccattgcactccagcctgggtgacacagcaagactctgtctcaaaaaaaaaaaaaaaaaaaaaaaaaaaagaaaaaagaaaagaaagaaagaaagaaagaaaaaaagcttgaaaaccactattagataccagagtttcctaatgcttgctctaaatgtgagtctacatgtttctatgagacatgttttatgaactctaaatatcaatttacacatggatttagtacttccagacttaaccgtgaaatgaatgatttcagacttcttattaaaacttggatacatggtcaaatttagaatgattaaaaaatataaaaaggccgggcatggtggcaaaaattagatgggtgtggtggcatgtgcctgtaatcccagctcccaagaggctgaggcaggagaatcactggaacctgggaggtggaggttgcagtgagccaagatcgcaccactgcactccagtctgggcaacagagcgagactcctccttctcctcaaaaaacgttatatatatatatataaaagaatgtatgttttctatagtgtggagtacataaaaatagaaggaatgttatccagaataggaatcagtgcgggttgaggttaattaaagaaagtatttttatgttgcattgaaggagaagttgaaagtagacaatcgggtgaaagcaaacatagtgtcatggttaagaatgtgttctctggaccaagattgtctgatcttgggcaagttatttaacatctctagtcctcagttttcttatctataaaatgaggataataaaatggttgtgaagattgcattaaataagaaattatatttatttaaaagatttggggctgggtgcggtggctcatgcctgtaatcccagcactttgggaggctgaggcaggcagatcacgaggtcaggagatcgagaccatcctggctaacacggtgaaaccccgtctccactaaaaatacaaaaaaattatccgggcgtggtggtgggcgcctgtactcccagctactcggagaggctgaggcaggagaatggtgtgagcccgggacgtggagcttgcagtgagctgagatcgcgccactgcactccagcctgggcgacagagccagattctgcctcaaaaaaaaaaaaaaaaaaaaatttggaactcttggcccatggtaagtactcagtaaaaggtagctatcattattcctactaccactattcctattactgctagttaccattaactgcatttgtgcctctgcctcaataagccataaggactcatctccatttcccttagtggtcagtagccaggagtaggttaggatctgataccaagttaagagcatcggccaaggagtcaaagagattgtggttcaaatcatgatttcatcacttattagctgtgtgattttgacaaattacttaatttagtctctttatctacaaaacgtagattataatacttccctcaggcggagcacagtggcttatgcctgtaatcccagcactttgggaggccaaggtggatggatcgcctgagcccacgagtttgagaccagcctggacaacatggcaaaaccccaactctacaaaaaaatacaaaaattagctgagtatggtggcatgtgcctgttcctgtgctactcaggaggctgaggttggcttgagcccaggatttagaggttgcagtgagctgagatcacatcactgcactccagcctgggtggcaggtgagaccctgcctccaaacacaaaacaggctgggcgcagtggctcacacctgtaatcccagcactttaggaggctgaggtgggcggatcacctgaggtcaggagttcgagaccagcctggccaacgtagtgaaaccccgcctctactaaaaatacaaaaattatctgagtgtggtggcgcatgcctgtaatcccagcttcttgggaggctgaggcaggagaatcacttgaacctggaggcggatgttgcagtgagcagatggtgtcactgcactctagcctgggtgacagagcaagactcagtctaaaaaacaaacaaacaaaaaaaaacaaaaaaacaaacttccttcagagaagtattgttcctcccggaagaaaagctgttttttttttaaatttttttaagttttcaatgttttatcatattggatagcagctttttttttaattggttacaaaacctaagcccatatacaaaattaggaacacatttagatgcctcttttgaaagaacattttagtctttttaaactgagttttaaaaaaataaaaacaatgcaatttttaaacactgttttgaaaacttaaaagtgcagcaatatagttagtttcctttatctacgaaatggggcaattccaattcagaactggtaaggtcacaaattgaatcaaggaaatgcatacaaatgtctgcactacttgatgctaatgttcacttaaatgttagtttgcactttaaaacatgagaggaaataggaatcatcacagtagaggcccacttttaatcataatgtgtgcaaattttaaaaggtaactgacaagtaaggaaagtccagaagaaactaaactggaaggggtatagttcacaatatcaaaaagatttggacttttaagggtttcaccgaagtttgtgaccttaattagcttttacgttgttattcctacttttagtgaacaccacacagaagaaaagctgttttgagtgttaaatgagacaatttgtataaaattggcacatattaaatactcagtaaaaggaagctgaccttgacccttgtgggagaaatgacttggagcctcattggttgcctctttcctcttggcctcagatcaaggagttgttgaagaagctggagcagctttcagaagaggttctagcaattcggggagaaaatgctcgccttgccctgcagctgcaggtatgttttggctgtcagggatggtgctggagaagaaggtcagcagtggaagtgatgtatatgtgggagacattctaggaattactgagggagacattctaggaattacagaggcctggctaggcagtggtccaggatgggccagtgatgggccaacgagcccacctggtactgctgaccacttcattgtgttgctcctcatgcttgggtgactgagggtggacatgtgacttcccattgatgttcattcccaggattcccagaagaaccatgaagagatcatctccacctacaggaatcatctactgaatgctgctcgggtgagcatggtggagttttgagggaggtatagacataaagctgagtatagggtattgcatttagggtccctctctcttctccagggtccctgtacacacttgctgtttctcggaaagctggatccagtgctaggtctctgatctcatttggtagatcaagagaggttgtgcatgaatgtgagaaggagaggtgtttccccctctgtttcaattctctggcctatagtaaggacttttcctgtccccaataccctttctcagtctcctcctggagccacttagtcctaaacaaggaagaagaggtaggtgtcttgctcccttgttaggaataataactacaaagaatggaacgaacacctattgtgtacctggtgctttgcttcatattcatggttgtaatcctcagagcaatcctgaaaagtagacatcattatcttccctgtgaagatagggaaaaagccatggagaagttaaatactataagtgaaggtatatagtaaataaatagccttccactgtaccacagaacctctccctcacctctctctctccattttctgttcttcatctccttttcttcctttcctgacatctacagggttacatggaacatgaagtgtacaatatcctgctgcaaatccttagcatggaagaggagtgaggcagcctcactgtgtgccctcagggatacgagattctctgttgtgagttgtgggttaagggtgatgagggaaggagtttgggagaaagggcttgggaaaggtgtatggaatgaaattagtcccttttgcccccgtggtggctgacaatggggagccttttggggcatagagcatttgaggtgactgagaagacagaacatggagaatcactgggtggagtcaggaatcagtgagcaggtggactaagggggctgacttatgagatggagactgaaaagaggggttgggtctggggtagggagatgccagtgaaagatgagtgatggtaggatagtggtagacagttgttccttagggcaggactctacaaaatccagaatctcttcactttgataccattcattcaaagagcagtcatcccccaaacctccccccaccccaatgcagatagtccccttctccagtccagatagatgagggtcccttttagcatgttgatatgagtgggaggagactgaggatatggaagtgggtgcatttcatctttgaatttcttctttcagggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggggctgagtgtaattttttttttttctaaaggggagtggggaaaggaatatctttcatccctttattcttttctttttttctggaaacaaatattaacagtatgtctttattcttaaaaacatttttttacaagtagattttttttttgaggcagagtcttgctctgtcgcccaggctggagtgcagtggcatgatctcagctcactgcaacctctgcctcctgggctcaagtgattcttgtgcctcagcctcccaagtagctgggattacaggcatgtgccaccatgcccagggatacaagtagattttgttttttattttgcaaatagactttatttttaaagcagttttaggttcacaacaaaattaagcagaaggtacagagattttcatatattctctgcccccatgcaggcactgcctccccaattatcaatatcctcaccagagtggtttatttgttataattgatgaacctacattgacacattattatcattcagagttcatagtatacattagggttcactcttggtgttagagagtctgttggtttggacacatttatattgacatatatccatcattatgttatcttttttttgtttttgtttgtttgtttgtttgttttgaggcagggtcttactctgctgcccaggctggagtgcagtggcatgatcataactcactgcagcctcaacttcctgggctccagtaatcctccaactcagcctcccaagtagctggggctacaggcgagcaccaccacaactggctgatttttctgtatatttaatagagaccaagttttgccatgttgcccaggctggtctcaaactcctgggctcaagcgatccacctgtcccagctccccaaagtgctggggattacaggcatgagccactgtgcctggccatctctatattatcatacacagtggtttcgctgccctaagaatcctctttgctctgtctgctcatctccccatccctgctaacccctggcaaccactgatctttctcccatccccagttgtgcttagttggaattatacagtatgtatccttttcagactggtttctttgagttagtaatatacatttaaatttcctccatgtctttccatggcttgataactcacttatttttagtaccgaataatattccattgtctgaatgtgtcacaatttatttatccattcacctactgaaggacatcttgattgtttccaagctttggcacttttttttttttttttttttttttagcagagtctcactctatcactcaggctggagtgcagtagggcagtctcagctcactgcaaccgccgcctcctgggttcatgcgattctcctgcttcagcctcccgagtagctgggattacaagtgcatgacgccacatccagctaatttttttctatttttagtagagacggggtttcaccatgttggccaagcagtcttgaactcctgacctcaggtgatccacccacctctgcctcccaaagtgctaggattacaggcttgagccaccatgcctggccttggcaattatttaatttgtttttgaatgaaattcacaaatggccctataagtcagcaactttcaaactttttgatccctagtaagaaataaaaaaaattttttttgaggcagagtctcactctgtcacccaggctggagtgcagtggtgtgatctcagctcactgcatcctctgcctcctgggttcaaggtattctcatgcctcagcctcctgagtagctggaattataggcgtgcaccaccatgcgtggctaagttttgtactttttgaagacacagggttttgccatgttggccaggctggtctcaaactcctgtcctcaagtgattctcctccctaagtactgggattacaggtatgagccactgcatctggccaagaaatacattttgtatcttgtgtatacatagctcgaataatactttactatttctcttctattctttgctaatatactccatcaaaatgcatccactaatgggtcaagacccacggtttgaaaaatagccctcagtgaaaatggggtttgacactcttcctttccactttctcgaatctgtcacagctctaatcttttttctctgccttgggactgttgaatccatgatttttttttttttttttaaggggagattgagagacctggattttcttcaggatatactttctaaagtattttatcaagtgttaaacaatgtgtctatatttgacacacatggtctcactgttctttgtcccaggtgacaaaagggatgaaaagtctgattcctgggtagaggatgaagggatacccaagtttcatttttgcctgtgattccattctcagactgaaaaaaaaaatgtatctctcttggccacttcccctgggtctcctcctctgcctgcccttccaccaggcatgctgttaggtgaaaatgaggcagtgaattcctctaaaatctggaattgcagtttggtggcccgcacgctgatccctccccattccttctctcagtccaccctctgcttggttacactgggtcagacagcagcagttttggcagtaaagaggctgggttgagaaaaaagagtggggaggggctgccatggaagacagggggctacacaagggctgcagaggccagctccagagtttggccaagagtgaaaaagagcatctgagatatctggatcagatcctagagaaggtgcagaggttttacgtggatgggcacgggactgctttacggccaggaaaatggaaaaaggagggattgatggagaaagggggaagaggtgcagctattgaagaaagatcatcaaaagggtctgagtcatttctattaaggggaacagaacctctccttgccttcctgctctcaattaccaatgtatattaaaggactattacatttcttgttatatatgacgtgtggggtggggagaatgaagaaactgtagagagaagggtccagaaagggggagatcattgggctaaactcaagaatgagtcaggaagcagctttggtaatggaagccaggactttggctccctccggggctcctggaaactgattccaggatgggctgagctatgggagtggtgagtgatgttaatgttaacacaggagtagaaacttccttagcccctggttttcccagtctccctccctaaaactccacaaacttacctcaacagccccagtcttaaaatttttcttgagttcataaatttttttccccaaagtagctataatcctaatgttccctttattcctcctgggctctctaatgggacttagcagggacttatgattcctgcttcatctccccaccccattccccaggcttgagatgtaggagtatgtgggtgaaagtaggtgaaacccgatgggccatgatcaggttcagaccatgtttttgaatgccttcaatctggaactttgcttctgattcacagtttccctcctttggtaacattaatttattaaacagatatttaaggagtctactatttgtcaggcactgggaatagagtagaggcagcacagaaaaccttcttatccttttggagcttgcatgcaggataagattcaggttccccggttccgtcatcctgtagggatgctagaacttataacctcaaattaacttttttccaatttattttttctctctttcaataactttagtaacctcaaattaattttttttagatgtattattgctctgtcacccaggctggagtgcagtggtgtgatctcagctcactgtaacctctgcctccctggttcgagtgattctcccacctcagcctcccaagtagctgggactacaggcatgcgccaccacacctggctaagttttgtatttttagtagagatggggtttcactatgttggccaggctggtcttgaactcctgacctcaagtgatctgcctgcctcggcctcccaaaatgttgggattacaggcgtgagccaccatgcctggccttcaaattaacttttttcgtttgtttgtttgttttttgagacggagtcttgctctgtcgccaggctggagtgcagtggcacgatctcagctcactgcaacctcagcctcccgggttcaagcaattcccctgcctcagactcccaagtagctgggattacaggcacacgccaccacgcccggcgaattttttgtattttagtagagacggggtttcactgtgttggccaaaatggtctcgatctcccaacctcatgatccgcccacctcggcctcccaaagtgctgggattacaggcgtgagccaccgtacctggcccaaattaacttttaaaggagattcttccttcatgaaatcactagaactcaaggtgaggttttctcttaaatgtttacagctttatttatttatttatttatttatctagagatggagtcttggtctgtgccaggctggagtgcagtggtgcagtctcggctcactgcaacctctgcctcctgggttcaagcagttctcctgcctcatcctcctgagtagctgaaattacaggcgtgcgctgccacgcctggctaacttttttgtatttttagtagagacagcgtttctccatgttgaccaggctagtctcgaactcccgacctcaggtgatccgcccacttcagcctcccaaagtgctgggattacaggcgtgagccaccgtgcccagcatttacagctttacttattttttattttattttattttatttttttgagacagagtctctgtcgcccaggctggagtgcagtggcgcgatctcggctcactgcaagctccgcctcccgggttcacgccattctcctgcctcaacctctccgagtagctgggactacaggcgcccgccaccacgcccggctaattttttgtatttttagtagagacagggttttaccgtggtctcgatctcctgacctcgtgatccgcccgcctcggcctcccaaagtgctgggattacaagcgtgagccaccgcgcccggccatttacagctttattgacgtacaactgatatacgtcaatatgtctctccatgtaaaatgcatgtatttgaagtatacaatttgatgtgttttcatatgcatatacacccataaaaccattacacaatcgagataatgaacatatccatcacttccgaaagatccccgctttgtctctttttaataatcctccctaccttcctcatcctgcaactactgaaaattcttagaaatacaaactatagtaacttttgatctagaggactgaacagaacaacagcaaaaaagatctcaggacctgatgaagactcaggtgttggaagggagcagctggaatttagaactagttgagtctgagtttagcttgaagcgctcaccaatttgggtagcaaagcagcaaggaaagaacctgagtgttaggagagggtggcatcttccctagggacaaaaaccacaaagtaactgggcctagttccagttcaactggcaccttcaatctttggcctgggtagggtcttatgaggaggattatactgaaggcttaagctaaataaaaggatttttcctatttattaaagcccttttttggtgtgctgattataggtttaacatgtcttgtctctgctgctagactgtgaactcctgcaaggcttttatgtcctcagcacctaatgatccctgataagcactcaaatatttattgaacaaatatgcagccaactataaaatgctgtgagtttctcagtatgtagtgcgggtacatttcccttaagttggtattttctgggtcaggcgcggcggctcacgcctgtaatcccagcactttgggaggccaaggtgaggcgggcgcatcacgaggtcaggagtttgagaccagcctggccaatatggtgaaaccctgtctccactaaaaatacaaaattagccgggcgtggtgacgcaggcctgtaatctcagctattcgggaggctgaggtaggagaattgcttgaacccggggggcggaggttgcagtgagccaagtcgcgccactgcactccagcctgggtgacagagtgagacttggtccccccccaaaaaaataaaaaaataggtatttccatggatacagaaacagatttaatttggtgcctgcatgtgagtgatcagcttggttgggatggggcctctggagggtccaaggctttggaggaaggagagtgggtaggcagttcagagagggacagaaagatcccttttgtgggtaagaaaacccctctgttcatcttcagctacaccaaaggtatgggggctctggtggaggtattctgcacgtgtatctagggtagttactgttaggtacactttggattcagtaccccaggctttgccctagggagggacagttgtcatttcaaggaagactgctttatactgtcagatacctggttcacaccggcttagcagcagtgtgccaccaccccaatcccatacgtaagcgttgaggggtcacagaggtagtgagaatgatgggatccaaggatctcgtctctccagatccactcacaccaggagttaatctctccaacgtcgagctctgagtccctccctctctcgcccgagctccgccccccttccctcttggcggtcctggcgggcttcccctggagggggcggccccagcccgagcgctaggcggggcggagctccggcccgggcggagccgcggccgccgcgtccggctgctggaccgaacttctgccgtgcggacagcaggagcagcgccgagccccattcccccacctctccagctcgccctctgagcctcccgagccctctctccatttcccacaattgtgctggtaagtcccgctccccgcaccaaacttttttttgctgccgagtttgagtcctacgatcggaccacgagctgcactgtagttggtgtatgggggaggaggagagggtgaattactgaatgccgactccacggcttccctaagacggatcagcgctcgcccatttcccgagttggaagacctctcgattttagttgattaaacttatgcagagatggagatgagggtttgcgctccaacttcgctaccccctcccccatttctctgagctctagcagttcccgatactttccctccatctttcaagtatctttggctccctaaaagcttgtcccctcccaactctgccgtggcaaagcccccctccaccaggcacttcgggcccgcctcctccccgttgccctagggaccccgcgatcttgggggccatacactccctccggggctacgcgtcctgccaaccggccgcagacgtgtagctgctgggtcggctgtggagggaggggctcaggctggggcttgtccgaagccaggcgggcggggccgggaaggggaggtatagggggccggactgggcggagcaggcggcatttgcggccggcgccagggtggagagttgtgcgccggtccctgggcctgagctccggctccggctggggcgcctgcgatgtctcaagatggcggagctgggcgaattaaaggtaccggccccctccccccatccccatctggactcagcccggcggtacgccgtgtccgggaagcgaccgagactgggtgccggggctcgggtgggcgccgacgacgtggcaggcacgagctgctgaggatgggagagaagtagctgagagcgaggaaggggctgcggcggggctccgggggcggggctgcggggcagatgtaggggtggggccgaggggaattgcagctgttgggggctgaggcgcagggggcggggacgaggggtagaagtcggatttagtagtaggggcggttgttggggtagggccagggggaaaaggtgctgtagaggcactgggggcgagtcgatcaaggccaagagatgcaacagtagggggcacatgcagggatgggaccgcggggcagacgtaggggaggctccgggggaaaggcagctgagaggatagggtctttggggtactctcgggatccgagctttgggaaataccagtaggctgctgagatgcagggggcggggctgtgcgggccgatacctcgaggggtggggcagaagcatcctggaggctcagaggaaggtcctgccgtagtgaatcgcggtgtttgggaagaggcagaggcatgtgaaactatgggatagaaaggtgggaagttataggggaagctaatggagaaaaaaagacaggacagaggagataaggatggggagaaagaggagcaagtttctcatcacattccataaaaggggtccaagacaaagcctcctatgagaagaattgtgtagggctagcaagccctgcacatgacaggatctcctagagattcacagaagggagtcttctaaggagagcgctcccctcctgctacatagagtttggagggtgaccacatctgaggacatctcatagaacctcaaactaccgagttcatccgcctgcctcctggttttcttctgccctttgaaatgggagctatggtcctgggaaggctggaggtctagccactgggcccagctaccttcaggggatttgcgattctgtgccctgactcagaggcttttccttcatccacccagggtctctgtttagagctctgccctctcctcttccacccctataggggggcgctgtaagttgtagaggagtattaatttctctgtgtaggagagatgccagattatggttcctggcagatagagtaaacaggcaggatacttggactcagtgattcactgttaatctccccgacccaagttttggtcctgtttcccttccagaaaaataggactaagttgtggggagggggtggttatataaacgattccaagaaaggatctggggaagttatgagcattgaaccctgacctgaaaaccctggccacagaagcttcagaggcttgggggaaatagctgaggtgaattaaggtggttgggaggggtgggctgaagggcacaatcctccagccacctagcccctttcttcccctggggctgtctggcttgaatcctcttgtctctccctccttctccctgtctcctatcctgttcccaggaggctgggatgggtttgagagtctgagaaagggcaagagaggagataagcagcttaaagcagagtccagggatggaggcgggaggctgcatggactcggaggtgtgtctgagggtggcttgctgtctgccattccctgccccactctggctgcttccaggcctggggaaatagtgttgctcaagctcgggggtggtggtgatgatgctgacctgatggttgctaaagtgggactgagatgtccctttggataggtcgactacctggcagtaatccactagctgcgaagcatcatctttcccatcagtgctggagagaaaggcactgcccacctggtagctcagcccatgtcttggcagggcaggcctgtgcaagggaggatgctcaagcttctctgtttttctccacagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccaggtacatctcttccagtcttcctgcctcatccctggtctctgctttctgactttcttctcttctgccctgtgctcttccctatccctcctcctatacctacttgtctcttgttcttctgtgtgtctcttctctatctcctggacatctgactttcagcctttctgtgcattcacccttgccctctgggggctacatgctgacatctcttcatctccctccctgttacagagaggttctgccaggagccaaatgtgattataccatacaggtgcagctaaggtgagttcatcctccctgcctatcctgggtacccactgggggtaggagtgaagtaggggtatgacagatacccttacgagatgtccctgctctgccactgcctactgcagccctgcgactcttgttggatgctgagggcttcaggcatctatgactgattttctggggttccctgtctctctgccagattcaagttaagaaatttcttcccactctttcttcctttctcatctcttaccaggttctgtctctgtgagaccagctgcccccaggaagattattttccccccaacctctttgtcaaggtcaatgggaaactgtgccccctgccggtaaatgctctccccttcttctgtcagtaatcccttaccgtttcagttcataaatattaactacaaacctattctgaaagagacatgcctagcacagtgcgtggcacatagtaggtgctcagtttactgactgaatcaatagaatctcgagagtattaagatagggctgaacaaaggttttgtgagaactcggaggaggacattagttcaacccgagatgtaagaaagacttcttttttgttttttttttttgagacagagtcactcgctctgtcactcaggctggagtgcaatggtgcaatctctgctcactgcaacctctgcctccctagttcaagcaattctcttgcctcagcctcccaagtagctgggattacaggtgcccaccaccctgcccggctaatttttgtatttttagtagagacggagttttaccatgttagctaggctggtctcgaactcctgacctcaggtgatccacccacctcggcttcctaaagtgctgggattacaggcatgagccagtacacccggccagaaagacttgaccccagagctgagagttagaaaaggtgaggcatccttattcctcctcctcagggactcagtgagttccttttttctcagtcaataaataagctctcctttctccccaggagtgaaccccacacataaccctagacagtgctccagttttgtgagccactgaatgggcctccatccccttggtcagtgagtgagcgagttggccttccctccagggattgaataacccgagacaagatatcttttgttcaaagagcagagccccttcccagagccacttctccactgaccaatccctcccttctccagggttaccttcccccaaccaagaatggggccgagcccaagaggcccagccgccccatcaacatcacacccctggctcgactctcagccactgttcccaacaccattgtggtcaattggtcatctgagttcggacgggtgagcacagctaaagcaggtgcctggaaaagcctgctgagggtgaaggggaaccatccagtgtcctgggttggggaagcattttcctctttatgagtctgtctctggtcctcatggaacaaaagtgggcagtggtggtatgagaagcagaggctaattgtctaccccctgcctccaagtagaattactccttgtctgtgtacctggtgaggcagttgactgcaggaacccttctacaaaaactcagagcaaagggtatccggaacccagaccactcgcgggcactgagtgagtaacatctttcctctcttccccacctgatctggattcaagtcttcctggccctccagccttcataattaaacccatacctcttttttgacaacttactccccttctcacatgaaccccaaccctccccctctacccctgaccagtcttccagtctttatagttgaagttggaccactcccaggcacccttgaatttccaatcatgtatctgctttgcacctcacagtccctaactccagccctgctagaatatgggctctccggactggaaagaatcttaggggtcctctaatctaaccctcacatgatgcttcaactcctccagatcatctctaacatagccagagtgtcacgctatgtttaagcatcttcagggatgggaaaatcccccacacccagccttcatcatccatatcccagaccacttccatgtgacgtcccactggcccccaaagacgctccacccagcagcctctcagccagagccatctgttcctggccttaccaactcctgggcttcctccagccttgctgaccccatggctctggcctcacttttgtttcagtcaaggagaaattgactgctgaccctgacagtgaggtggccactacaagtctccgggtgtcactcatgtgcccggtgggtaaaaggggagaagggaacagggtgggaagggagttgggtttagcctgtggactttgatgagggttcctagggatactggcgtgaagttttctgggatgaaatcagagtagggcctctgacaagagaacttgcttctcctcagctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatgggtagggccattttgcttcctcttacctaggacatccactagaacctcttttcttggttatttctttttctttttcttttcttttttttttttttgagatggaatcttactctgttccccaggctggagtgcagtggcacaatcttggctcactgcaacctccacctcccgggttcaggcgatactcctgcctcagcctcctgagtagctgggattacaggcacccaccaccatgcctggctaatttttgtatttttagtaaagactgggtttcaccatgttggccaggctggtcttgaactcctgacctcaggtgatctgcccacttcagcctcctaaagtgctgggattacaggcatgagacaacatgcccagcctataatatttcttttttcttttagccaccacctccttcagggtttttaattcatatggcttacttcccctcacatgaactgcaattctcaccttatctatcccttttaccagtctgtgtgtgtgtgtgtgtatgtgcatgtgtgtggagggggagggcaacattaaggacttagtatatacaaggcatcttgctgagcactttgcatgagttatctcattgaatcctcacaataaccctatggactcggctcctacctgtaattccaacactggaaggctgagatgggaagatcatttgaggctaggagtttgagaccagcctgggcaacatagtagaccctctctctataaaaaattaaaaaaattagccaggcatgttataatagctcatgactgtagtcttagctgctcaggaggctgaggcaggaggatggcttgaacccaggagtttgaggctgcagtgagctatgattgcattactgcaccccagcctgggcaacagattgagaccctgtctcaaaaaaagaaataatcctatgattggctagtgacactcacccagaaaaaaaaaaagaaaaaaaaaaaccctatgagataggtagtatcattacacatgaggaaactgaggccgagagagattgagccttgctcaaggttatattgttaagtggcagagccagtgtactgaactgtcataatatatcacctataacaactacctgacttcccactgagcattgcaataaggttcttttcagggcctggatgttctaatcttttgatcttgctagtcttaacctctttttggaatctacattatggttcctgttcccagtgctcccccactttttgtttgtttgtttgtttttgagacagggtctcgttctgttgcccagactggagtatagtagcacaatcatagctcactgcagcctcgacctcctggcctcaagtgatcctcccaccttggcctcccaaagtgctaggattgcaggcatgagctaccatgcctggcccctagtgcctttatttatttatttttacacaagtgtttagaaagccaaagacccagtgccttttggagatggtttatggacttctgtgtctctgctccttttgttccttatactacacgtaagtgctcagattttttttttttttttttttgagacggtgtttcactctgtcacccaggctggagtggtatggcacagtctcgtgatctcagctcatgcaacctctgcctcctgggttcaagcaattctcctgcctcagcctcctgagtagctgggattacaggcatgtgccgccacatccggctaattttgtatttttggtagagatggggtttcaccatgttggccaggctggtctcgaactcctgacctcaggtgatccacccacctcagtctctgaaagtgtgattataggcgtgagccaccacgccggctttttttttttttttttttttgaggcagagccttgctctgtttcccagggtggagaacagtggtgtggtctaggctcactgcaacctctgcctcctgggttcaagcgattctcgtgcctcagcctcctaagtagctgggattataggcatgtgccaccacacctggctaatttttgtatttttagtagagatgaggtttcaccatgttggccaggctggtcttgaactcccagcctcaagtgattcacctgcctgtacctcccaaagtgctgggattaaaggcgtgagccactgcacccagcctcagattgtatttattttaaaacctattacttactttgcaaagctcttttacataccttgtgttatttgattccaacaactcagagcggtccagtaggatggataatgttcttattttacagatgaggaaactgagatacaggaaggtgagttacagaactctggctactgttctgctcatctcccagccccgtgaattttcatctctctcttcccccagtttatttatggagattcttagttcctgttcagattgtgatgagatccaattcatggaagatggatcctggtgcccaatgaaacccaagaaggaggcatctgaggtttgccccccgccagggtatgggctggatggtgagtgaccccctgttccccagctaagctaaatcttggatggcctcttctctgagacgtagtcttcttaatacccacaggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaagggtatgagaaaataggctgagtctacagcaaaacggacaggggaagaagtcaggattgctttctgatcattggacaaagcctggggcaagagaaatgtggaggggacagagagggaacctggggacctgagctgggtgagggcatctgtggtttgctggctgcctcagctcctctctacccacagagtcctgacatctggccaccagccatcctcggtgctaaggagccctgctatgggcacgttgggtggggatttcctgtccagtctcccactacatgagtacccacctgccttcccactgggagccgacatccaaggtatgacatgggtcataagatggaccctgcactgccacaccctccccagagctacatcagaacccctgttccttctcaaagcctcctgcttctcctgcaaggggccacagtccacagtgctttgtcttttggtggtaaaggggtcagataggaggttaattttgatttttcttttcctgccaggtttagatttattttcatttcttcagacagagagtcaggtaagtggttctttcttcagaaggtctcagatctctgaagcttcctttctagacactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcaggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttctgtgagtgtcatggagatgggctagggaggggattttacacttcactttccagacccctggtttgggggaagagggtccatgttccattcttcctttgctggccctgggtccaggtaagctgcacttttacacggtgggggtgttctgtggaggaattccaagagaggttgtcctttcctgctttcccccgtgcctgtaaaaactagaccattccagcccagtactgtggagctctccagtcctttttcacttttacctgcccagatgttgcagccagagcttgagggcaaacttggttccagtgctgactctctctttgtcctctgccatggttgggatcatccgcaggagggtggacatgtgcaggaccagaggtcgggctcttccatcctcctctagttccactgcactgcatggtgacaactcctgttggggctgtgccttgtagcttacaaagaacttacatatatgttaggtccccgaatcctcccaactaccacaggaggtgggtgggtgttgacctcatttgcagaaaggaaacaggttcaaggagggttaaatgacttgcccctgtgttagaactgacacttagaccttcaatgctagccagttagagcaagaatctttggggtttgatggtcagtgtcttagatttcatgtaccttcttaattatcagctgacccactctccttaaatctcccccacaacacaaaattccatcctgaggacaggatagacgctgaacttctcaacatgaatatgttggtgtattagaggctgagggagaagctcttacttacaggacagagggtggtaggtcctgggggagaagtccgggtgtctctgtcccatcctctgcggcagccactgcagcagctacatctggtgtcagccacataagggcgctcacctcatttgggtttggttggatccgggcctggggtcagacatggtgacccctcagtcattgcctctccctgggctgcctgttcgtgatcaaaacctacccgcaggtttcatggagaaaggcaggagcaaggggaaagggcattgcatattcttcgttatctctgactacccccgccacccccgcccagctcctaatcacagtcagaaccaggttgcttgggctcccctgagccctgtttccttccctcactgccagccctacctgcaactgctgctgtgattcctgggagatcacgagtagatacagaacaatgtgatggtatttgggtaaaccccagctcagcctaggagggtaggcagactaggaaaagaaaacagcaaaagtgagaactttccgtcactttttttttttttttaagatggagtttcgctcttgtcgcccaggctggcatgcaatggcgtgatcttggctcactgcaacctctgcctcctgggttcaagcaattctccagcctcagcctccagagtagctgggattacaggcgcctgccgccacgcccagctaaaatttttgtatttttagtagagacggggtttcgccatgttgtccaggctggtctcaaacttctgacctcaggtgatccgcccacctcagcctcccaaagtgttgggattacaggcgtgagccaccgcacccggccctttgtgtcactttttgagactttgttaatacagctttagggtgaaacaaaatggtggccaaaagctgagggcgtggatggtacagatgacacagcagggacatgggtgagggttatggatttggggattccagcccacttatgtgctattgtttcccttgtagccaaggcaggtaggggctgatctatggaggagcttctcccagctacttgtctcacctcccataaacccagagggacccaagagaactggccctggggcaggtgtagtccactctcctcccaaagttctcgaagccctccgtccagcagctgggagtcagagaagacacatcagaggggccagtgcctgactcttccaag

SEQ ID NO: 1767 - DNA, 231979 bp, Homo sapiens
  FSHR gene - 49101303 - 49293281 of chr2; NCBI Entrez Gene ID: 2492; Build 35; sequence includes 20,000 bases upstream of initiation codon and 20,000 bases downstream of termination codon of the gene
aaaccttggtcctggagtcacctctcaaacacatgccgaggctccattctcagcacctttcccctggaacctaaacataggcccacactcctgtttctgtgtaacccacccacagatatagaaccatctatttcccagcacccatatttccccaagagaggttcaccagtaagtaaagtaatggctctgagtcctacattgaattgttttattttaccctgtgagaagacaaactcatcaccccctctgaatagataaggaaactgtagcccaaatatttttgtccaaaatcatggggagaagttacggatctcccaatttatgcttttctcattaaaacactctgcttcatctgagtaagatatgtagaagcaggggattctcacattatacgtatgattagaaagggaatagggtacacaagaacagggaagaatcaagagccatttttcttctctattaagatgaaatactgccacttcctattttcaaatgacaacagcaacaataacatgctaatgatgcagaattttagaggaatttctctagcctttaccatttgctctatttgccattgtttgagaagcaattattaagagtaagcttttttttaatcacaagattctaaaatccatttaattcaataaacacttacacaatggggtaccaatcaagacaaactttaaatgttgtaattgtactttaatgacaaaactgctatttgggaatctgaaactattgacaccaacttcctcagttctggagaaatcaacaggattacatagaaatcatgtaaataccaacgattgttctcagagaaagctgtgattcccccacaaatgtgactgcaggtggtgtaggctgaagtttgcatttattagttgggtaaatttgatccatccatggtaagccaggatgtacccttaaagattttgataactgttctaaaaagcaagtttaataattaatgctccttatatggcattatttaaataagaatactgtagacttgggaaaatatattgttgactattgccactgacttttctagagttcccttgaaacaaatggaagttcatattgaagaggaaataaaacattctcaggctcacagattagtgtctgtgggttgcagaagcagccactgctgcgacaatgcacattatacttggggtggtgcttctattacttcatcagcaatccataaatgaatctggccttagctgtacttttgaagaggagactgtgcccaccagcagccaggagaaatgaattataagataatgtgataatgtggcattgggggaaaacaatgctttagagctgagttggtggacaggataacaagtgactactaagattagtttgaagaacctctaaggcttccttggggagcccctctggaagagaaaactaggagaaagatggattttcaaaaaaaagttattcatgaaacatttagtacccattttaggaagaaaataaggggggctttccagttacatttaccatttatatgataaatgtgccagacacatgcttggaattagagacacaaaggtaaataaaacacggccccttctctcaaagcagttaaaatctactgggtggccatttgtgggtgaatgttgtgagtgtgtaggggaggtgctaggcaggttgggagggttgcattttaacagcaggatgtcaaagtatgagtagtcatttccaggttcataatctgtctgtataagaggaaagtttttggtgcctcaaattgctccttctctggaataagctagtggttaacctagagcaactgggttaacaaacaaggacatagcaaaagccactcctcagtcaccagctctgcgggaggaagagattgctccatggaaactgtagcttatcccactctttacaaactaaatagatagatttttagaaaggaaaaagaccaaattaacatttgttaatttaacatttgttaaaaatgtcaggagaacgcaaatcataaagtgaatttctgtgaactcaataattaacttcatctaggatgtttatcctctggtgtaagcctctgtggtcttattaatatggtgaagtttcttcttcagggtcacctgggttgagggcaggtgcctatgagtcctacagcggagagagcaatggagaatcaccccatgcatggcctcatgaacgatgatgatggctcactcagagaatcaaaaaactatttctgactaaagaggtcgagacaaagcaagcttcagatttaggaaaagacatctcttttcccacctctctccatcatcattcaatttactgacaagctattaaaggttttaaatggctggccacatatacaagtcagaattgagttcttttgagggcaataggtcagaggaaaaggaggcttctaagacctcgatcagcctctttggacttgtgattgagaaaagttaactggttgccggagctaagggtgttgtgttcccttaactgcagagattcgctgtatttacaatgcaattttctcaagagtttccatgtccagaaggctagtgaagaataataaaacaaatacaacaggaactacttcacctatggtcaccaatgatatctacatggttgaaaaagaatgggcagttctctatcctcctaatttccttacactattgaccacttccctctgttaaagttctcccctccctttgttcccactcttttctgattctccttcaaattctctgacctctccttctcagcattttgcacaaatttcatgcttcagcccatcatagggtaacattccctctttctcttctgtccctcttcctctctgtcagtgatgtttgcattttgttttaatttggactgatgtaacaggcttcttcttggcccccctgattttaattttgattatctaccattcagcctctatatagctgccagagaaattttccaaagtaaacttcatcgatctcttacttacttcaaaccacttcaagatcccccattgtccataaaacacagactccctggtcaggcataaaataattttatgatctgcctcctgtgtaacctctccaaacttaactctcacaacacctctccacatgtgtctcgtgatctggtcacacagaattatttgcagctccacaaggttggattactgtattaatccattttcatgctgctgataaagacctacccaggactgggcaatttacaaaagaaagaggtttaattggacttacagttccacatggctggagaggcctcacaatcatggtggaaggcaaggaggaaaaagtcccatcttacatggatggtggcaggcaaagagagagcttgtgcagggcaagtcccgttctttaaaaccatcagatctcatgagacccattcactatcataagaacagcacaggaaagacccaccccataattcaatcatctcccactgggtacctcccacaagacgtggggattatgggagctgcaagatgagattttgggtgggaacacagagccaaaccatatcattctgcccctggcccctcccaaatctcatgtcttcacatttcaaaaccaatcatgcctccccaactgtcccataaactcattaactcaaaagtccacagtccaaagtctcatccaagacaatgcaagttctttctgcctaggagcctataaaatcaaaagcaagttagttacttcctagatacaatggaggtacagccattgggtaaatacagccattccaaatgggagaaattggccaaaacaaaggggctacaggccccatgcaagtcccaaatccagcagggcagtcaaatcttaaagctccaaaatgatctcctttgactccatggctcacattcaggtcacactgatgcaaaacgtaggttcccatagttttgggcagctccacctttgtggctttacagggtaaagcctccctcccagctgccttcacaggctggcgttgagtgtctgtggcttttccaggcgcacagtgcaagctgtcaatggatcggtagatccattggggtcttgaggacagtggccctcttctcacagctccactaggtggtgccccagtaggtactctgtgtggagactctgaccccacatttcctctgaaatctaagcagaagtcccaaaacctcaattcttgacttctgtggactcaaaggcttaacacgacgtagaagctgccaaggcttgaggcttgcaccctctaaagtcacagcctgagctctgtgttggtccctttcagtcatgactggagtgactgagatgcagggcaccaagtccctaggctgcacacatcacagggacccttggccagccgttgaaactactttttccacttaaacctctgaggctatgatgggaggggctgccacaaaggtctctgactcgccctggagacattttccccattgtcttggtgattaatattcagctgcttgttacttatgcaaatgtttgcagccagtttaaatttctcctcagaaaatgggattttcttttctactgcattgtcaggctacaaattttccaaacatttatgttctgtttcccttttaaaactgaatgcctttaacagcacccaagtcacctcttgaatgctttactgcttagaaatttcttccaccagatacccgaaatcatctctctcaagttcaaatttccacacatctctaggaaaggggcaaaatgctgccagtgtctttgctaaaggcctcacaatcatagtggaaggcaaggaggagcaagtgacatttaacatggatggcagcaggcagagagagagcttgtacagggcaactcccattttttaaaactatcagatctcatgagacccatttgctatcacaagaacagcatgggaaagactcacccccataattcaaccatctcataccaggtcccttccacaacacatgggaattacgggagctacacgatgagatttgggtggggacacagagccaaatcatatcacatagcatctctctggaatgcccttaccagctttgccaggcctgcctcacctagtcccagaagccttccctgatcaggttcgtgacaccacccaatatgggtgagatgtcattcctttctgatcttccttaatgctcactacttgtcttcattataacattctcttgtaagggtttgtataggattcagacagaaaattagatttaccataagtgttatgggaataaaaaattgattgtaggtgttagcccttataaaaatatgggaggagctgaggaaaagaaaatttggaagggagagttggatggtaaaaaaaaattagtcactagccaggtgccctgaagcaaaggcacgggtcaaccagcaggagcttgaaatgaaattgaaaaagccaccaaagtgaaaccacaaaaaaggagagcttatgaagtctacaaaaattgtttttcctgggaagagttgcctgtgcagagatgcagttttggtgtgtccccagccaagaacctggtggtaggcctggggccactgagtgaagacaagttggaggggaagaggaggagcccatcgggcacctctgcatctgtctatcaccatggtcgatggtgacaaccttctgagagtaatgaattctacttcatttctgtaagcaaattgcaagcaagttctttcaaaaaaccagtcagagaaggttattgtcccgggaaataaaatttccagctttggccaagttcacctaacagaatacagcacaccttcactgtctgtactctagactgtgagataagaagacaggcagtacgttctatccattttaatttattcagcatcaagcacagtgcctaagacatagcagagactcaatagagatctggacagtgaatgaagagcattaaaaacgcagatatggcctttgtgttttcaatcattcccaaagcatatggtggaaatggtgctacgcattcttgggaccaaatcttcacgtgtcaagcaagaccagactccagtgactaaatgattgtaaaagaatttcactgtgaaaataaatgtaattacatacatcaacacacttacttgaaatttcaaaaagtaagacaatgttaaaatcaagtttgcctttttcctttaatgttatcaacatcttcagttttactgtgttttgttttggctttaaggtagtcattcgtttttggttttctgtttgttgctgctgttgtttttaggatgctgacagtaatgtgtaatgaagaaccatattatgtcaacagatttatactgaggttaattgttcttatcagaaaatcaatatgtttgaaagtacatctgttttctgttttaagtctactccatgaatgccaaagttcatactcatctgcctttacctcagaaataaaagcaagtctccagcaaaaagaagggtaaattcagagttattaagagtcctcagctgggtgtggtggctcaaacctgtaatcctagcattttgggaggccaaggtgggagaatcatttgaggccaggagttcaagaccagcctgggcaacacgggaagaccttatctctactaaacatttgaaaactagctgggtctggtggcacatgcctgtagtcctagctacttgggaggctgaggcaggaggatcacttaagcctgtgagttggaggctgcagtgagcagcactgtacttcagcccaccagcctgggcaatagagtgagacttcatctcaaaaaaaaaaaaaaaaatcttcacatacagttttatgacttcatttcacttctacttatcctgaagttcaaaattgtaaattatctttctgataaaaaccaagggaacacttatggataatggaatattttgggagaaaagagtcactacaggttttatttggtccgtacaaagactttagtagactatttttctctgtatatcctctacctgtctttcttgtcagctaaaatgtgtaataatatcatcagagtaacttctttattcaatactgtgcttctagtttaataaactatttttaaagctttgaaataaattagtatttccagattcacagttgacttttatcatcaaaaatctatgtttataacttttaaaataattaactcttcccttctgtcagctgctctggggtggtttcatccccacattctgagaatgaagggcctggaatgatgccaaagggaaacatgaagctgcagaataaaaatggctcatcttttcatctctgcacatacctcttactaaaaatattttgagaaatttgatagtaaaataaacatgactctattgtaaaagagaatgtaaaatttgcatacatttataatataaaataagagacaccaaagaaatgttgaccttattgaggctctctttggaaaactccactctcattggggtggtttgatgaaaattgttgacgaccctctcatctcaaagtaagcattattttcagcattagtaatgaaaaacaccttggttttagataaatggaatttgttttcattcccagagagatttaggactggaagttactatctaaactgacactgtctagttattccaagaagcatttttatgtctttttttttattactagacataatacaagacaacgtgtcatttgatcaatgatgctgtcataaaccaacacccatttgtcaacctgaaaagaacaaatgacaagagggtcagggattgaaaagagaagccttgtgttagaaggccactgtcacattggaagatgttcctggatcatgttggtttaaagtcacctagactgtcctctctccctcccttcctcctccaatcctcccattcttccctcctcatgcctcacctcctttctttcttttggagcccagcttgtcagtatgtgatttctttcagattcttgccagaatttctatgtgggtaaacttcagtatttgcggttgcagtccaatttgtaaactttaagcagaaaagaggtaaaaggccttcaaggattagaagttatttaaatcctgtaagttagaacggtgcaaattcactaactttggcagtaggcaagaggtttccacaaaacaatgtcaccctgacacagtaaatcagggctgccttggcttagtaaggggtgggtgaaggttgaggactacgctgcccaaatttgtaccctaacatcaggcagcagataaccactactgctgtcaatggagttcacttccatttggctgctcgatgccctaaagatgttcttgtctgaataatgtgggtctcatttccatgttaactatatcctttgatcccatattggtagaatgattttaagtcctggatgccttggatagtcctggcagtaattactaacagagtctcctttcactctcaaaattgttctggtttacaaggtaagttaaatcatttctttagaaacctcactctcaaaactagcattaaaactgagctatttcccattatgtcagagccacagaaataaaaatatagaactaaggcaggtaatttagctacaatgaggtgggaatgattcagcaggaccatctggcagaaacgaaagagggaccatagtcttcctgggtcaccaaggcaaccgagggagggactcttctccccaggaagggtggctgtgtagtcctgcagaagtcagtgtcagcctgagagtcaaccagcctcagcctccttcttcccggtccctcagtccatctccctgctgccctggctttctaggacagagctgtccccaaggagtgggtgctggcttgaaaaccatcacacctgtgtttgaagcctgggcttatcacttaccagctgtgtgaactagggcacattcacttcatctctctaagcctcaccctttccgtccataaaatgagaataatcagagctgcgttgtagggttggtatgaggatcagagattatgtaagatatttagcctgatgtctagcacaaaattagcacaaaataagtagaagctgtttcatagcctaaatctgaattctgaagaatttaggtatgtgactctccatatcttataaatgggctcctctttttatacacattgctctcaactctcctgtgagtcagtaaattccttgaggacaaagtctccattttatacctcagctgtgcctgcaacccttcaatacatttctgatcaattaatcggttgcctcccaagctcagtgaacactcccagccagagcccaccagctctctttccccttccccagcaggagccaagatttcacaccaccagggttgcctgaggtacccacagggaaggggagattatgaggaaaggttagaggccccgtgtggaataaaaataaattattctttgaaagcagtgaaatttcgctgcttctctctttttttaaccgtgttcataaataatggaaacacagtattatttttcttcattccaaagtataaaaatagaaaataggccttggattttcagcttgcagtgctgtgttgctgacaactgacactcctgctttcataaacaatgaccctaccctgagatgttgttatgtgttgaatatgtgtatatgctgcatatatatacatatttaaaatattttgtttaactaggagtttgattgagaggtttaagtgagtgcaagaaccagatcagctagaaaattgccaaatctatttatcttcactgccagctcagcttaaaatcagtgtttcctcaagcaccacagcatacatagttagctactaagtatgctgctacactttaatttgattatatgcctgtgaaataaagaatgttatatgattcagtcatgttatcatggctaaatgtttgagttttccaagggaaggggcagtatcctagactgacacacatcaactcctagggccagacttcttttgcagctattgggtatagatttatattaatactggtcttaccataagtattcctgagaacatttatctgccctgagatttttagaaaactctccctggtcaaatctggaactactgctccccattttcccactggctccttatgtcaaaacataagacatatgatttccatattagtgtaccccaattcccaaacatgccccccttcaatttctgcttactctgaaatctagacatgtggggataaaaacagtcacctatagatcatttgctacaactaaaatgtgatgcaaatttactccattttatttttaaaagagaccaagacttctctctacaaaaaattaaactaatacgagaatttcagaatccactttgttcatctaaaagcagcactaaattccccaacaagcttacaattacatttttcccccacctgtgataagttttcacagtaacatttttgttgtgtaaattggcccatacacttcacttgttatccaaagtggtcaaggacaagtcaaagaaggcgaatcttcactctgccggcaacaggtcagccctgacctcctcaagtcctgagtgggagaatgggttcaaaaggggaagtgcaggtgagtgaaggtatgtgttgccaatggcagaattgtggcagacagctcaggcatggtcagtggcgtggaggtccaaatatccatatagtcagagttgtctgtacaccccttcaccatgtaagcaaactgaaaaattgccatgaaaaaggcccacttttgcagtgatgagcagtctacttctccctttcatgacaacagctgtgaggagaatattatcatacattcacaccagtctctcttacagtatttccacatgcttctctcattttgtcttcgtgagaaccctgtaagtgttcacacccccattttggagaagaagaaatacacctccagataattgcaatgtcctgagattctacaataatgacaaagctatgactggagcccagatctccaactccagcatactgttccttcctttgctggttgttgacctcctcccaacactctgagtactctgtcaagtgcctctcctcagcctccactgccagtatccagtgagcttaccctccacaggtccagcactcatcaccagcagacagccaggtgcaattgtgtaggtcgtgcactgctcagcccaagagggttcattaacattatggcttacatgactgtcctgtctcagtaagctaaaggtgtgccatgccccaacaggccaggtgtggctggttgtagagctggtatgctagcctcctatataatatcctggtacatttacataatcccatctaattctatctatatgctctatccttaatttgtattatacggcataatataaaaatttacattatgtggtataatttatatggtataatatataaattatatgataaagcaataaaatatgaaagcttaatgtgtaaaagagcaaggttctaatattaataataatgcgaatttaaggatgctaactggaaatatttagtattcaaagatgatcatgttgtactaaaaattcacaagctacatctttatggtctcaccatattacaaggaatttttattcctgccataaatctcatagtatacattttaaagcctataatattatagtatgcctacactacattcacagaaacaatcaaaaataaaggataatgtgttaaatagaaaaggaatttgttttttaaaataaatataaacctaccaaataagaatttctgaatggcgaataaatgtctttggtcccgtcataacgacagatttttaaaaagaccaacctacattattttccctcttgggacagcaacatgcttagtcagtaattgaacaaatttctaaaggctaaagatgagtcttcaacatcattgttgtcagtctctctattggttggcctaacttgtactttgaaaaacaataataaagaaagcaagtattaccaagcatggacaaggatgtcctctaagtgcttgggtacctgtggtaaattgttggcagaagtggctgtctttatttctacctttgtttgcacaccactttgcaatgtgacattgtgtttctctcctcaagaggtggggtcaacagaatctggttgactccttgaatctggtctggactttgtgacttggtatgaccaatagaccacagcaaaattatgtatggtatggcagttctgagcctcttggaatgccatcagatgaataccaccaaggcagtctgctggggaatgtgaagcacagctaagttatcccgggtgaagtcatctggcaccagccagatcccagctgactcaatagctaatcccagtcaagtctaaaactgctcaactgaacccagaccaaactgctggcccccagaatcacaaataaaatgaatactggttgttttcagacatgatgatttggtgttgtttgttaagtataaaaatctaactgtttcaatacataagaaagaaaacaacatcatcttacattctttttttcttcgagatggagtcttgctctgtcccccaggctggagtgcagtggcgcaatctcggctcactgcaagctccgcctcccaggttcacgccattctcctgcctcagcctcctgagtagctgggactacaggcgtccgccaccatacccagctaatttttttgtatttttagtagagacggggtttcaccatgttagccaggatggtctcgatctcctgaccttgtgatccgcccacctcagcctcccaaagtgctgggattacaggcgtgacatcatcttatattctttagattaagtttccttttgacagaaaagtcatcagtacaaatgttcctacctcaactcattctacactcctacttgtaagattttattttttatatagcaactttcaccactgttaggatggctttctttccagccaaatagatacacaggtgttttccaattgaccccagagaccttaccttcacatgactaccctaaaaaggaaaaaaaaaattgacccggaaattaatttcacagatttgtttataaaccagttcaattatctaaccggtgacaaatcttctctgattaagaattatatacagttccatgaaaccatgaaagtccaagaaataaaatctgcctgaaagatctatttagtcctctagccttgtggtgtaaaaatgtgctactgcctcattgttgagatttgagatctttgagatttaggaaactttaagttataaaatcatgaagttaaaatggaccttgactttccaatacaattcctaacagatagattcctaagatgtgaatcataatcataaccatcataatcatcactacctaatgtttgcatagttcttaatccctatggaagtctgagcaacctgaaggcagtgccaaatgcaaagggtcctctgaaataaggaataactagaaaataacctcaaaagaaagttcttcataaagtagaataaccgtgaggacacgcaaggagtgctagtgataagtttaaaagaataaaggtggtcaggtgggagatttacagaggtagaaaaaggttctgtattccacataatttttaagggatgaacacttagtaataaggcatttaattccagtttatcaccactaatctcctgctaagatgttaaagcctcgttttctatacatgattcccttttatatcagaggagttattttttcccccttttgcatctaatactgcagccaaacgttgttgccacaactgctatgcccaattctctaattctagtatgagtagcctttctcctcactctggaagaagaatgcaactccagatagctgcttcagagagcaggccgtatatattcacgccctaaaacactttctgtctggccagactctcataaagctcatataacttaagatagagttaaacaacccagaacaacactgtaagttctagtccctgaggtaaagcaactgaggttggaggttattctagaatgaaaatccagacaaaatgcagcacatttaaaactatgtcagataaggaatggctgaaggaattggagattgcctcaacaagtaaaaaagatgattcaaaaagtacaaaatagctggtgatgtgctggaaccagctcctaccagctcacaagaacagattgctaaatgggaattttgcaggctggttggcatcacatgggtagcttgatataagctgcagagggagaggttacaccatggaaattaacgaatgctacaaatgagtttttttttttttttctggagagctggttgttgagcatttactagcatatctgtgaagttagctgtcttcaattacttgggtcctttttttggaatgagattatacttggttatacacaatgcttctcaaggctttgcaatacagtatctgcaaaggcaaaggaaaataaacccctaggagctccagtgacatggtgcagagtggcaaggaatctaagcaaatattgaaggtataaaataatgagggtatataatactgtaaaactaagatcctagacaacaatgaatgcatgttacctaaccagcaaataaccttaacaatgtaaagtttatgtatttgttagaaggggagttagaatactgataaaattaaactgcattaagtaaaaggtataagtatacagtaaaagcataatgtcaaagataaaaatttgagattaaccataaacatttataaagaaagtataaaacttgcaaaagagtaaatgaaacaaaataaaacaagaaaacaaaaagcaatttaaaaaaacagcacacaaaaactcaacaaataaaacaaaaagcataaaaggaaaaaaaagcatgtaaaactagaacaaatagaaagcatgttgcatagtagaaaaacaagcatttatatagatcaatattatatagagcaataaaatgtaaatgactaagctcacctgttaaaagaatgagattgtagaaatggattaaaacacaaaattcagttaggtgattatgaaagacatgcctagaacataaagacacagaaaggttgaaagtacaaaggtagaaaaagctggtatatctatattagtatcacataaaatagacttcaagataaaaggcagtattatgagtaaagtaagatgtgacaaaagatagaaggtttaattcaccaggtataccattctaaatgttcatggcccaaagaaaatagccttgaaatatataaagaaaaactaaaactgacagaactgtagagacttggatcatccgaatcatgtgaaatttcaacagaaatacttcaattagtttaagtaaaacttaaaatgttagtaaatatatagattttaggaaaataagctgaatttatggggcaaaaatagaacctggaaacaagtaaacagagaatgttgattcttctcaaactcacattaagtatttgtaaaaattaacttgtgtcctaagccataaaacacatctcaacatgtttgggggaaaaatacaatcaacacagacaacattctctgaccattatgcaattaagttggaggtcagtaacaaaaaaagataaatttaaatatttctgaagtttgtaagtttcaaaaccacacctctcaattatctatgtgccaaagaagaaattgtaatgggaaattgagaaatatttaaaaataaattgtaatgaaagatctacctatcaatacttgtagaagagggccaaggcagaaatcacagaaaaatttacagctttagtatattattagaaaggaagaaaggctgaaaactaataatctgacatataaataaaacgttttagaaaggaacaacaaaaaaggaaaaaataagcgcaaaaatcatggaaacaaaacataaagatagaattggatcagcaaagggtaaaggcaaaagttcgttctttgaaagaacaagaaaaataaagagaattttggaaaggttgattaatgaaaagaaactagacagaaataaacaagactagaaattgtttagaatagatttaaaaagagaatactaaaaatctttgtgacagtaaattttaaaacttaactaaaataaaaaattcctagaaaaaatataatttaataaatttaagaagaaatagaaagcctgaatcatctaataacaattaaagaagttgaatcaatatgtttaaattttcatacatacactgacacacacaaacatgcacacagacacacatatatacacacaaatatgaaccgaggctcaaatggttttttaggcaaatacaggcatactttaaaggaatagattactttaatctgaaacagtttttttttccctaagaataaaatgagggggattataccccaattcagactataaggcaaacgtaacaatgccaccaaactatacaaggacaacatgagaaagaaaacttaggaattaattatgcactaaaaattactcataattaagttacaaataacttacgaacatagatgcaaaatttctaaataaagtattaggaaatgtgtagtttaatagcatataatcattattgtagcccaggggtggtggctcacacccataatcccagaactttgggaggccaaggtgggcagatcacctgaggtcaggagttcgagaccagcctggccaacatggtaaaacctgtctctactaaaaatacaaacattagctgggcatggtggtgggtgcctgtaatcccagctactcaggacactgaggcaggagaatcacttgaacccatgaggcagaggttgcagtgagccgaggtcacatcagtgtactccactctgggtgacaagaatgaaactccatgtcaaaaacaaaaaaaaaattattattgtaaagaaagagtagaaagagaggaagaaggagagagagaagaaaaggaagttggagtcagggaagaaaaggaggaagggaggaaggaattgaaaagaaagaaactctctacacatacacacacacatacacagaattatttagatatggataattgtttgcatagaaaatgtaataagtggctgggcatggtggctcacgcctgtaatcccagcactttgggaggccgaggcaggtggatcatgaggtcaggagatcgagaccatcctggctaacacggtgaagccccgcctctactaaaaaatacaaaaaattagccaggcgtggtggcgggcacctgtagttccagctactcaggaggctgaggcaggagaatggcatgaacctaggaggcagagcttgcagtgagccaatatcgagccactgcactccagcctgggtgacagagcaagagtctgtctcaaaaaaaaaaaaaaaaaaaaagaaaatgtaataaggtaatttagatataagataaatattccaaaattaactgcatttttacagtatgacaacaaacataaaatgtgactttaaatattgatttcatttataacagcataaaacaggatgtcatcaggaaacacatttaagatattaggacatatatggaagaaagtataaagctttatttaaagacatcaaagaagggcttaaataacatggtgctataccatattcatggataagaagacttgttatcttaaaggtgataatttctgcccaaattaatctatataatcaatataattccaaacaaaattataccagggtgttttcaaggagtgtaataatctgattctaaaatttattcataggtccaaaataggcaagatactcctataggaaataagatagaagtgttttcttactgtatatcaaggcttactttaaagttgtagtaattaagacagtataacattggtgtaatgtagaaaaaagaatagtggaatataaaaaagcttagacacaaacccatgcaaaatagttacttgagatatgagaaaggtagttttacaagtgagaaaagaaaagagggaccattcaataaatggttttgggacaaatgtttatccatgtggataaaaccattatgccatcagataaaaaacaaattgagtcctttactcacacccataaatctcaatgccaaatagatcaaaggccaaaatgtacagagcaaaactaaaaaattttagagaagatataaaataatattttcacaacctcaggattttaaaaattacaggagaatgaaaacataaattatggtatatttatgcaatggaatatcatacagtagtataatattaataaactacaggtatacctaacaggtacaaaattaataaactgcaggtacacataacaacatggttatttctttaaaatgtctagttagtgtaaaatagtaagcagcaaaatactactaaaagactgatagactttgtaaaaatgtaaaaacacgcaagaaattaaataatatattccttggagatacattttgtgacaagattaattttacaaaacaaatgaaataataaccacaaaattcagattaatggtcaccttgggcataggaacacaagaaggtaataaaggaaaatcaactaagtagatgcaacaggactggctatgtcctttattctccagcccgcaattgtttgttgcattattatgcttaataaattacatttatgttacctataagttgtgaatacgacatagcatttaaaataaaaatctcaattttaaaaagatttctgcttattatactaagactaattacagagctctccaaaagctagaaggggacttatggggcagaggaattgggtaaaaggtttaattggtagtgagtttcttgtcactggagttattcaagtacagatgagaaaatccgtttaaattaatatgaatacttaaacttaagcattagttggttgattgaattaacttccttctacatctgaaagactataattccttggatcagttgttgaacaaactaatttaaccattcatgttagccaatttgttaaaaatatgaagtccatatagatactgcctttgtctgccaattccagaattagaataaaccagttgctcccagaaaaaatctagggatcaactttgccccccaaatcacttgcttctgtttttttcttaataatttaatcattctttacatggttttccttggtaaggcaggggagagggaaggaggggtgggataagtaggtatttttaacattttcatgaagctcaattttatgcaactaattatctaaagatagtattgaaactaattttagcaggtaataagttgtgggcaggatcttagagaatattctgccttttaatcttcatagattctacaattgaaagtagaaagccacttttctaaaagtgttgccaaacgttcctcagatccctcaccatcgaggaggggaatgccaacaaaagtgctgggctgtcacctcagggaacttttaaaagtaagttaaaagcgtagattaaataaattcatttatgccaattgccaaaaggcaagggcaatcttcagagcctggaaatgcgagaaggcaggcaggatatgcacgagggggtggatgtgctggcatttactaaatccccactggaaacatagcacatttcttagatcactcagttcagtcaattatcgctacagataaccctatcagaagtacctcccacctacggaaatctgcctaaggtttgctaacccacctgcctgtttctgaatagtgccatttttggcataattacagcaaaaaaagaggatcattgaatgcaacccagaagggctggttttctctcaggtgggctggttgaagaaattgatgctgaagactgaaggtcccagcccttcacttattagtacccctcttagtgatgtgtcatattgtgggttgtgtcttttttggagaaagtcaatcatgtcactctgttgagaagagaatggtgaacagcaaggagacttttgcaatgaaataatgcaaactattccagacatgcctaatggttctatttgctgtgtgccttaggtcagggtgtaagaaacccaatcttgaaggaaaacagagtagcttatcttgcctggaagtaacaaaaaaaaaaaaaaaaagcatcccttggtgggtcacatgaccctaccagttctcaagtcagatctcttctcataagggcactgtgtggagcttctgagatctgtggaggtttttctctgcaaatgcaggaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgtgagtatcagagggagggggaacaactgcatggctggcatttgtgcattgcgtactattattatttttacattaggctgatatctgttagactgaaatatttctgccccttgaccgaagtcctgaataaaacaactaactccccagcccaaccctcctgcctgtggctttccaagaatcttagatgagagtttgtatcagcatttgtcagagaacggcagtgtcagagaaccggaatccaaaggcaaagggaaaagttttgtcttttcaatgcatttgctcttgggtttcatactctctttagtggaaccagaaaaggaaaatgaaggcaaagtagaaacttaggagacccagaattggaggcagaaaggcagctttgatctaagcagaatacacaaggtatgtctcccgaggacactgaatctaaaaggccatagtctttgtcgttttgaaggcagcagcaaataattcctgaactgagattctgcttttgggtgtaaaaaggaggtggtagagaagagaaaaggtgtgaagaaagaaagaaagataggaaagacacagagagagggagaaatacaggataatcttttacacaactggaaaaaaatgtgattaataagttagaaatttacttaactattttaacaggaagtagactcctagagttggccaagaatttagacaccatcctactctctctttcttttgcaaattaggaatctggtgtctgaagagtaaagaggattttccaaactctcgtgatgagttgagatggagccaaaagtagaaatcgggccttttgactcacagtctactgttttgttttgttttgttttgttttcccaacccactgtgactgactccattagagcaacagtgagggaagcctgaagtaattgttcagttactgcttcccctgagaactggcaagttgggactcagggattttagatactctctgtgtttttattgcaaggattttaaacagaagcctgtttcaacctttgtcacttaaagctgtggatgatttgcatttaattgaagaaggtggtcatctctttagttcaccaattgccatattgacactgaaacatgttggtgttgcatttcagattttcactcagggacaatgagttgcagccttgcagacctgattgattctgtttgccacatttccccttaacatctcaagtcttcagtccttatccagaggcagctgcagaggcagggaaaataactggccagctctgtgttttggctacactgtctcagattagacagctactcctgattatgctgaagaatgtgcccatgcacaaagacagtctgatttattaggtaaatataagcacaggagaaggccaatgtacctgagctcctataagtcatttggtcctaagtgactttcagtgattacttaaccccttctgagcctcaagttcctcatttctgaagccattttagtacaacctgcttggttgaattgttgtgaacactaaaagatatagatgacccctacaccctaatttccacctctcctggacctactccactttttccaatgtttccatgtgggtcaagcagtgtcatccagttgataaaacaaacagacccaaacaagttttaattttagggtgatttcacactagcctgtctgctttctgaaatctccttatcagaagagagattttcttttttcattctgcagagaaaacataggccaaaaaagagaaaagatggagggaaaaagggaaaaagagaaagaaaagaaagaggaaagaaaagaaaatccacccccacaccctaaagcttcagggagtatatttgtatgaattactatgagaggatatgaatttttgaaaaaaagtaatgctaaggtataaatgactaaaacacatctctggccaagagcattttgcaactaaggaaagagagcatgagatgttgagatagtatggaaagagactgtgtgagagagtgtgatgaacagagcaccagaaacaaatttcacattcttgacaaaggctagctctaggtcaattccttacttcagtgtacgtattagaggacaaagttgcataaaactaagaaaaggaaagaaagttcctgccaggtgttaggattttcctccacctaaggaatgagtatagttaagagctttagaagctctctcaaatacccagtcttaagaagattctgtcttctgcacactcattggtagggcttgacttggaccatcttagagtttggctttgcaatcttcttggaaaggtgtactgaggtgagaagagaaatgttgctttgtctattagattttaaaaaaggaaaattatttcaggtcagtgtgttaatcactgaagagtagataaaatgtcaagtgaattacaactcacatactgttagaatgagagagcaattacctttatttttgcttccttaaaaagactgaatcaaggttatctaagtaaatggcagaacagggatgaaatggactgttcaactaagtatctctaattcaccttacaatcttccaagtttgcgtattaactttaatgattacatgaggtgtaggtggatggattattggacttcattgactgcaattgcttaatccatcaacatgtcaaagcttcattgttactcaggctcaccgggtggaaaacaattcctacattttactatgtacatttttatcctatcattccattcaccttgcagcagtttcatttcatttgatacatctgccagctatcacgaaagattgctaatttcctatgatctgcacatgctgatattaatgctaaaagaacagaagcaccatcaacaggcaagtagatttcatttactaaggggctcctactatttgctttatgcagtatgttttgtacatactacttcattaaaacttcaccaaaaactgcaagtttggaattattgctctgtttttcaaataagacaaaccaaagcacaaaaaagttgagtagctctggcaattatccctgcagctcctggatggcagagctgggatccaaatttgaatcttttatatctcctctgcatgccatgtgaaatgaacatcatctgactctatacctttcttattctgaaaaaaaaaaaaaaaaaagagtaatcctttacattttaaaccagaagtcagctttatgggctataccacttcttgcaactactcacttctatcacagtagcagaaaagcagccataaacaacatgtaaattaatgaacatggacatgttccaagaaaactttatttatgaacacagaaatttgaatttcatataattgtcatgtcacacaaaaaagcattattttgatttttttcaaccatgtgaaaaggtgagaaagatttttagcttactggccatagaaaaacatggggcaagccaaatttggcccatggactatgtattgcccacttctgatttagactatagctgagagagtgggttaagtattactagtttgagtggggtttaggcagcctgaggcaccatggcaccatggagaaagtactaaactaggggagcaggttcactcacgggcagcctttagctggttctgatgagtcagagatggtggagtatagtgtttagaatctgagagacctgagtttaaacccaggatgttccattaaattttagctctgttatctggacctttggctgtataatggaaatcaccatgtgtgcctaactgacagagatgctatgaggattacatgagacaatgtgggtgaaacactttgcacaatatctctcatgttgttattgttgttgatgataataatgttgctctcaactgtaaaatattaggcaaaaattatctaccacagagggctttcgtgaggaccaagtcagtcaagagatatgagactgattttggaaaattgatataaagatctttataactctgaggtagtttacaacctcccatttgtttaagaataatctcctcccagggtatctagcacttaatctccatggacttactttctgggtaagaaaatgtgtcccttaacgctgtccatatttgtcaagaactcagggagcaggttcattctgactatagtcaaaggaattttggtttctgacttatcttagaaactcagcttcacctagaggcagtcagtggatctagaaaagtgcctttgatcttactttattcttcctgcagttagaattcctaaggagaatgcaaacacccattctacatctgaaatttgaagtctaggcaacagtatggacgtaatgatgtttttcttcagcagggtcagatgattataatactaaagaagaaaagggtctattgatggtcattcttgtcttaaggaaacctgtcctgggattatattataggctgcctgtgttaaaccttgtccttatagcaagttcccatatctcattgcaatctcttttcactagcatttacttctaattatcaaattatcttttcctctttttattttctttctttggcttacattccttattttttcatcctggtttagatctccatattccataaccacagattattattaggaattttaaagtgtgtctaggttagtctttgtttaataggtccttagttcagagggatgtatcaatcgtgtacaaaaagggtagcctttgctataccaaggcgttctgtgatgtcttaagagtgaaacagagtttttgatgtttgcaaactgagccacttttctaagagtattctgaggattaacattccacagaggtcactttgggaaaggctggtctatccaaccccagccatcaggataaattccttctaaagtctgaaccacaacccaggcctcttgactctcagattcagtgttcaatatcacatctagaaaaggactcttggattcgtttttattgctttgtgcctgacaagtaggtattttaaagtgtgctgtgttctcatgaaggagatggttctgaagtatagactataggtaaccatgaggtaaccaggtattacctgttctgaggtgaagaaagagaagataaaacaatggattacaaaactataaaaaccattcctaacttcctcatttgttgaatgttgacagtttacttctcctcatcatataggtttcaaacttttctggttacccatctaatcagtttacaagttcctttcatatttctgctactaataataatattttttttaaaaaaattaccattatctttgcttcggccctggcaatctaaatcctggattatataattacttcctaatttatgtctttcttatcaatccctcttttctccaaactagcctgcacaccgtcattctattttctccataaaacaccactgccaccatgttgtgatttcccagttcaaaaacattcaatagctcatctttctgactttacctctctttattctccaacaggagcctactccacagggctcaagcatagtttgtgcatttctacctctttgtgtctttacgttatgcctcctgtttgtactattctcagtttattctttgtttcttgaaattcagccttattataatcttgctcaaaggttgcctctttcatgaagtcttcccttaccactccgtctttatttaaacttgctttcattcaaacactggtgcagttcatttcacacttaatcttgccttgcgtttaatttttcatgtgtgtcttatttcctcaactgtagtgaaaatttcctttgtacaccttagtgtgtctggttcaatacgatgtgtattctggacgctcaattacaggtagtacaaatgattcgataaatcaggaggaattacatctgtttatttgctctgctcctcagtattgaataaagaattcttataaaagatgattattactttctcctgcagtgaactagtataggatcggatagctttcttattttccttgcttttttatgtgtttgttttaagaaaattcctgtgtgtcattccagaatccattaatttatacagaaagaaagagacgttgactagaaacaaggtctactgagttaaaagttgaatattctatactctaggcacatcattcaattctcttgacttacgtgataatacttgcctctctatacctaacaaaaatatcgaaaagaggaaagtgattttgcccaaacaaaatcactttaaaccagacagaagtgttcaaaaaatataatttttgccaattaaggtcagattctagaccctgaattttaagttttctatattcctcagatgtactttgattgtcgtagttctctctgattatcaaaactgaacaccccactgtgcaaattgccctgagtgcccatgtttggagtctcctatagccttgtttaggtacttctttgacagaaacaaacagcacagcgttcacactaatatatacataatcctttctcttgacataaaatcctgcacctacttttgtgagaaatgatatgtctatgtccaacatttggaatttaattgggctgggggaagggaggtttatattccctgcagaagaataaaaaaaaaaatgactaaaggaacagctatagaatgcagtaccttgaaagagaaaaagtggaaattacattgcagggaaagaatcctttaaagtagaagatgaactctatcctgagaattggctaagagctataatttacagagtcattattagcaattgaagagtaggggtttgatagcagagaactgcacttgcttggtgatgataaaacccccttgtttacctaaaggtgcatgctatccttcctcacccaagtcctctactctaagaagcctatgcttcagaaataggacattgtggcagcaaatgggaaattcatttaacttttgattatctttctccaaagccactaattgggttatctagccactgtggttgattggactatactttttctttaggcgcttagatttagactctccaatttagctttgtttagactagattttagcttatatagcccacaaggtcagctaggaaagagagtaattatttttaattgcctaggatctgattataatgagatatggatgtttgttcttaatctgacctctccctggagtatctcagagcatgttttgtatctctgacctgaacatgccattaccttgttctttcgtatgaaataggctggctgatctgaaaatcttcaaaggatatgtaaaataatatttgaataaagcagccaaacacgtgctatgcacttgaattcaattatacttttagtcttcagagtgacatgagcccttttttgcatctcatctctcagacctttttcagcaagagtcaacataaagttatcacagagtcctgtgtcagaaaccatcaagaatgcacagctgagcccatttttgtatctttctaatggcaagcttgatgaaaacttctaagaaatagggacctcaaaagtttaactgtttcgatgcaacagaaagatccacaaattgaggatattgagagaaaactcatcagtagattgctgaaagtttgatgtaaaatgacgctgagatgttttcaattctcaaatgctttgattttacaagcatcttcaggcaccaaacttccccaaaccaataggctttctctaggcgtcagattccagcagctgtgtaatccttgcgctcctctgatctcacttgtgggatttagagagtgagcatgtttcccttgggctgaatagttctgttattttgagatgcagcatggaaaaaccccacacaaacatctctttctcttgatattttcaacttgttgaggggttttaaacaaagaatttatgagggatcctatctccagcaatgatttcataactaaacagggggacaggtctctgagcactgcatccctcctgaattctcttggaataaggacttgagaaagaaaggccccttatatgaaagggccacatccttgagcactagactttctgaagtggcttcggtttcaaatattctgtccctttaagaaagcttacaaaatgttggttcataagataggattacatccctagaagatggcattgcctcttgtggttcctcgtcttctcacaatagtagcctctgaattggtctttgagctttccatcttcttccctcccagatccctgctctgagatcttgtcctggtttaattcctctgtgggtacacatgcccaaattcagaacaaaaatccagtcacaagtttggcattaagatcctctgtattttggcctcaaattaactcttctatctcatctcttctcttacatcctctcaaccctatgctctatgtgctattttctactccccagcttccaaatatgttttatattcccctactcaagtactactattttctccagcctgaatatattctcctactccaatattactcacctttgataccaaagaaaagatgctcatttttcatgaagttttctttgaacagcaaatatttattaattatatatgttcaaggttctatattaggcactggagagaaaacaatcaataggaaaggcaagatccctgtcctcatgaagttgccaaaaaagaactcaaacaagcagtgacaatgtttttccttgctcttacttgcaactatcagtatctctctcagaactcagaatagtcattgtcgaaatcactaatttgacaactaattgcatgttgctttgtgcaatctgaaatcatagattgtgagagctagaaggaatggatacctgcctgcctgatgccagaacagagatgataagaagacagccattggcctgtcccatctagatttgccttcttgaccaccgtgggatgatttcaggggctatatagggccacttccaaaatactccattgctttaaagctagcaaatccttgttttattttataagaagggcacagacctgaactaaaatataatgaacaatcagcaaattaatgatagggttcaatggaaaggtgtccaaatatttaagtttgactaaaagtttacaaattgtcaaaatacaagagactcaatcttttcagtttggataaaggaggttaacacagaaggtagaaaagagcaccaaagggaaacgtaggctgcattgttttctttgccaacttcaccgtttttccaaaactacttgtattgataaatactattttatgcctgttgggtaaaagtttacccgtcaatgggctgtgtatgccagcttcccccaaagcagctgggatgatcctgaatctagtaaaagaccagagctaatcttaacaaaggccatagccctccaaaaatgacagaccttaagacattttgctttggcatgagggggacagtaataaggaattacagaatgctcttgaacttataagtaatttccttgtcctctaaatttcaaactatttggcatggttatattagctttagggtagaaaaacaaattaaatgcaaaagaatgatcactgtctaccatcagatcacagcctgagcaggtacccacagtcaacaacaaacccttgccactaccatgtacccatcaaagctaatttctcgtcagggcaggaaaggaagaaaccttcattgaattgctgtttgttttgtgggcaagcagtgcagcatttctctaagtaaatacattggagaggacattagaaaatgcaacaagaaacattattttaagttagaaaacaaactggaaaagcaatgaaataaaatatgacaattatgatgaacagcaaagaggtcatctggaatcctgcaaacagtagcaaaattgcttatcatgcccctgattgtgaaaatctgctgaactcctttaataagaacacacagtctttgaatggcatctcattcccccaaacaaatactagaaataaggggaaagaagtgcaaatagttatgctagtcagataggaaaattacaaagtggctctggaagcagatgtttggggtaagattctggaggaagaagagcaacaatagccgcagcagcagatttaagaacctcagccaaagaaacagctaggctgtttgttggggaattgctgcatcagaatctttatgtcttgacttgggctggttgaatttcctggagaagattcttccaaattcctactggaggatgaagtcctgactaccagcattctggtggttgggaaaagaactagggtctcagcatccaacagtcgtaagtggcacctggcatcctcaagtccaaaaactccctattttatgctctctaaagaataattctttggggttttgcttgggtgggtaggggcactcccatgactgttctgaggggaaagtctggctgccttttaaatatactttccaccaatcctctttattttatccattttacccgatttccacccctgccccactcctagagataccagtgcctccagtccctgagtgttttagggatggtgcagtataaatcactttggcttccattttctagagtcaaccaagtaacacttctcaaactttaatgtgcttgcaaagtagaggaatatattgtggaatgcagattttaattcagctttctgggatgctgtcagtactagttccagaaccacatttctccatctttgcaatcctaaaattttcttgctcttgttcttctgtccttgttgctttattcatttaaaaaacaaattcccttattgtcttctcagtggagtttcaggaggaaacaaatagttgtttatttaatatgccatttctacccaggaattcccattcattattcacccactcaatctggctctgtctccatagttccactgagctgaaaattcttcttgtcacaggtaccaaaaaatttctctttatcttccatatgttttgtacagtgattatattacattttacaactctgaatataagaggaatgtgctgaattcatatggcagattctgtggtcacttatctgttcacattacacacctctcaggaacactccatgcagtgaccattcgagtacttgacacatgttccttttttgactttcagtgtctgtgataccacactagttttcctcctatagctcaggcaaaactttgatctcctctgctgacttctctattgcttctcagcctctagatgttggagttcccaggcttcctcctgaaccttcttctgttgtgcatctgttctctctgtatggtgagctcatccagacagctttaaatatcacctacattcagaatatgtgtgccatttctgactgccttatggagcccaagacatataatattcaactgaaaccttgacttctccacttgacttttacaagcatctcaaaaccaacaaatagaaaatagtaacacttaattgccttcctttaagccccacagaatctcttctcccagccttcatcatctgtataaacgcacatgtcaccaaactgtcactcccaaatccaatccatcaacaggtgctggggatttgacacataaactatagctccaaactcttcatttatccgtatctcccctaccaccactatagcttaattcaccatcatccctcacctgggctactgcaatgtcccctaccttttccatttccttgtttcacttgaattaacagtctatcccctatgcagcagctagaggcatttcaaaagcatatgacatccaattacatagaacttcatttagaataaaatttattacactcatgttttatgactgcctactatgacaggcactgtttgaggtgccagagagtcaggagtgagcaaaacagacaaaatatctttccttgtggagctaatgtgctttgccatgactacaaagcaccccatgatttgacctcttcctgtcaccctggacccctttctactctttagaaacactaggctctttcctaccttagatctatttttctctttcctcttcacatctttcagcatgatgagatgacacgagatgacttttcatcttttcagtctctacccaaatgccacctccttagaagggtctttttgaccactccactataatagcacataaacttactacaacttgaatgttttcatttctttactttcctccccaccactagaaactagaactaaagttgaatgatggcaaagatttcaacatgttgaatagtccccagcacagagtaaacactcaatacatatatgagttgaaagaataaatgaaagggcttctcaagcaaataataactagaaggaaagactgaatgtaacaaacatctaataagtcctactgtgtcactatgctgcatgccacctatagcatcttgcccaacaattttgcactgtagctattactgtccctattttggaaataaggaaactaaaatttaagaattagcccaaagtcactcagcttctcagtatcagaattgaaattgacatctcttatatacctgattttaacatgcccattctttgtatgaacaaggaaaaaaagacacagtgggcctctttttactctgaactcctaaagtaaagtctaaactcttcatctgagcacttacatatgtaaaatgctggactcatctttaatacagaacttatgtattattttgtctcccatatatagtaagctgaagattagcactgcactcttctcctgtacccagtcagggttggcgacatagtttggatgtgtgtcccctctaaatctcacatggaaacataatccccattgttggaggtggggcctggtgggaggtatttggatcattggggtggatccttcatggcttggtgctgttctcttgatagtcagtgacttcccgtgaactcctgttgttgtaaagtgtggtatctccccactaccttgctcctgctctgccacgtgggattcctgttcctccttcaactttcattatgagtaaaagctccctgaggcctccgcagaagccaagcagatgccagcaccacacacttcctgtagagcctgcagaaccatgacccaattaaacctcttttccttataaattacccagtcttaggtattttttaatagcaatgcaagaacagcctaacacagatgggtacaagcaactactccatgaggagagagaaagagagattcaatcagtggggttgtgaataaatagaaggactaaaaagtaaatgcgatgacaatttccagaaataaattacaaagtaatcagaagctggctaatgtcaaggagctgtttgagcaatatgtatgcctatctatagagtgggtggtatcagggctggctccaactttattttgccttttacacatttcttatgaagatggtgcccagaagtaactgactctcagcaggttgagtagctgatcttctgcagatgtagaggcttagcagaagtgaatgccatgtgaaaatggagtacttaatggaggctcaggaatcactgtaaatgctccctaaatgctcctcactgaattagatgaaccttgatgatagtattttaaaaatcccatagagttcaggaaaaaaaaattattgatctatcatgacctcatagccttttctaagatttatttctagatgtggggaactgtacctttttttttttctctctttttttgagatggagtctcactctgtcgcccaggctggatggagtgcaatggtgcaatctcagctcactgcaacctctgcctcttgggttcaagtgattctcctgcctcagcctctagagtagctgggattacaggcacgcaccatcatgcctggctaatttttgtagtgttaggccattcttgcagtactataaataaatacctgagactgggtaatttatgatgaaaagaggtttaattggctcatagttcagcaggctgtgcagaaagcatagagctgatatcactcagtttctggggagacctcagggagcttttactcatgacagaaaacaaagtgggagcttgtacatcacatggcaaaagcaggagcaagagagagaatgggtggggggtggtgcgggggcaatgccacacactttcaaacgaccagatttgtgtgaactcaagccaacagctcacttatcaccaaggggatgaccaagccattcatgagggatccacccccatgacccaaacacctcccaccaggccctagctccaaaattggggattatattttaacatgagcgttgggtgtggacaaatgtccaaactacgtcagatgtgatgtcctatttaggccaaagctgccctaacaaatccatagttccctaagtaatacaatctgagaagcactaagctggctcagttgcccccagatatatcctctgctacttgtcacaataccaccattaataaatcaattcttggagccttaaagattgccctaatttcaaatactctgcatttgaaacataaaatttcttggggctgggtgcggtggctcacgcctgtaatctcagcactttgggaggccgaggcaggctgatcacgaggtcaggagatcaagaccaccctggctaacatggtggaaacctgtctctactaaaaaatacaaaaagttagccgggcatggtcaggggtgcctgtagtcccagctactcaggaggctgaggcaggagaatggcgtgaacccaggagacggagcttgcagtgagccgtgatcatgccactgcactccagcctgggcgacagagtgagactccatctcaaaaaaaaaaaaaaaaattcttggaagttaaaaatctttacctttaaaggctggcactttagcatttctccaagtatatgcctcacaaccctaatttcatgacactccataaaaagtaaatttttaaaaggtcttccatggtcagcttggtttggaaaatgctgcgtgctataccctcattctagagattcacatgcatatacataataaaggctctcagaggcagtccaattttgtataactcataagtattctaccttccacacttcaggaaactctcatttagtaaaatgtagctaactgaaaataggctttggcaaatgggtctccatatacacccaaaggaactgaagggttgagaaaggtactatgtacaacccaaaatagatggtagacaccaaaatccctttttaaagttctatgtgggccaagtctcctgtgaaaacctgcattgttcttcaaattagaaaacattgccagatgagcttgagacagtatatactacctccttccccttgttttagaaatgtaaaatgaagcccagtgaaatgaaatgatttgtctaagatcatgtgggtagttaaatgtattgtttgtccgttattgacaaagcctacaattttaagcttgctattgcacagacgacctcccactaccacctttatctcataccccacacacccaagggaacaccttccagaaattacgagcattagaattccactggtatttttacttttgcattattaaaaaaaaacagctttgagctataactcacatacaatacaatcttctcatttgaagtgtgcatttgaatggcttttagtatattcacagatatgtgcaaccatcaccgtcaattttaaaacatttttatcatctgaaaagaaaaactcatacatgttagctatcatcctccattcatccctgagcaagcactaatctactttctgtctctatagatttctctattctggactttcttatgagtgggatcatacaatatgaagtcttttgttactgtattctttcacttaggataatattttcaaggttaattcaaattataatgtatcagtactctattattttaagggtcgaaaaatatttaattgtatggatatgccacatttcgtttatccattcatctgttgatggacatttgggttgttttcacttttgggctatgatgaatgatgctgttttaaacatttgtgtacaagttttagtgctgacatatgttttcagttttcttggtgtatacctaggagtgcaatagctgagtcgtgtttaatcctttagggtatcaccagactatttttccaaagtggctgagccattttacattcccacgaacagtgtatgaggtttactattttttcacatcattgtaattgcttaatatctgacttcttgattccagcaatcctcttgagtataaagtgctatttcattgtggtttttatttgcctttccctgatggctaatgatgccaagcatctttcatgggcttattggacatttatatctctcccctaaatttctattagatataaatcccttatcacatgtataatttacaaatatttttgtcccattatgtgagccttttcacttttttgaaggtgtcctttgaagcataaaggttttaaattttgataacattcaaagtatttttttattctttttttgtgcttttggtgtcatatccaataatcctttgccaaatccaagattaagaagatttatatctttatgcattcttctgagagttttataattttagctcttacctgtgggtttttatccatttttagttaattcttgtatatgatgcttgataagtatccaacttcaatcttgcatgtgaatatttaattgtcccttactaaacaattgggaccatattgaaaatcagttgaagatagatatataggtttatttctggactctcattgtttctgttccatttacttatatatctatccttgtgtcagtatcacactttcttcattactatttctttctactaagttttgaagtcagaagtacaatcctccaactttgttctccttcaggatggtagctatttagagtctcttgcaattccatatatattttagaatcagcctgtcaatttcttcaaagaaatcagctgggatactaacagggattgcactcaacctatagactagtttagggagtattgccatcttaacaatattaagtcttctgacctatgaatatgtaatactttcccatctattttaattttctttcaataattattttatagttttcaagacataagttttgtactccttttgttaaatctattcctaagttcattttttataatactatcatgaatgaaatttttctcttatttttaatttgttcattgcaagtacagagaactacaattgattttggtatattgattttgtattctggagacttgctgaactcatttattagttctaataattttttagtggattccataggactttccatatacaggaatatatcatctgtgaatagaattactttaacttctttctagtctgtatgccttttattactttttcttgtctaattactttagccagaaccttcagtacagtgttgaatggaagtagtgggagtgcacatcgttgtcttggtcctgatcttaaggaaaatcatccagtctctcaccaatacgtgtgatgttagtggtggttttttcattgatgactttttatcagactgcggaagtttccttctatttttgttaagtattcttaccaagaaaaggtgttaggttttgtcagaagctttacatgtgtcaattgagacaattatgtgatttttgtttttatttatattgatgtaatatattacattaattgatttttggatattaaaccaactttgccacccctggaataaaactcaattaattaaacatgatatataattatttttatatgttgctagattcagttttcaagcattttattgaggacttttgaatttacattcataagagatactagtctgtagttttacttgcttgtgatgttttgtctgcttttggtatctgagtaacactggcctcatagaatgagtgcaaaagtattttctttttacttttgggaagagtttgtgaataattggtatttattcttcattaaatatttggtagaattcaacagtgaagccatctgggtctggcattttctttgcaagtagttttttggcttctaattctaatctctccagttgacacaatctatttatattatatatttcttcttgagtcagtttcagtggtttgtgtctttccagtgattttccaaatttatctaagttataaattatctaacttattggtgtgcatttgtaaaaatattcctttatttttctttctttaaggtgagtagtaataccatatcttgcatttctgattctactaatttgagtctactatcttttcttcttggtcattctatctaaagtttgtcttctttttttaatcttttcaaagaactagctttgggagtcttttttttattccttattttattaatttctgttgacacttgaccatagaacaacatggattaaactatgtggggcgacttttatgtagattttcttccacctctgccagccccccaagacaaccccttgtcttcctcctcccctcagcctactcaatgtgaagatgacaaggataaagacctttatgatgatccatttcacttaataaatagtaaacatatcccatctttcttaaaagttttcaataatattttattttctctagcttactttattgtaagaatacagtatacaatacacatacagaatgtgttaattgtttatgttattagtaaggcttttggttgacagtaggctattagtagttaagttttagaggattcgaagttatgcgtgaatttttttattgcatgggggttggtaaacctaacctccacattgttcaagggtcaactacaatctttactatttccttccttcagcttgctttagatttaatttgctcttcttttcccaggatcttatgatgaaggttgggttattaatttgaaatatttttttcaaatacagctatttatagctataaacttttctataagcatgaccttagctggattccataagtttagtatgttatgtcttaattttcattcatctcaaagtgttttctgttttccttttttaaaaaatgtatccatttgttattgagtattgtgctggttaattttgacatatttgtgagttcccaaattttttcctaatatttatttttcattccatttcattgtagttggaacacatactttgtattatttctattcaatcaaaaatattgaagtttttttttaatggcttagcatatggtctatcctggagaatgttccatgtgaacttaagaagaatgtgtatctcctattgttgaattaactcttctatatacatgtctgttaggtctagttgatttataacattgctcaagtcttttatatacttgatattctgtctagattgatagtttagggtacatgtgcacattgtgcaggttagttacatatgtatacatgtgccatgctgctgtgctgcacccactaactcgtcatctagcattaggtatatctcccaatgctatccctcccccatcctcccaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccatacaaaggacatgaacgcatcattttttatgtctgcatagtattccatggtgtatatgtgtcacattttcttaatccagtctatcactgatggacatttgggttggttccaagtctttgctattgtgaatagtgccacaataaacatatgtgtgcatgtgtcttgatagcagtatgatttataatcctttgggtatatacccagtaatgagatggctgggtcaaatggtatttctagttctagatccctgaggaatcaccacactgtcttccacaatggttgaactagtttacagtcccaccaacagtgtaaaagcattcctatttctccacatcctctccagcacctgttgtttcctgactttttaatgatcgccattttaactggtgtgagatggtatctcattgtggtttcgatttgcatttctctgatggccagtgatgatgagcatttcttcttgtgtctgttggctgcataaatgtcttcttttgagaagtgtctgttcatatcctttgcccactttttgatggggttgattttttcttgtaaatttgtttaagttcttggtagattctggatattagcactttatcagatgggtagattgtaaaaattttctcccattctgtaggttgcctgttcactctgatggtagtttcttttgctatgcagaagctctttagtctaattagatcccatttgtcaattttggcttttgttgccatcgcttttggtgttttagtcatgaagcccttgcccatgcctgtggtcttaatggtattgcctaggtttccttctagggtttttaggttttacatctaacatttaagcctttaatccatcttgaattaacttttgtataaggtgtaaggaaggaatccagtttcagctttctacatatggctagccaattttcccagtaccatttattaaatagggaatcctttccccattgcttttttttgtcaggtttgtcaaagatcagatggttgtagatgtatggtattatttctgagggctctgttatgttccattggtctatatctctgttttggtatcagtaccgtgctgttttggttattgtagccttatagtatagtttgaagtcaggtagtgtgatgcctccagctttgttccttttgcttaggattgttttggcaatgagggctcttttttggttccatatgaactttaaagtagttttttccaattctgtgaagaaagtcattggtagcttgatggggatggcattgaatctataaattacctcgggcagcatggccattttgatgatattgattctttctatgtatgagcatggaatgttcttccatttgtttgtgtcctctttatttcgttgagcagtggtttgtagttaagtggtttgtagcttgagatcttataacttcactctcctgacatggattcactgcctcatgaactgggacaagagctatcagagacccatattctcaacaggtcatggtcaaggtagagccttgcttgcacaactgtggcttggtcagaagaaggggaccccaacctgttaaatgctgttgcacaggacttagcctcagcaacgggcagctgggataaggatgagaaatgctgaagtcctccttatcttgggaagaaagtcctatagttaggagctagggaagagggaactctgtgttctttactgcagcagtctggagtggggtctccacccgctctgagatgagaggagagggagcaagcggtcttggttcaaataccacaaacttgcctttttttttttttttttttttttttttactgagttttaataaatgttcttgaataaatgtgttcttatttactcttttgcccttaggaccatttcaagaaactctgaatagtttttgtttggtttttataatttttatcagtttcaccgtggaacaggacagcagagctccttaaactgtcatgctggaagtcaattccacaactatgtttttgaccaggcaaagcagagagtaagtgggttgtggttgaaagaagcaaagcagttaggtacccaggattatcatctttgaagttcttggtgtgcccttgaacaaaagagaacagttgggcaagccaggaggaaataaatgttattgcaatgaagttacttatcccattttttactttaatgtgtcccatgtgcattattagtgttaaataattcagtatgcatgtcctaaatactggtctggtgaatggtaatggctctatcacctgcaaaataaggccaataactgttctttttggcagacataacagtttcttaaacagtgtgacatggtgagcaaaacatcgaaataaaattacaactgaaaagatgctttccagtgctcctttgatttattagattaaagggaaagaagagatttattttcttctgagcaggatagaaacaaaaatgaccttttccctgagtatttacagtcctgaacattgactgaagtaatttcaccaacagagtgcatgcagttgtgccaaacggaaaacaagccaaaagttatatcaaagtcctgagttcagcatcttcacagcaaatcactgagaccctaaacaaagcagtacatcatccagaacatgtaactacaggcaacacatctttactaaacacttaaacagtgtatacagccacttgctgggatttaagagccaaggatgcagccctgacacatagactcttttaatgcagctaaagacacacatgcacaaacacagaaaaatagaataaggcttttcaagttgtcacgtgataacataaggataggatgggcagagcaatatttgagtcctcagaagttctttaaaagaagaggtaactacacttgaataaacaaaggatggggaacttcctttaaagggtgaggcatgtgctgggtataaaaaaggatttaaatatatggtagtaagagagaagccatagttggtagaaagaacttctggagaactagtcaaacaggagcaaatcaaagaaattgttcttgttcctgaaggaaataatattttctctgaattatctattttatttctagaaatgtgccaagtacagtgcttgagtaggggagagggtagttgaagcatttccatgtcagatctttacattcaagataatacagcaagaaataatgcagttcttttaaaaatttgtggaggtttaggtagaaagaaacaaaatgtggtacagagaaacttagtgacgtaaaataaacggcttctcaaatctccgtaaactgaatatagactctgccttagtttgcaattgagaaataatgtatttcagcaaataattgattatttatttatttgtttttattgcctgcagtatggactagctcagatcacactatgcttagagggtctttggattcaacatcctatgtttctgacttacttaaacatggtgttaacttagtcttttatgcataaaagcaaataggctccaattagatataaataacttttcctagaattaacttgaatttatcatcttgtttgttggtcttcaactcgtctttcttttaaagaaagaaaatagcaaatgaataaaggactgagtataaataataaatattaccaaaatgttttaaataacctatctccccatttattgtatttttctaactcttcatttaaggtgagcagtccaccagctactgatacatggctcatctaattttatttttgcatcactctgttaagctgtcttccttccaataatcattatggtataagtaacactcccagagaaatcaatttatcaatttttttgtactaaatagagaagcccatttacctccccggaatcataattggggctttgtttattttgctgtagtttgaactctataacagcccccttcttgtttttacctaagttgagtagcttgtctcctacaccctccagggaaggttggccagcctcgaggaatgtccctcaccagtagggaataattagaaccatttagaaatcagaagtacatttcagagcaactgggtgaatgtcattttcctaaagattgtttaaaggaggagacccttaagcccctgagggataaagtatcttattttctctccactaagaaagatgtaaagctacaaaagtcattcagatttgtaggagcataggtctgaaactgttatgcatgtcttaaacctcaagagatatctttgaataaatgaaattaatgacttgcactaaattcaatagatgagttgaactgaattggattgtattgaactaaattaaatttacttctctaggctgacagaatggctatcatgagagcagaatgaaggccagagtattccattcaccagataatcaaggccagaacttggaatgatcagggagtccaggccttcctggctattgaggacactgagattaagcgatttaccccaggacagatagcaaaatgggagcagagcagagattccacacatgataacaatacaggcaaataactgggctcacccatgttaagtatgtactgtgtgtcaggcacagctctaagtgctttcttgtactaccttatttattcctcctagcaaaacatcagggcagacccctctattatcctctttctcagaaaaagctactgaggcacaaagtaattaagtaacttgcctaagtggtacatccaggatttgaacccaggaagtaagatctcaagacatttatcatatccatttaaagacgtcacagtcctttgagaaagagagtttataacatagcacaaataagatttaaaacaaaacaaaataaaacatgttaaggaaattgagaaatagaaaaattttctccctctgaaaaacctgaaattataaattgtcctaatttcctgaactcaaacattttaaaataatcaagttttacaactctaagtttcctgaagttcaacctcagtagggtctgccagaccatatggtacagaattttgaaggcgcgtcaggattctaatttatgagaatactatataaactaaaggtttttgagataacacattatctcatatttatatttatgtatcctttatatttgaaaacacagctctataatgttgaaaatgttcagttagtatcttgagatttggagcccccagtcagtgatggacaccatgctacatcttcagctccagaatgaccaggaatcctaacactgtgttatttccctgtcttgtacacaaaaaggcccatctgtctctggatctgctgctcacatcagtgaggactgattgagtgcttccaatagccctgcacacagagaagcacttatcatcctatcagaatcagaaatacacaaatgattctgattattgactattctagtactgaagatctgcattccatagagttctgagcacatggaagtcatcctgtggatgggttaattagcagcccctactgactagaaactaaatagaaatcaggctatctggcctggctgtgagggcagggaggcaagggatgactcagaatcaataggtgttgatgggtgacgtgaggtgtgaggaacagggcagcttcaaggaaaacacccaactgtgacatgagcaattcagtggaaggcagtggtatttactgggctgtgtgaggagcaagacaggcaggggaaagagatagtgaaaacaaaagtaccatttgggacataaattttaaatgaatttgaaacatataactgaaaaaaaaaaaaacaagaaaacagataaacaatctggatgattcatatgctttaacgaccttcaaagatgaggatgtgaaattaggattgtgagaaaataatagagtgatgttaaattttctggtctaaaatttctaaaatctgttttctaccttctgaaaaattgaaccattacatgttattctcctgtcttctgatatcagttctatttttcgtcattcttcaaagattaaggagtttcctatccacatgtccgagtttttccagagctttgagatgccactcatctgtgtctgaatcagagactcatttaaagcagctagctgtttctgtcctctcttctcccacatattgaacttcatttttatagaaaaaaaaaaaagactattcaacaccttcctggacaattctccctgcttaagaaggtagaagtcaaacagaagacaggtactttagtgttgttatctgtgagtgttacagtagcagcaggctgatcatcccttgcttttcttcttgacctgaataaagatgaaaagtcagctttgtaggtgttagcatttttttttttccaggccacagctcactgtaaggtttaggttcctgttactcttttgtctttactcttaatattatgttcctttattttgtgcatggtatagctttcttagtaaaatctttttcaagcttttttctcagtattgctcaatttgtgtgtgtgatatcagttataaatgcttataattttactttattagtttaagaaaatcctcccattcattcactcatttattcaacaagtgtctgttcagtatgcactgaggcagtcactgtgaagcacagaaaaactaaccagacagagatttgagttcaagcataaattggctgggcacggtggatcatgcctgcaatcctagcacttgggaggctgaggcaggtggatcacttcagatcaggagttcaagaccagcctggccaacatggtgaaaccccatctctactaaaaatagaaaaattagccaggtatcatgtaatcccagctacttgggaggctgaggcctgagaattgcttgaacctgggaagcagaggttgcggtgagtggagattgcgccactgcactccagcctagggaacagagtaagactccgtctcaaaaaaaaaaaagaagaagaagaagaagaagaagaagaagaagaagaagaagaagaagaagaagaagaagaagaagaagaggaagaagaagaagaagaagaagaagaagaagaagaagaagaagaagaagaagaagaagaagaagaagaagaagaagaaagaagaagaagaaatcatgcacaaatcaatgtgccacaagagatacacaagtcttaggggaattcagacaagacaggtagcagaggcaggattggcaagatgagagtgtgtatcagagaaggaaagcttcatcgtgcggatgtcagtagacctgtgccttggatgatttagataagggaagagatgtatttgtgtgtacatggggtgtgtgtgtgtgtgtgtgtgtgtgtgtattgtggtggtcattgagaaagaaacagggtatttcagaagaaggaaagaaaggacacgttcaatttctttttcctttttctccatgatgcacttttcttgctacttctcatctactcttttatatgctcagatatttcacttattttgctactggaagaatctttttctgtttttctttttttttttttcttagacaaagtcttgctctgttgtccagggtggagtgcagtggtacaatctcagttcactgcaatctctgcctcccaggttcaagcgattctcctgcctcagcctcccaagtagctgggattacaggtgcacaccaccacgcccagctaatttttgtatttttagtagagacggggtttcgccatgttggccaggccggtctcaaactcctgacctcaggtgatccaccagcctcggtctcccaaacggctgggatttcaggcatgagccactgcacctgagtctttcatccaaggttattattctatctttcccacatgcctccctttctttccactgagttttcccaaatccctccttggttgcccactctttctctaccagcttacagaagtgaatactctttctgtctgatgaatttaggaagcagagatattgcatggatggttccttgtgagggaggcctgcaaaccatctctgtaactttcacattctatcttgagaggtgtgtcctaggacaaggagtgagcccaagattagaagtgaaaagacctgggctgtggttgcagtacgaagagcacatcattacataacctaagaaaagcatctaattctctgggcttcagtttattcctctatacagtgacagaattgaacatagtgatccccagtcccttccaatcccactaaacagaaggaaaacttgagccctgaaaattactataactgaggtcattcaaccatttgatattaccatcagcttcatgtctagtttactcttctcttgctattacttgaatatgtcccccaaagtttatgtgttggaaacttaatccccagtgcaacaatggtataaagtggggcctaatgggaagtgtctaggtcatgagggcagagaaccctcataaatggattaatattgttatattatgcattattgcaggaatggtgtttgttatcaaagtgagttcaatcccttcttgccccctctctctctccccccctcttccttttgtgtgtgcacgcgcatgtgctctcttgcctttccaccctcccccatgggataaggaagcacaaaggcccttgacagacatgggaccctcactcttggacttttcagcttccaaaactgtaacaaataaacctctgttctttttaaattacccagtctcagatattctgttataacaccacaaaagagattaagacaccttcccaacttaccattccacggatcctttactgctttgtcatttgtgattctaggaatcccacatgggtagtggaaattctgcttctcctaccagactctttcttctggcttgttatgattaagcggcagcaggagtaagctagaagacccagtgtctatttatggacagtttgccctctagaccctgctccaggaggagaaatagcagaggttcactgaactcatcagccatccacagtttcctagtctttaggtctgttagcaactgacatttcatctgtaccacgacagctagtggcaagactgtggagttaggaacacctcaaatttaagtgtatagctggtcctggctttccttatctaagtccaatatttacaaacaacaacagtcctgcaaattcgaggcagtgatggattttagattcctcaggtaattggatgttatttcctaaggcaagaagaaagcagagactgtatatcatcaattcattcgtgaattcaacaaatacttattgattgcctactgtgtgcgagacagtgctctatatgctggagatgcagcagagaacagaactgactgcaggaagaggtgatcagctctcatggactttatattctatagcagatgactgataatgaacacaaaaaataggtaataagatatataatatgctagatcaagtgttcaacctgcagctcacaggctgcatgaggcccaggatggctttgaatgcagcccaacacaaacttgtaaactttcttaaaacattatgagatttttttgtgattttttttttagctcaccagctattgttaatgttagtgtagtttacgtgtggcccaagacaattcctcttgttccaatgcaatccaagaaagccaaaagattgagcatccctatgctagatgatgatgtatgctactaaaaaagtaacgaaacaaagaaaggcaatagggaggatcagacatggtagatacactgtccaggaagcccatcagaaaaagaaccaattgagtaaagactatatatgttgaaggaccaaaccatgtgggtatccgagggatgacaaacaagcaagagcagtgactctgggacaggaacacatctgtttgtacaaggaacaacaaacaagttagtgacaggtgacaggaatggatgagtggacagggattagtgtaagataaggtcagagagtaacagagaaggttgcatgtaatgaggggccagtggacccctgtaaggacaccagttttctttcaggatgaggcaagaagcaattgaaaggatgtgatctgattaaagctttaagaaaattactgttgactaaaggaggtcaaaggagaaacaggaagatgatttaggagactattaaaataatccatttgagaggagttgatggatcacatacatgtggtaacagagaaggtgatgagaaggggtcggattctgggcatagtttgaaggttgtgacaacaagactactgacaagtctaattggggacatgagagaaaatagtgtcaaaattgttatagggttataaacctgaacaattgaaaaaaaaatggagctacagtttcccaggttgagaaaagaacacaggagaaacaaggcagggaggatgaagatcatgagataggcgtaaaactaggaaagacagctctttatacttttaaaaataattctatagcctaaagattgtgatttggatatgaatgtaatattaattatatttttgttttctgataccacctaggataaacttttgcccatcccttgcccttagaatactacactaaaaacttacacttaaagaaaactcggccgggtgtggtggctcatggctgtaatcccagcactttgagaggccgaggtgggtggatcacgaggtcaggagttcaagatcagcctggccaagatagtgaaaccccttctctacttaaaaaaaaaaaaaaaattagccggacgtggtggtgggtgcctgtaatcccagctactcgggaggctgagacagagaattgcctaaacccgggaggtgcaggaggtggaggatgcagtgagccgagatcatgccactgcactccagcctgggtgatagagcgaaattccgtctcaaaaaaaaaaagaaagaaaaactcaagagctcttgaagagttacattatacctcagtaatagctttaaaaaaccctcctaatagctaagcaagatccctacagctacagacttaagccacataccctagtatgtctagtgaagacgcaaagagaaccctccctcccctgatgataactactcatttgattgtcaacattctgcattgttcttccttgctttgtcctctcccagtgcttctactgaatcccttctctctctctcccctggggagaaacactgaatggaagtctctgttatctgaatcttgcatgaagggcatgattccttttattttaaagttgtattttatttttaattgacaaacaatcattatataaatgtatggggaacaatgtgaggcttcaatacatgtatacactgtggaattatcaaatcaagctaattaacatattcatcacctcaaatatttgccatttctttgtgatgagaacatttgattatttttttaaaatttgagacagggtctcaccctgtcatccaggctggagtgcagtgatgcgatcatggctcactgcaacctgaacctcctgggctcaagcgatactcctacctcagcctccctagtagctggtactaccagcgtgagccaccgtgcctggctaattattgcatttcttgtagagacagggttttgccatgttgcccagactggtctcgagcaatctgcccgcctcagcctcccaaagtgctaggattatagatgtgaaccaccgcgcctggctgaaaacattttaaattctcacttttagctattttgagacatgaaatcatgattccttttaaaacagagtttatagacctgatagggaaaatagactctatatgactcaggtatataagtctcttaaattctttatgccttggatgtttctcatctcaaaccaaaatgtggaggaaaggaaggaaggaggcgaggaaggataaaggaaaggagggagggaggaaagcaagggaagaggaacactacagttcttggagaagaggatgatagagggctaggcagatagactccagtatatcttcataaccataagacacccttcatttaataaatgtagaagttgagatttagaaaggtgacatgaccttcccaaagacagagtcaggatttggcaaggccaagaatggaacccaagatcctgggtgttaatcttagcagaagtgagccagccctcttcaccaggagggactttaaaagtgaggcagagaataatagcttccatataatagacaatggaaagctattgcacaccctggagtaggagttggaaatcatgtttctggagtgttctcttgaaggtaagtgtccaagacaaattggaaaagggagagacttgtaacagggaggagacagaatgcaggccattatggttagtcatgaggtatacaacactctcagccaggataaaactagaaatgaggaagaaagagtgtatccaagacacaatttcaaggaagaagtgatcagacttttgggtaatgagaattgagagcaagagacaagtgtaagaagaccccgactgtagtaaccatggaagctggttcactgtttcataagcttgttgtcactccgtgaatccattcatagagaaggctagagccatcccccctctatgcattaggaagatgacagttctgtcagcaaaatcagtaaggctccagctcattcccgtgtaagccaagaatatgcccgtgtaggtctgtcagtctgttttcagctctttctttccatcatgaaagtacaaaggaaaatgctcagaacatgctttaggcaaagcatattttatcctaaagttgagaaaggaaaagttcacctctctcaccaccaatgccaggatttggaaagcaccaaaaagtggataaaagaaaataagctacagcaagggctctgattctttagttatgagcaatttgtagtggcatgcatgttgcctgactgagcggttatcaggaggtaaatacaaaaggagattttattgaagtgctttggatgacaattttctcaaataaataaataactggaaaaacatcctgtcaaaagaaagggtgtttgtttatttttgtcctgaagatacagatcacgaaaggatgaggcagagaagaaacactaccttatggatatttttcttaaggaaaaaaaaaaatctttgctattaaaaatgaaagactcagggactttgatgcggtggcaaccagtttttgggtgacaaactccgatgttggagttaaggttgctatgcacacagctcttccttgagctgctgtctatataagcaccaaggtatccagaatgacaactgcaaggcaaaggaagtcattaagtcatatagaagtctgtcactgatacacagaacctcagctaggtatgggaaagcccctaaagaatacctggaatctagtagacacctaataaacaattaacccacttcccacactgctttcaactctagagatgcacaggactagggacttttagagacatcaatacaggccagatttctgttcctgagagctcttttaattcataatagctaccatttacagggtactttacagtttacaaaacactttggcattatcttatttggttccacaaaggaaaatagaggttattattttgtactgaagagaacactgaaggtcagggaggttaaatgacttgcccaaatgtatgcacttcataaataatgaaatagattctgatccaaagttgtcaaactttgaagcccaaaggtaggttatggaaatcactcagcagtgtctggcacatagaagctgctcaataagtggcagcacattattccctaacacacaataacttcactgaccacatattatccaaaacagcttgtcacgtggtttagcaatttttctttcaaaggatgaccatgttaggtgaataatttggtttatcatcacttgctatctgaaagtctctacaggacttctaattcctgataatttattaagctatgaagaaaaaccccaaatcactagtgttctcctggtatatcacaatgcatcttactctcatattctaatatttgttcaacctgtacggatataatattggtttacacctaaaaatatgaaagcaaagtggaaaagaagcagagatatactcagcatctactacaggtcagcaaatgtggtaagctcttttaaaacaacttttcaaagagctggccttgtagcctcttttcctggaagagagtgaggccagagaggttgtataatatgtccaaagtataattggtatgataatgagccaggatttgaacccagaaagtgtgtctagctccaggtctgccctatttcaactagagcacaatatctcttgattctagagattgctagagtgctatggagtgcaacttacaccaacaaattccagctctttcaaggacataatattatatcactgtatcaatacaattcgaagtgctagattcttccctgacttattttaaagtgtcatccaactacaaaagaccatcctgtccagcaacagaaagcagaattcatcagtattatccacagggaaacataacacattttcctcaaattttgatttataatgaatttcactaccatcctgacttaggagatgaaattctgtacctaaagcataaggttgcaacagtttcctttcctttttgtttttttgtctgagatggagtctcactctcttgcccaggctggagtgcagtggcatgatctcagctcactgcaaccttcgcctctctggccccggcgattctcctgcctcagcctcctgagtagctgagattacaggcaggcaccaccatgcccagataattttttgtatttttagtagagatggggcgtcaccatgttggccaggtgggtctggtactcctaacctcaagtgatccacctgccctggcctcccaaagtgctgggattacaggtgtgagccacgatgcccagcctcctcccactttaaagagccgtcatagagcccactatgtgcctgccactgccacttgctgtactcacattctctcattgatttctcacggtaaccctacaatgtagagactattattagtcccagtttgcagatgggcaaactgaggttcagccaggttgtgcaacatgctggctcacacagctctaagtgtgaaatcagacacaaactctgagtctggattcctttgttcgtttttgtatttctgtccacttgttttatgttgaaaattgcaatcataaccactgcaaagggagcgtgtccaagggtgatatatgttacctgggatttcagtggtaatctgttctaagtgtttgtataatattggtacaaaaatcctgcaagataattcagtgataacagattttgtcaaagaaagcgaaacaaaccaaggatctaaaatgcgccattgcaaaaaaggaaagaaaaaaatttttcaggtgctggataaattgaattgatgggcttaaaagggaaattaagaaaatattttaggtttccagcatgtaactttctagagaggaaaaaatgactaggatgaaaaaacaaaaacaaaaacaaaaaaaaaacaaagatgatccttcttgtctcagcatttggccaaagtatgtattgtttgcctatcgaacactgcttaccaatatatgtaaccgaaatttgcccacactcacaagcacagtaacaaaaaatcactttgaagtaacagtgaaatacaaaggctctagcttcttgcctttggggatattgccccactatcacattccccaataatatcagtcttcattcttaaaggatctctgaattacactggaaatttccggggtccacgtcatgtgtccataagtagtcttatcctactcactgatgtccactgcccatgtaacgtggaggtccccaaacgctggtaggacctggatcctgttggtgtctaggctcttgacaccatcacaagaaggaatgcaaggacaagtgggaaaatagtgaaagtacagacagttattgcaaagcaaaaagtacatagtcaagaaaggggagtgcaggtatactcaagagaggatcccatgcaaaggtttttggctctttatgggtttctttaaaaccaaggggtggaatatttataaagatttctggaaaaaggtgaagatttcttggaactgtggtgccacccacttttacaccaaatatgggtgttcctggaacggatatggtgctggtgggtgtgtgattgggtatgttaatgagcatataatgaggtcctaggtgaaacctaagtcaaatctagtatcacattgggtctagttgttcttggccaatgtgacccacatcctggttttcagggtcttatcagcctctagcttatgcaactatttcagcagtttcttttttgctggtcatttgaaactgctgcctggaattttctattctcccatgaccaccctgtattattcctgtctcacatgaagccacttcacatgacacctctccggtcccactgctgccatgtgaaagccacaggggtccaaaagccactgtttctcaaggtgcaactagtgccggcacccctttgtgaatgagctcactagttgagttgaggagggggagaaagcatcttttctcccctttggccccattcagccatccactcacagaagcctcttgccttggctgtgtctctgaaacctctgtgctccctccccctccttgctcctttcctcctttcctccttgggaatacatctctcaactcctgctgggagcccctcttgcagaatgctcaggcacaagtccaccaccttggagtggatagatacctttttagcttttactctttccccccaaccatccatcaaattaacattttcaaagagatgcctcagagccatcggctacacctactcatcaggtaggcccagacacctttaaatcatctgaatcccatacaccagtttgtagttcagggctcagcaatatttgctaagtgattaaactgtggagctcctttataattccctaaaataattctataattctcctttatgttgggttttctatccctttgctacaatgggtgagcatcactgtcacgcaaaatcgagcttatggaggtacatacaaatgataacatgatctcagtgaaacaattgaaataattccctttcaagaatggtcaagcaaattaaacagcaaagagcacatagaaaagaaatttgaaaaacggaaagcgaggcaggagtgaagaggttaaaatatttctccttggtcctgctatacttaacctaacttattggtacacagttactgggcttttgatatcattgacccttttttattctccttcagcttcattgcacagtgcttccaaaaaggacactccatttacctggaataaaaccccagtcttcggaactcttatagctcctcagcataaacaggagcagctgctaatttttatgagtcagattgaattccagaaaagcaaaagataaaatgactatccacttagaaactaacttttctttgtgtccaacttttcatcagtacactattattatcctgatagtagagccaaagcaagctctatcacattaaatatgtatgatatgtcccattcactagagaggttccccctaatgacaccgatgacataccagagatgcaaagatgtgtgtggcagtcagggcaaggattgctttgatttggaaagtgcagctgagaagtctggaagggtgaatattaaacacagaagctagatattccgtagttgtcctcagtgatttgttttgtaatctaaaacagaagtagacttctcctgtgaacctttttttcttgacctgctcttgagatggccaaactctaaccaggcctataacaattctagctaacactaactgggctcacaaagtgctggggccatgttttacacaatggtaggcaaagaaggggaagaatgcttccctctcccaagcttggtttttcctcttagagctagctggattgaaaatgtttccattcatatcaaagtctcaaacagaaatagaatggggtaggaagtaaatgctcctttattttcgttttgccttctaattgagccaacaaagcagaatgttgggaaaagagaccagaatcttgaaataacagagttacactaagaaccctgatttgaccattctacaatgtacatgtgcatcaaactatcatattgtaccccattatttgtcaattaaaaataaaatttaaatctgaaaaaatttaaagaataatggtagcaaactgtgggtacataaaaagctattggctacatacatggaggttaagaaacattctagctgacatcttcaactatcatttatcaagtacttagccatgtgttaggcacagtgctgagaactgtatgtgcatttacattacctcatttaatcctcacaacagctttattaggaagtcctatttttattctcattttacaggggagaaaactaaggttcagagaacacatagcttacaagtagcctaacaaagactaaaactctcatctgcctaaggctgaagcccacatcctccaccttacccccttgcctctaagtaacgcaagtgtcagagccttcaaactcctaggtcagccgttatctcatccccaccatatggcagtggagaaaacttcagacactcaagtttgatgactttagtcccttgcttaaaacctctcagggttccctattttcctccaggacaaagtccaaatttcccaatatggcttaataaaagccttcctgatttgactcctgctcacatatcagattcagttgtcacaaattcctcacccctctgctctacccatgatgactctgctacaattactaaaaaaaatgccaagatcttgcttacttgcaggtttgcttacccaaaatagtctcctcgctctcttctctgccctgatgacatgtttcattctgaatcaaacgcaggattaggattccccatagagccacctcctctcagaaagcttcaagtccccacaaggcccttttgctgggtttcaataacccacccttcacttatgtcatgcacatatcacaccaaattgcagtattccctcttgcccctagattgaggtccttgacagtaacatttatatcatattcatcattttagctccagcactttgcactataactggaccttcatcagtcagcaaaatgaatgaagacaccttggcactacagctgattcttactaatgatgcaacagagccagtagatcatgacagcatgatttctttacccttgtcatgatacaatagagcatgatttaagaagactgtctctagcagcatgtggcacctaggttcaaatcccagctccatcactaaaaaaattacctaaaataagccacatccaagagaaacttttccttacagtttcctcctcttctcacaaacagctccatatttgtttttaccctagcacttattccgaattaacaactattggtttacgagattacacagtctataaaaatcatgaccacactggccgtttttccatctttccacaaagctagaatagtgtctgctccatagaaggtgttcaataaacatgtgttgaatgaccttgaccttggtgtgagataatagtaagcatcacaaggacatgtttcacatctaaaaaatgctgtgttcggagtttgtgttccaaacatttccagaggtattaaggtagtgtgtccaaatgcgacaatctctctctgctccggtgcctccaggtggcctggttggatcctgtaaagggtcatacagtggccaagtccttctttctccccttcatcttgtatgccaggttttctccacataccactctaaggtttaagtgagccagctcctttccatgcacatcttgtccaccacaactgggctttcattggatcatgttctaagggcaggaatggggccaaacaaacttttcaaccaaatggtttaaaccaaattctagcattttggttttagcactgggcaatgattgctttttctgtatatcttcttacctttcaaaggatcctcatttcctcataccacattgattctaccacaaaggttgtatgatcattgtaacaatattcatctctgagcccagtaagcttttattgtcccctcccccaacaatttctgctttatttgaattctgggtgcctcagtttccctaaggcagagtgagagagaaaccatcccaacttctggcatcttcaatagtataaaagtactgtgattgttgctattgtctttactacactctccaaggtattttcacacatattgtcccttttgagtaccacagtaatgctacgagggttcttactctttttatttttcatagttgaggcaactaagattcagaaacagtagttcacttactcaaggttatatggctgtttagtattacagccagtctgaagatggaacttccagttaatgtgaaaaccttctcattcattctttttttctctgaagcacttccacaatggccaagactgtggtttataaacaaaggaaatcatggcaagctggttctgacatgttatgtaaaagcaatgcattgggagagtattgctttggtctagaatgaatgtgtgcatccacagaagctccccaggatgtagaggtgatcagcccccagtcaccatgttcagcatttggataatgctcagccctgtggtgtgaaagccagcaaaggctccctaagtgcaggtgattgtactggcgatgtggtgatgctggggtgccaaagttatttgtttgcacagtggtctctgtgtcatcctgtggtaacgaaggaggggagtaagatgatggattttctgggaagcaagtcttcagtgagagaggctgggagtataaccatcctgccaggtggagaaggagcatgctttgctggtgtgacctggaagctggaaaaatgagctcttgataaactgccacttctctaagccttgattattccatgttcttaatgggggtgacaaggctcacttgagacaactctgaagtctcttgaggatgacaggaggcaatgggcatgaaaacatttaaggagcttttcttataatcaatagagggggagagtttactgccaacatatctggcatctgtggggatctatgtacctgggtgccaagacctccccacaagtgtcctttttggcacagtttaaattcagaaaccactgtctacaaaagtcactgtcaaaatagaaaaccagatgctacgtctctaataggattattcaattcaattaaaactaattgtttagggggaaaataaaaaatgaagaaaatgttgttctcacgggttaaagtaaaagagaaaaatgcatttgggcaaaagaaaaaacaaaaacaaaaaagatttgaatggttttttatttaaatcttgtttcctaacctgctgagctaaccttagctctcttcttgactgtgcaaatgcacagcttcctagaacataaggtgagtatgtggctggattaacaattttcataaataatcatccttttaaattcctgcaccaaggatctaagaactcataggagcttagaatttagcttttttagggctcagcctctcacccctggtgcctaccacacttgcacagagctgcatacagccatctgccagagatttccaatccctgttttggcgatgagataagcaatgtgttaaaatggttcagccctgtctggcagaactagctctggggacttggagccccacatgtctggaggtgctgtgccatctgctcaaggtcactggtagtcaaggctggtagtgaagagtacccttaccacattgtctccatcttcacctctttagtcataacctctagagcgctgccctggctcccatcctgcctgttcctcatacatggtctattaagtggcccgttttctttcccttccacactcatggaggcttttcttttcccttccacattcatggaggcttttcttttccctccagttgcttcctcccacctgggcatttgggacttgtgtcaggaataaaagttctcaggactggatctctaatggcccattttgcactaatgtaactttcaaatacgcagcatggccagctcataaaaatatcttggtgcaacttaaaaacttaataaagcattgttcacaaaagtttataggggcaagatggtcttactgtctttgttacttagttaactattaggaaatttttctctccaaaataaaaattaaatagcagtcagcaatggttcaagtggttgcagggatcttcacatctaacactctctttaatatactcacaaagtgatctgctacttctgcttaaagacttcaaagacatgggtttctctacctatcaatgcatctttataggtttagcattttgttttgaaatttttaacatattaaaaaatgtacagcaaataacataataaccccaatgtacctaagacccagcttcaataattatcagtaaatggttaaacttgtttcatctaggtttaccaactttccccaaatcctcctctactgcattattttaaaacaagtcctagacattattgtttcatcataaatatttccgtgttctattgtgtgtgtattctattgtgtgtgttatatttgtgtattctactagggaaaaaaatggcatttcccttacacaacttcactgtcttataataatgcatatacattaccctgaagcactttggtcacacctagttgcagttttgtgaatggaaatgtaatagttaggctgggatttttctctttgctgagttttaggactccaattaaaggaagttcacatacataaccgaagcattaatttcgtattccataagaagtgacaccatgaggtgaaaaaaaatgtgtaagagatcctagttgctactctgcagcttggaagctgtgttaccttgagtaaattattttatttttcctcagttccctcttctataaattacgggcaatattgtcagccctacttccttcaccaagattttgtgagaatcccatgggatgatccacatggaatcactttgtaaagacaatgtactgtttgagagtaagaaataattactgaggggtgataaagatacattgcagaagcagagctcagtaggaaagtataaagaatatggagattttccctgccaactaagccattatggttcccagagccttctgtgaaaactcataatagacacttgctgaggagccgtggggagcaccagctgcagagctatgtcaagagaggccccgtcatatatgatctcaatcaataaacccgccgtccaggcaacaacggctccttccagcactgtgcagactgttcagacaaaagccaccaggaaaagtatatttttcaccttcttttgagacctgaacagaggaacaaatcactgctctttccccttagagagaagaaaaattgtctaataataatactttcctcggcccgctggagaaatgaagtgaccagctgagctgcaagtagatgattattcttttggcaaaaactataatcggtctgaattcaaagaccaaaagcattttaaaggcgaaaacacctggggagaagaatggacagtggattaaaacaaaaatttccctcacctgtttccctcacagggcaggccaaaaaagagctcaggaggcagaacagttactgggaaggaataaagtaatgcctggttatacaatggccctttgtctgtcaaagaaggggtctggggctgccattctctccaacatatagaacatggctctcatatgtcctaatggcttaataaggacaagatagtgacaactgaactaatccagacaaagacaagtccccagaggggtttctgcctccagtcaagccacatggccacaggccatacataaagcaggactccagttttccatttaaagaactgattccattaataaggttccatttgaagaaccttattaaccactgtgtgttaataagggtaggctagctgctgtaagaatcagtccccttaaattacagtagcatcatgtaacaaaaattaattttccttccaaaaaaatctctatttgtctgggtgactcttcgacccaattccattgccagagttctgaacagccccagcaggaacaagggggctggaaatgttgtccttggctgggcagctattccccagcagcaactccacaccatgggaggaattgcagcttgctgagtctgacaagagtgggaaattgtgaaaaattgactaacaggcatttataaggcacctactttttgcaaaatcctttaccagctgtcacagggaaacagaagaaataggatccttgatcctcaagaggctgaaaacatgatgagggtgacaaatatgtagtcaactaacaactagatgttgaaactccatcccttccttttccctgaactgtgccagttgatttacttttatggaatatcggtggatgtagtatccccacctagaaataaatgatttacaattcaagtgttcttcacataaagtcttactgaactttagtatgcagagacagtatattaagtagttaaaagagtcagcattagggccagacagcccatgtttaaatcttgagaccaccacttcccaggatttatctgctatgggcctcagtttttgtacttataaaatgtggatggagattgttcctacttcatggaatactgagaggattaaataagctaataaaggtaaaaacacttagtaccatgcttggcatataggaagcaccatgttaatgttggctgttgtcactgggtaatgacatattaaatatgaagggcataagcaacataaaaacatgagaattcctgcatgactcagtttacaaaatatcaacatgcaaaccctgctcccaaatgcactcttcttggcctcctcatgcaactgttctgaccctgcctctcaggtgctctcacattatctgacacctgcatagccccaactctcattctggatggcatttttcttactctttatctctagtcccatcaaaacagatttgtcttgatttcttagaagtggaaagaatttacccttttttacagaaggatatcttatccttttcctaatttaaaattttattttcacgttcctaatttagcagagttgcttcccatctccccatcataatggcataaaggaaaaagcaatttctgagatactggagaagatttttagaagatgtgatgttgaactatgcaggcttgtggtagatgcaggaaaagttccatggcaggtggctgcctctttatttgaccagctctcagtatgtctggtccacatagctaaaacaggagatgccctgtttcaccacactgtccccccagtccactcccctttctatgaacagaacaaccactatgtcctccatgcgcttgacctcaggggaggctctctcaccattcaactttgcccactacagtctatctctacattgtagtcagaattatctgtatgaaagagcataaatctggccatggcacctcctctctccccaacccagataaaacacttaaatgagacttcatctctcatggcatttctccacatttttcgatgggcataaaaggcagctcttcacaccaactcccctctcaagtgtctctttcctctgtcccccacccactctgctcctgcaacaccaagccgctcactcttcccagtctcatcaaagttcttaactttgcccttggcctagaacacactgctcatctttctggatagggaatttctgctcatccttttatgcacagccaaatatactcaaatttatctgtggagatctccaagatattccctgcataccttttcctgtctcattcccagaatcccaggcagatttgcttcctctgctctccccggtgaagacatctcctctgacattttaagcccagcaggcgtgcttaatgccatctgcttttctgaactatgagcaccaaaaaggcaggattttggtcctaactgtccctttgttcccttcatgacacatattaggttatatattttagagaatgaatatataaaggattctttaaagcctcgtacctaattagatatctaaaacttttgactcatttttaactatccctcaaacatatcctctcatccccattcattttcgttgcctccaggccacaattcacccctcctctcctgctcagtctaaatgttctcaaaagccaccctgcactaatgcaagtctctttattctccctttacaaacatgccttgttctgctttgcttccatttttgaaaactcccatgctcagtttttccatgagaggctcttggcaggagaattataggtgaaacaatcgagaactcagtgggccctcagccttctgcctagtttgcagccagatccaaaggtagcagaactctaagctgagcttggttggccagagtagggaaaaataaggagtgagaggggcaaaagacacgctagagacagagggcaaataaacccaggtatggatatgtatctgtattaggtcagggttctccagagaaaccaaagcaatagaatatacatataggaagagatgtattgtaagaaattagctcacatgatcatggaggctgagaagtctcacaatctacaatctgccagctggagacccaggaaagccagtagtgcagttccagtttgaatctgaagacctgagaagcaggggattcgatggtgtaaatctcagttaaaagttaagagaagaccagtgtctcagcttaagcaggcaggcaggaagcaaaagggatgaatttatcctcctcaacatttttgttctattcaggacctcgacagattagatgatgcccattcacgttagagaaggcaatctactgaacccactgagtccaatgttagtcttatccagaaacatcctcacagaaacacccagaaacaatgtttgcactgggcatctcttggttgacagaaaaccttcatgatcatactattgatgtgtccaggtaaggaatgtgtactcaaaatatatttcaatattcatttgaaagccatgggttgggaggagaaagagatctagcattagagtcaggaatactttgtccaaacttcatctctgctgttaagaaattgtgtgaatttgtgaaagtcaccaggtctctttcaacctcattttcctcacctataaaattgggaatagtagttcttactttgtagtgttatcaaaaggactacaacataagaatataaagcctaccaatagtttttgccaaggggtagattaccaataaaaggtaatggctattaatattaattttgtgattaaccattgttaatcagttttcattctataaccaaattgtttctctttaccatcatagatggattaattattttccagtaagtactcattaaacacctgtaatttttaagacacaagatgagtgaaatatagagcctgctttcctggggctaattataacagagtgaaacagccaggtcagcctagagtcacagtagtaagataagtgctataagataggtgtgtgcaagacagcatggtgatcttagcagagcctaagcaggtctgaggcacttgcccagaggagatcatatggaagacaaatttcaaaagaagagaggaaatccccatgagaactaggaaaaaaaggccatttcaaggagagggaacagcatgtaaaaaaaaagtggaactaagaataaaatagtgcaatcaagaaacagcaagtagcttaaggtgatcagaagacaggactaggggctaaagcaggagccagatcatacaggaattgttcataaatggcgaggagtttgaattttattctacaggtgataaggagtcattgaaaggtaatgatgaaatgtgattttcatttagaaagttgtctttagatattgtagaaaacaaattacaataatgctttccaacttattttttcacacaatggcacaagtaaattagtataataaaggtatggctcattatggtcagtaataggatgcttaaggcgagaggctgctccagaccccacagagctgcagagagctgagggacttgccatcttgcacatatgtagccttctcgcagaccaccattgtgaagcggtacaggggttaggaagctctggattagagggaaccacaaccatcaggcaagcaatgctttgaagacttaaccacactgaatttatttgtctggatgagtcctaaagagcaaaatgtaggtaacagccagtgacacagattcggtgtcaagaacattgctccatgctcatgagcctgcagtttggttgaatttaataagctgtctctttacatggtataaaagtaaagaacagaatagggtaaaatatgtctttcttctcgcttaattgatttcaatctgtacctctgaagaaaatccctgaatggcaggaaccatctccagccaaactgtaaaattattgaaggttattctggaatttaagcttttccctatcattgccttcccccatgcactcatatcctctatctgttggccaactgcaggagctctctttctctctctctctttttctttctttctatctctctctctccttcctccatcaaacttggctaccagagacatcgctgatatagtcactcactcctaggtataagtgtgcccttgcatatcttctccctgcagtgtttgcacttcaaatgtcatcttgttgttaagcattaaggcttgcctccttttaaaggtatttcaggcctgaggtctcaggaaggagagataggcaggtagagagtcttctcttcatactcctgacattgcacttgaaagttgtccctaatacctcttaaatattccctcctttggccttcctaataagctgctcagaaggcagagcagatagtcatatgcccattttacagaggagaaaactgagatccagagggattgagtgattttcttatgactgcccagtttgcttttgggagtaaggtctagcttgctgattgggagggatgaggagaaccctcaccttgccatgaaactcttgtctgagtcagtgttcttcaacttccatcaacttggaacatacagccagcctcacatggtggagagaggtcaaaacatccagatgcacctcttcctaaagctttgtttgtctgctcagtggccttgagtggggcagcttgcaggcagctggcagtagagcacggctcacaaagacagcactgctttgtcctgaaagactgaatgtatcaatgtggagactgggatgggcctttgggaaatgagagccaacagggcacattgatgagaatcagcttgcagagcctgatctttctgagaaagcagaaacttagttgtttttctcatttaaatcttttccatttatttttgcccagcctcacgactcttgaagtttaattgccaacctttgttttttaagcacaaaaggggaggggcctgactttctaaggcattaagaaacttaaagtaagcttccttggaaccctcaccttgcccttgaactgaagaaacaggtatccaggctcaggagaaactggtgaggcagcaggtggtggagaaaactaaggaggggagtttatcagtgcaacatgattgagatataccaatgcaagcagcactccccaagcacaccaaggcaaaggggagaaaactgccccttgttttcaacataggctccctttctcacttttcaaggctgttcctaatattcagataacctagattacactggtgaaaacacacttaaactttgtgatttgtgtttgtgtttgtttgaaaagtacaaagtgtgattggtctcagtacccactccctgccctcaccctgtccagaattgatggtatgagccccttcccccaaagttttgatatctacggatttctcaactcaaaagagttattttcgttgcctggatattcttacctttaattcacaagtctccattgccaagcccttctcattctctacatgccctcaaaagtttttagaagggtggtctcctctctgtcacaggtgagttctgtgcccgccccccctccccccatctctttcccaccccataccaagagggggcactggggctaagcagaactggtggaaatactgggctgggatggggctgactactcccttctctctctaccctgctgtattgaggatggcaatcagagatagagaagaaccaaaaaacaacacccagctgaagcaacttcggtcctctttacattcttgtcatcttccaatctctttctcatgccactctacatgccctttggaacacgatatctttctgcaaaccatttttcacttaatttcgcaagtcaacctgattctgtcaagaatacagcttgactagaatgcaaagaaaagactgaacaagaacattttcttaagcttttctttctatctaaaagaaaagccttgatggacataaaacagaaaggaaacagaatggctctccgaacaactttccatggtgaattgttttgaactctgaccgaacaaaggaaactcttcccccttcacaaagagttcgggttcagggggcctctctgtggcatcacctatttccacccaacacatagcaatcctccacctgtgctgaggaagtggcaatggctgaccagaaagtcaaggtgtgccttttaatctaatcagactgctgagaggctgaagaaaagcaacttgccagcttcaaggattacccgttttcttcccaaggccattgggcctggggtcagcatttcgcaaagattaaatctactctaatcttcctccaggtaagagtttgctagataatgacctttcctatactcttactggcatgattactgatactatcatctcccccaagcctttacaaactgaaattgcagtgataatagtgaattctttcaatgtctttttagaggataaaaaaaaaaaacatagcccacctagtcacaataatccatgacatttgagctttggggaaaaccaatggggcagcaaggcacactaaaagaaaaccaaacaaagcacctgttgtcctctattcacaatgcaataaaatgatctgtctttatcccaaatttcatccagggcatagatagagtcatgactgtagtctttcttatccctgaacatcatgagaggaaaaccctgacccttatgtaggttattccagtaaggccaagagaatcagatacactctttagagacttttcccctctctttcctgccatttttgccctcaatttaaaagatagggataggtcctcactgtaccaatgagccagccgttagaggcaggccatcggttctgtagggatgccatctcagaatgtgccctttgacatccttggatgtcagttattggctgccccctgcccctagatctgtgctgaggatcacaactatgcacaaggggttctgcaaggcaaattctgagttcttggcttggaagaagacaagcagaggaggcctctgtagttctacctgaaataggccttacgtttgtttctaaatcttgtcttatgactgactgtgttgtgagagatttgccagtgccactttttgatgtgagcctgagtttatttacaatcctttaatttctacagaagagaggatctttcaaattataagaggagccacaccagcatttctgtatcagtcccttcctagatatcctcaggggctcctatttccttccaagtaatgtccaaacctaggacgtttcttctcaatagagcaatactgctcccaaggaggcaaaaattgttttggggaggggaggagagataagacagttcttactccttttattataaagaacagatatacatacaatacataaacagatatacaatataactgtggtattaaattttcatgggggaaggcggggaagattagagaaaaaatgtctatctaaaaagtgccttagggaagcaataatgggagaaaaaaatcgagaaacactgagatagaataaaagcttttacaatccgatttcaaggatgcctttccatccttgatctcactctacctttatgccaaagaataacaaaccgtggcagaaatcctgaaaatcatggagattttggtagaaatatttacatgttggaattaaagaaacaaatctataatattttattatttcggatacaactcaataatagattatgtactatcccagattatacatcatcctagatttcaatgtccatgaagctaatccattcaaaaattgactttctatttactggactatgttaactctattaaagactatcactttactgaacttcagcactcactttcagagcacatcattctatttattgcccagtactggtccaccctagtgagcatttgactgcacttgtctgttctatgatctgcacctcctaacttaccaagtctcacatttttgtaaacaccatacgtcttgattttgacctcctggctgaactccaaccccatagtgtcttagttgtcttccaggctgtcacatgcctcttggccttcctcccttttatagatttagactcccttgatgaacttctgctttattgtctcatcagcattatcaaattttttgtatttctgtgctgcccccacaccttcccagcaaagtcccaaaggaggatgactatagatcattgccacagctcaacttcttctcctcatgcccaggtcactattcactgctggtagaaatgcacacatctgggcaaatagccagaaatataaaaaggtatgtataatcctggactatatgtggccctctgcactgcccatcatgcttagcttcccttgattagcttctttgttgattccctttgctattttgaatatctgtcccctccaaaactcatgctgaaatttaatccccaatgtggtagtattgagaagtagggcctttaaaaggtgactaggtcatgagggctctgatgggagcttcaatgggactgatgactttagaagaagaggaagagacacctgagctagcacactcagtcctattgccatataataccctgtgccaccttcggactctacagagtccccaccagcaagaaggccctcatcagatgtggccccttgaccttggacttctcagaccccataaatgtaagaagtaaatttcttttctttatagatttctgattccttcagattgtttatggatttttcagattcctgaaacctataaagaaaagtttcagatatttggttcagatattctgttataagcaacagacaatggacaaagacccccttcaactaggagctaaatccctactactctcctcatatgttattctgaaccatacccccacacttggagtaaatgttcttgccttctttgtaatttagaaaattgtgccctttgacataatctttctctcttcattttctgctttcttatcattagaattagctataatcgtacccttgtctatttaattttctctagtctcagtggacaagagtctttcagtcctgttcaagattagtgtctcttctaatctccttaaccccatctactcccagttctggagggactccaccctattatacttccctactctcctaacttgctctttctttcccagcctataaacatgtttgagtctctcacaactgggcaggaaataaagtttttctttgactttctctccctctagctaccctccaacatctcttccctggttcatccaaaatttttggaaggttattttacatttgctgtttttatttccttaacttttccacatctttcctcaatacagtgcaatcaaatgtcttccccaacaatgcacagaaattttttctaataaagtcaccaatgacctctcaatgattacaccattgcatatgtttcagtttttatcttattacatctctttgatgcacttgccatttttatcactaggcttttaaaaattctctacttcctttgatttcttaacacaacactttccagttctccttgaagctccctgatcattctttctcaatctccttccctggttttcttccctggtcccttcctttgggtcagctttcctcagtgcttctttcactataaatactctctcaatgtatcagttggaattgccttcaggtacaagtgatagaaacctagaataataatgatttagattgatagtgctacattcttcttacataacaaaaggcccggctgtagacagccagagctaactatttaaggatctgatcagggatctgggatctatccctctctctgctccacttttacttagtatttgtcttccatcttcacgaccacaggatgggtgctgcatgcatgcatctcatccaggtaggaagattgggtaagggttttgggagaaacacaaagactttctagtcttgagactttccttttttccagaatgaaaattcttttccaaggctttccataagaaatgtctcacatggccatctgagctgcaaggatgactgaacagttgagtattttattttatttaaattgaagaaatcaaaggagaaagtactgtgaatttctggagtttgactagctaatactcattatctacctctgggtataatcccaccttctttttggtaccagttcacacttacaagcaggaaagcaaaatgccaagagcatggatgctagagcaagcatgttcctagaactgaattatggcactaccaccttctatatagctatgcaactttacacaagtcatttcagtgctctgtgcttaggcctcctcatctagaaacttggaatgattatagtacctatgtaataggtttgttgtgaagattacatgagttaatacgtgtaaaagagcctgcaatggagtaagctctacgaaagtgagctattaccattattattattagtgctcacaaatatgcatttatagctcatttcccttccttagctttggatttatacagccaactgctcattatacattatattaatagcctagagatgccacaataaagtaccacaaactgggtggattaaaacaacagaaatgtattctctcacagttctggaggttagaacgctaaacttagggttagcatagattcctcctgacggttctaagggaacaacagttccatgcctctttcttagcttctggtgatggccagcaatctttggcattccatgttttacagacgcatcactccaatctcttccatttccatatggccgtctttctttgtgtctctgtgtcttcacatggcattcttttccctgtatgtctattttctatttttatatagacatcagtcatattggattagggcccaccctaatcaagtatgacataatcttaactttataatatttgcaaacaccctattttcaaataaggtcatgttcacaggtatgggagcttagaactgtattaatctgttctcacactgctaataaagacatacctgagactgggtaatttataaagaaaaagaggtttaatggacttacagttccacatggctggggaggcctcacgatcatggcggaagggaaaaggcatgtcttacatggcagcagcaagagagagaatgagagccaagcaaaagaggaaaccctttataaaaccaccagatctcatgagacctattcaatactgtgagaacagtatggggaaaccacccccatgattcaattatcttccactgggtctctcccacaacatgtgggaattgtgggagctgcaattcaagatgagatttgggtaggaacacatttaaaccatgtcaaagacttcaacatattttgggggaaaaatacaattcaccctaccacagacacccatcacagatctcacagaggtaccttacatatgatactggagatgtgtgattcttctttcttccacacttaccatattcaaatgaatcgccaagtcctgctagttctaatgtgtgtatgtgtgggatgtgtgtgtgtgtgtgtgtttgtgtgttgcagatatatatgtatacatacatacacttatataagtataatatatggataatataagtatatattatatataaagtatatataatataatatataatatataataatatataagtatacatattataaatatatattattataagtatataatataaatacatattattatataataatatatataagtatatatgggtaatatatggataatatatatagatatatgtacacatacacacacatacacacattattcccttttcttaatatgttctttctctgctacctcaggccttcctctccattcaagtagcaagatcaaatctctgtaacctggcatagagattctccaaaatctggtacctatctttcactgaagacaatatagtggctgccacctcccacagatagttcccttaactttaaatgtcttttttcattcctccctttcacatggtcaaattctatttacactttatgatttaatccaagcatcacttcttctaggaaactatctctatatcaccccattctatcctctaagattgaatcaagtgtccagccttcagtttttctatatctttacttatctctatcactaaatttatcatgtgcctttataattatttttatgcatgtttactccactagcctgtgaatccattaaggacagagaatacagcttgtttttctttgtattttagtacttgccagatttagcaaataaaaaaagtacacccaattacaaatttaaatttcaaaccaatcaggaatcatttttaatgtaagtatgccccattaaatatctgtgcacacttaaactaaaataaattatttgggataatctttattttatttcgtaaccctactagccatatagttgtcaaaacttgcatttctataaatgtttattggatgaatgaatgataatatagatatataatggtagataccaaatatttttaaaacttaataaaaatttgggcagagagtataaatttataagataaaaatccatgtgtgcaaataaaaagacttcaaatttttcttaaaactaaatttcttctctattatgaattaaatctaacaacaaaacactaacttagatcaatccagcagtttatcaattaaaatttaaaattaagtttaaaacttacttttctagtttccttctttcctttccccttcaggaccgatgttaaacttcagaaaccagtacctctcacagtgcaggggtgatctgcctcagaacttttttctctgtcctaacgttattctattccagcccttgctcagagatacattttccaagttggttcttcattcaggcaatgcacagccctccctcaggggtttgaaaatcttcacttcattccttcttagctctctagcacagtagttcatccaagataaattatgttctcctctcatccttgaatgagataattcatttcttgttctctgctgtggaaacctttcatcttggccttgcactgaaaaatacaaaagccaaaattgtgaagttccctagtgggctcaacagaataataaacatgacagaaaaaaggtcagtgaacttgaagatgtatcactagaaattctacaattctcatatctaatgaaagacatagacccacagattcacctacagcttagaaaatctcaaatgaaaaaaaattcaaagaaatctatgcccagtacaacacaatcaaactgatggaaactgaacagaaaaaaagaatttactgaaagcagaaaagcagaacattttatataagaaaacaataaagcaaatgaccatggattcctcatcagaaatcatgtgaattaggtcattcttgcattgctataaagcaataactgagactggataatttataaagaaaagagatttaattggctcatagttctgcaggctttacaagaggcacagtgctggctattgcttggcttctggggctggggagaccttgggaaacttataatcatggcagaaggtaaagtgggagtaggcatatcacatggccagagcaggagcaagaaagtggtgccacccacctttagacagtcagatctcatgagaacttactcactatcacaaggacagcactaaggggatggtgctaaaccattcataagaaattcaccagtgatccaggtacctcccaccaggccccatctccaatactggggattacaattcaacatgagattttggtaaggaaaaatacataaactatatcaccatggttgccagaaataaattgaacattttagtattagcagtagttgtaatattttactggagatattcatataccataaaattcactctttttaagtgaacaattaagtgattcttagtgcatttgctaggttttgcaaccatctctattatctaatcccaaaatattttcatcaccctgaaaagaaaccccatatcgttggcaatcaatgcctatttccttctccccctagccaatggcaaccagtaatttaccttttgtttctatatatttgcccattctgggcatttcatgtaaaataatcatatacaatatgttctattacctctgtttttcacttagcataatgtcttcaagtttcatctatgttatatcatttatcaggacttcattccttttaatggccaagtggtattccattgtatgaccgtactacattatgtttattcattcattcattgatgaatatttgggtgttttcaaattttgactattgtgaatgatgcttctatgaatatccatttttgtatggatgcatgtttttaatactcttgaataaatacatatgagtagtatttctggattatatgggaactcaatgtttaactttttgaggaactatcaaagtgtttgctaatgcagctacattaatttacatttctactaccaatgtgagagcattccaatttatcttcatcctcatcaacacttaatattgtctgtctttttaattacagtcatcctagtgaatgtaaagtggcatttcattgtgattattttatctgcatttccctaatgactaatgatattgagcatcttttcatatgtctattggctatttgtatatctttactggagaaatatattttcaaatcttcacccattttaaaactgggttgtccctttgttgttgggttgtaccagttcttcatatattcttgataaaagacctttctcagatacatgatttgcaaatattttattttgtgggttgtctttttgctttcttggtagtgtcttttgatgcacaaatatttttaattttgattaagtccaatgtatctactttttcttttgtttatgctttgggcatcatatttaagaaacaattgactaatccaaggtcacatatatttactttcatattttcttcaaaaagttttatagttttagctcttacaatttgatctttaatcaatttcgagttaatatttacaaacgatgtgaggtagggattcaatttccttcttctgaatgtgcctatttagttgtcccagcaccatttattcaaaagactattctttcccctattaaaatgtcatcacccttgtcaaaaatcagttacccataagtggatgggcttatttccggactctcaattctattccattgacttatatgtttgtctttgtgccactgctaccacatcttattactgtagctctgtagtgaattttgaaatcatgaagtatgagtcctcaactttgctctttttcaaaattattttgaccattatgggtttcttgcatatttttgtaaattttagaatcaacttctcaatttctgccaagaaaaataaaagcagctagcgttttgatagaaattgtattaaattctttctgggaatttgtccatttcatctaggttatctagtttgttggcatacaatactacatagtattcacataatcctttttgttctataagggataatatcccatcttttattcctgattttagtaatttgggtcttctctcttcatttcttagtcattctagctagttttatcaaagtgtccaataataatgattttttaaagaaccaccttttggttttattgattttttatattgtttttctattctctattttatttctcttctaatctttattgtttattgttatttcttctgtttctctaatttcttaaagtttaagttactgactggagatttttcttcttttttaacgtaggcatttgtagctatacattttcctcaaagcactgctctctctgaatcccataagtcaggatgttgtgtttttgtttccattcatggaacaacattttaaagttctaaatgaaaagatattttgactccaaattctatgtcctgtgaaaatagacttcaaaaatagaggtaaaataaggctttctcaaaataatgaaaactaataatttgttagctgggaaatcctgaagaaaaattttacaaaaaggaaacagaacataaataataaaggaaatgcaacagaaatggcaaaatgtctacaatatctgcgtaaagacagtaaactattcttctcccctcttaaattatttaaatatgtatttggcagttgaaagcaaaaagaataaccttatctgatgcaatttttaatgtttgcaaataaaatgcctatgacaattacaacatggagggaggagcttaatggtggtggcaaggtttctgtattaccattgaagtaataaaatattaattctaagtggattctaaaagtttaatccctagagcaactacttaaaaatttatttgaagatatgtagtcaaatacaatttgagagaaatatatttaaataatccaaaagaaggaagaaaggaggaaactaatgaaatatagagtaaacaaacaggaaacaaattagaaagcgatagacctaaatctaaagatattaataattatgtgtaaatgatctgaagacaccagttacaacaaagatattcaactatgtgctatgtaaaataaatccattttaaatataatgttttagaaagctttagccaggcacagtggctcatgcctataatcctagcaatttggaaggccaaggtggatggatcatctgaggtcaggagttcgagaccagcctggccaacatggtgaaactcggtctctactaaaaatatttaaaaattagccaggcgtggtggtgcacgcctgtaatcctagctgcttgggtggctgaggcgggaggatcgcttgaacccgggaggcagaggttgcagcgagctgcgatcgtaccaatgaactccagcctgggagacagagcaagactccgtctcaaaaaaaaaaaaaaaaagataaatataatgttttagaaaggctggaataaaaggatgaaaaaagagagactatgccatgccatgtaaacacaaatcaaaagatagctgtagtggctatattaatatcagataacacagacttcagagcaaggaaaaattaccatgaaaaaagagggacattgcagaatgacaaaaaggtcaagaagacaatgatttaaatgtgtatgcacctaacaacatttcttcgatatacatgaatcacaaactgatacaactgaaatgaggaatagacacatgtacacctctatttggacgttttaacactcctatctcagcaatcaaatgaacaagtagacaaagtcagtaaggatacagaagaatgaatcacattaccagccaactaaatctaattgatatttcccagttcatgttacaaagccggcattactctgatatcaaaattagacagaaatagtaaaacagaggaaaactatggacaaatattccttcatgaatatggatgaaaaatcactgaaatcttattagcaagattgaaggcaatccagcaacataaactaagaattattcacaatgatcaaatggggtttattccaagaatgcaagactgtgttgaaattcaaaaccaaagctgggtgtggtggctcatgcctgtaatccgagcactttgggagtctgaggcaggtggattagttaaggtcaggagttcgagaccagcctgcccaacatggtgaaaccccatctctactaaaaatagaaaaaatagctgcgcatggtggtgcgcatctgtaatcccagctatttgggaggctgaggcaggagaatcacttgaacccgggaggtgaaggttgcagtgagccgagatcacccactgcactccagcctgtgtgacagagggagactccgtctcaaaaatgaaaataaaaataaaataataaaataaagaaattcaaaagcaaacactataatttatacaatgtaattaaaagactaaagaaaaaagattaaatcaattaaagaagataaaacatttgaaaataatccaatatctattcttggttaaacattcagcagactagagatagaagcaaactttattagcttgataaagagcatttaccacaaacaccatacttaattgtgaaacataaaaagcaagaatgtccactttcacaacttctattcacatagtactagaagcctttgctagggtaataaggcaagaaagaaaaataaaaggcattcagattggaaacacaggaacaaaattgtctctgttcataaattacctgattgtctacatagaaaaaccacgcaatgggtctccaaaaaaacgctcttataactacaaagtgagtttaacaaattcataggatgcaaagtcaacatgtaaaaattctttttatttgtaatttagcagcgaacaattagaaaccaaaaataaaatctaacatcacttacagttgctcaaaaaattgaaatacttagttgtaaacctaataaaatagatacaggatctgtatcctgaaagctacaaaatgctgatgaaagaaatcaaataagacctaattaatggaaagccatactgtgttgtgttcataatcagaaaattcactatagttaattctcctcaaactgatctgtaggttaacataattacaaacaaaatccctgaaggattttttgtagatacagattagctgattctaaaatttatatgaaaaggtaaagggattaaaacagtcaaaataattttgacaaagaagaaccaaatcagagaactcatgttaaccaatttaaagacttactataaaactgcaataatcaagaaaacataacattggcaaaaagactcatagatctatccatttagcagaacagacccacaaaattatagctaattaatttttgacagaaatctaacgtaattcatcagcaaaaggatagtatttttaaacaaatagcactggagcatatgtttttaaaaaaattgttattggctgggcatgatggctcatgcctgtaatcccagcactttgggaggccaagttgggcagatcacttgaggtcaggagttgaagaccagactgggcaacatggtgagaccccatctctacaaaaaatatagccaggcatggtgacacacacctgtagtcccagctactaaagaggctgaggggaaaggatcacttgaacttgggaggtcaagactgcagagagccgtgatgatgctactgcactccagcctgagtgacagaacaagaccatgtctcaaaaatttttttttaatgttctaaacctcataccgtacacaaaaattctcccaaattgtatcataaatctaaatataaaacataaaagctataaaaaacttagacaaaaacactagagaaaatctccatgattttaggcaaagagttttaaaacatgacatcaaaaacacaatccattaaaaaaaaaatggtaagttggacttcatcgaaatgtaaaacttttgttctatgtaagctactatcaagagaatgaaggacaaactacagatagggagataatatttgtaaaccctatgtctaaaaaaggacttctatctagtatatatagagaattctcaaaactccagaaagaaaacaagaaaaaaaatttttttaatcatgggaaagaatcagtcacttcaccaaaaaaaatataagaatgacaaataagcacaacaaaacatgctcagcactaaggaaacaatgtagccattacgtaactaattaaaaccacagtgtgataaaactttatagctatcagaacagctcaaaacaaaactgactactgcatgctgacaaggatgtagagcacctggaactctcataaatacctcctgagaacccaatgtggtacagctgctctggaaaacaacttagcaactttttatgtagtcaaacatatttatcatgtgacccagtaatttcactactatatatttatcatgaaaaatgaaaagttctattcataagaaacctccacataagtgtttatagcagctctattcataatcatccccaaacaagaacaacccaaaggtacttcaacaggtgaataggtaaacaaactgtggtatattcatacagtggaatactactcagcagcaaaaaggaacaaactacttattgacctatacaactaaacagatgaatctcaagtgaactgaaagaagccagtctcacatgttatatactgtatgatagcatttatatgacattttagaaaagacaaagttatagtaacagagaacagattggtcattactagcagttaaaagtggagggacagtgtttcctcaaaatgtcagtccaagggagttttgtggtgatggagctgttccatatcccgattgtggtggttacatgaatctatgcacatgttcaaactcatagaattttacacacacacatgcacacacacacacacacacacacacacactcgattttactgtatgttagttaaaaaagaaaaaacttgctttgtttcactgtagtgagaactaaaagcaagatcatgtgataaacaaccctggaaaatgcctgtacatgatagggcttcaataaatgttagttcatttttcctggtctttttgccttttagccactggtaagtctttttcgagtggtcagcgtccctgctagctagaatgtacacgctttgcacacacagttcgggattagaaaagcctggtgcagactatgtaaatctgcatcatcactagcagtgactcagctctccactatcatttttcaggcttacattagtgcaaagaccccttttaacaggaatatttattttttagatcaatagctactgtcaaattaggaactgtcaaaaatcaagacacatatctcattcttagagtaacatgaaatatatcactgttttccagaaattggagacatactttctttgttaaatgcaaggttttgatcctattatatcattgttgcattgcagcctggatgagctgttgttttgttacacgcggttactctggagatgagcatttatagatttcagtattttttaatgaagagtctctgtgtttctgttggccaatgctatttatttttaccaagtaagtattataaaagccaaactgcctttcctctatttcaacatgtatgctatttattcaggacttgctctgttctaatagtatctaaagaagcagaatgtatccttgatattattttacgttcttctgatgcaaaacagttatttatcttgatttctggtaaaaatctctggttcatatttgaaagaaacaatgctgaaaagaaaatgctttcattccatccctacagaggaaattaaatttttcagggaatctttctccctgtcgaaatacatgttgttcttaaggaataggtgtagatataatccggttatcaccacgaagattaaataattaaataaatcattcctcaaactcatataaataaatattatattatattatattagaagtgaatttggatacacaattgcattctgagcactaagtcttcttcacttttctctgaatctattatagttttatgcataggttcttatttctaacagttcatttgaacgttcgacatttgcattttacacagtcagtaaaatataattactcaatgcatatgttttctgattaaatgtgtgaaacttttaaatagaatacagaaattagttttaagtgcattatgaaagacctaaatttatctttttggttcatggagtagtgatcagctttccttgtgacttcattctcagtgactgtcagtcagccagagttcatggactctaaaaggaagtttatccctagttaatcctcctatatctaagcagaagtagccccaaaccaacctttatgtgacagtcacctcacattattgcatcttgagctaaatattgtcaataaaattcacagttaaatcaggtggatattaactgagggcacctaaagaactgctttagaggcacaatgcgtttgtcattctgcctgaaactacagtgaatcattaaagtcgaattctgtttacccacactgacagagcaaaagtaagggcatcactgaattatcccaaccggggtgcagaatctagagtaacaaaagttcaattctgaattaattttataccagactgtctttctgaagaatttctggtaaaatttcttctttccccttcttggggcatctttgtgtttcctcaaagtcccagcacaacctcgcatgactgctgtctttttttaaattttcttacctggtcctactttttaaagaaacatctaagctccagaactgttttgttatcactcattctcctcgccctcattaaaactttaccagccctgggtcccattctcttatccctctgcaccacatacacacgcagacttgtgcgcatgggctttgggaccagacaggcttcagaactacatctgccactttctaactgtgtccttgatcaagtaaataaaccatgctcagctcagggccctcatctataagtggacacaagtatggatagttacctatttcacaagatgattttgaagattatattagatactgcaaatgaaatatttagcacagtgcctgatacagctagtgctaaatgccaccactgtcatcatcaccacacactctatactatagttattagactacacatatctctctctcaatataattaaaattggtagagaaggaaatgtgtctgtcttatcactgtttttttcctaagaaacttagataatgtgtgtcacgtagatgttcaataaataatttgaaaatgcataacaggatatattagtcctctcccacatctttcgccttcccttgctccctccctctgtctccatccatccatctaccacccaactatgcatatgtatgtaatttttaaaggactgtttcttttttacctctattactttatgcatgattgatcctgttttcattccaagtaattgcctcatgactatacatgcttttattttttcaaactatttctgattgcctatttctctggctagaacataagctaattagggcagatacttcgtcttttttatcatatgtcctcagggcctagcgcagtgtcagacatatgaataggaacacagtgaatatttgtcaaaagaacaagtgaatgctctctggctctttcaatatctgcttctgattcttcatcttggactcccctctctggctttcttgtttcccttccatccaatgctcttcttctttactgttatatacactaccctcatttatgtactgtgtacacctgaggtagaagagtcctttccaccctgatctggccccagttaccaaaaagcctaacctccattgaacaaagaagaggatctccaatggaaagtgtatatatcctgtttatttgtgttgttattccaatgccttgacctgtgactgaaaggagagagatatgggatagaagtagctttgtaaaaaaaaaaaaaaaaaaaaaaaaaaaaccctgcccacagggtccctcaactactgagcagagcaacttgctgctggctctttatgctattctactaaagcaggtgttctcagtattgaccacacgtgaaaatcacatgagtatcttttaaaataaggatgcctgggccaggcacgctgcctcacacctgtaatcccaccactttgggaggccaaggcaggcagatcacctgagatcaggagtttgagaccagcctggccaaccatggccaacacggtgaaactaagaaaattagccagacatgatggcgggcacctgtaatcccagctacctgggaggctgaggtgggagaatcacttgaacctggcatgtggagtttgcaatgagccaagattgcaccactgcactccagcctcggcaaaagagcaagacttcatctcaaaaacacaaattaaaaaataagaaataaaataaggatgcctgatagcacacccacctccaggagagaggctcaggcatttatagtatgaaaaatcttccgcaggtgattataaaatgaagccagatgtgagaatcactgagttctgaagcccactcggactgcagcttttcaggtaccagaaatctcaaagtcttaagttacaagacagaagaacaaatcagcaaggactctgactcactgacaacttatgccatttataaggtgtcacccatcactcaattatagctaattgtgattatgtgagagtgtagctcagggttgctacatcttttctgtcttgaagagaagccataaatctgcaattttagatgaactctcacaatgtaaagtgctggcacctattcaaatttctctataatgtagtatgggctgaaataaaagcatatcttgggctggattacattcatgggccaatcatttgtagtttttactttataacaactgctctcccatatcctaagaaaacctttctatatttttattattatactttaagttttagggtacatgtgcacaatgtgcaggttagttacatatgtatacatgtgccatgttggtgtgctgcacccattaactcgtcatttagcattaggtatatctcctaatgctatccctccccactccccccccccacaacaggccccagtgtgtgatgttcccctccctgtgtccatgtgttctcattgttcaattcccacctatgagcgagaacacgcggtgtttggttttttgtccttgggatagtttgctgagaatgatggtttccagctttatccatgtccctacaaaggacatgaactcatccttttttatggctgcatagtattccatggtgtatatgtgccacattttcttaatccagtctatcattgttggacatttgggttggttccaagtctttgctattgtgaatagtgccccaataaacatacgtgtgcatgtgtctttatagcagcatgatttatagtcctttgggtatatacccagtaatgggatggctgggtcaaatggtatttctagttctagatccctgaggaatcaccacaccacacctattccaaaattgaccacatagttggaagtaaagctctgcctaattgccctggccagaacttccaacactatgttgaatagtagtggtgagagagggcatcccttcgttgtgccagttttcaaagggaatgcttccagtttttgcccattcagtatgatattggctgtgggtttgtcatagatagctcttattattttgagatacgtcccatcaatacctaatttattgagagtttttagcatgaaggttgttgaattttgtcaaaggccttttctgcatctatcgagataatcatgtgggttttgtctttggttctgtttatatgctggattacatttattgatttgcatatattgaaccagccttgcatcccagggatgaagcccacttgatcatggtggataagctttttgatgtgctgctggattcagtttgccagtattttattgaggatttttgcatcaatgttcatcaaagatattggtctaaaattctctttttttgttgtgtctctaccaggctttggtatcaggatgatgctggcctcataaaatgagttagggaggattccgtctttttctattgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagagtgtatgtgtccagaaatttatccatttcttctagattttctagtttatttgcatagaggtgtttgtagtattctctgatggtagtttgtatttctgtgggatcggtgatgatatcccctttatcattttttattgcgtctactgaattcttctctctttttttctttattagtcttgctagcggtctatcaattttgttgatcctttcagaaaaccagctcctggattcattaattttttgaaaggtttttttgtctctatttccttcagttctgctctgattttagttatttcttgccttctgctagcttttgaatgtgtttgctcttgcttttctagttcctttaattgtgatgttagggtgtcaactgtgaatctttcctactttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggggcaggttgttcagtttccatgtagttgagcggttttgagtgagattcttaatgctgagttctagtttgattgcactgtggtctgagagatagtttgttacaatttctgttcttctacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatcctttttgactttctgtctcgttgatctgtctaatgttgacagtgggatgttaaagtctcccattattaatgtgtgggagtctaagtctctttgtaggtcactcaggacttgctttatgcatctgggtgctcctgtattgggtgcatatatatttaggatagttagctcttcttgttgaattgatccctttaccattatgtaatggccttctttgtctcttttgatctttgttggtttgaagtctgttttatcagagactaggattgcaacccctgcctttttttgtttttcatttgcttggtagagcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcatcagttgatgcagtttcttcctagtctcgatggtctttacatttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgtggaatattggcccccactctcttctggcttgtagagtttctgccgagagatctgctgttagtctgatgggcttccctttgagggtaacccgacctttctctctggctgcccttaacattttttccttcatttcaactttggtgaatctgacaattatgtatcttggagttgctcttctcgaggagtatctttgtggcgttctctgtatttcctgaatctgaatgttggcctgccttgctcgattggggaagttctcctggataatatcctgcagagtgttttccaacttggttccattctccccgtcactttcaggtacaccaatcagacgtagatttggtgttttcacatagtcccatatttcttggaggctttgctcgtttctttttattcttttttctctaaacttccctcctcgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttatctagttatacattcttctaaatttttttcaaagttttcaacttctttgcctttggtttgaacgtcctcccgtatctcggagtaatttgatcgtctgaagcattcttctctcagctcgtcaaattcattctccgtccagctttgttccgttgctggtgaggaactgcgttcctttggaggaggagagtcgctctgctttttagagtttccagtttttctgctctgttttttccccatctttgtggttttatctacttttggtctttgatgatggtgatgtacagatgggtttttgatgtggatgtcctttctgtttgttagttttccttctaacagacaggaccctcagctgcaggtctgttggagtacccggctgtgtgaggtgtcagtctgcccctgctggggggtgcctcccagttaggctgctcaggggtcagggacccacttgaggaggcagtctggctgttctcagatctccagctgcgtgctgggagaaccactgctctcttcaaagctcagatggaaatgcagaaatcacccatcttctgtgtcgctcacgctgggagctgtagactggagctgttcctattcggccatcttggctcctccgcctaactttaacttttaaacttgtgtgaaattcaaagaacacagaacccagtatcatttacacttgggccatcataaaaaggcagctttctcaaaaagaatattggctgtcttccagactgccagaaagctttctatggaatcttttaaaccgttctcctttaagccacaaagggaaattaaatttggccaagtgtgaatggactgcccaaagtatgaaatatttctaacagagacagagtttaagagaatcataaagcttcccaatttcagggaagaaaacataaattccacccaccccatttatcatgtaagaaacattaagtaacctgcagtatagtgacaaaaaaattttttttagtgtcatagtggtgaattatttaatctttacagaaatcattcaggcactttatggggaggtaaaggtactatctgacaagaatggtgtgatgatacttttaaatagctgtttaaaaacaaatgaattaatagtgagttaataaatgatgcttgggatatgccctggtgagaatttcaatcttgaaaattaattatgaaatatttcaagcatgaagtatagagaatattataataaatgcccataagacaccacttagctttgccaaatcttaacacttggtcataattgcttagttttgtttttttttaatataagatactttagatacaattatgtacttcttgtcacagaagtgactatactgattttggtgttgatcatctccagaattttttaagagatatatatgcatctttaatcctgttttaaaatttagtctttattactattcctgtttaatggtgaggccaacagatcaagagacaactaccattgaaaagataatttgttatactcacagaacccaagagaaaggaatcacaccctggggcaggaggaggaacacaaagaaacagtagggtcaatcagaaggcagagaaagtaagggggaaatgtggataaaactcttattgtctttccataggaacgggcagccagagaccaggtaaacagcttaagattggctagtttgaataacttctcggcaaactctgcagtgtagtggatgtccctagttgtcagatacctggacctaggtaattagagtaggggaataatggcccagagtgttaagaaccctgtaaaggagatggctgggagtatggactttggattagttggtttgcatatgaaaggtgcattcacagaccagttgtttgctgtctctgggcattagccaccaccactgggaggggcagtttcttcagggtcagcaaagccagaagatgtcaaagcatcaaaaatacacaataaaaagacatgaatacaaaacaacatactatattattttgcatgttgttaacctttataaaaatatcattctgttcatgtttacatacatcttatcaactttttggtttttgctctcaacattatactttggaaatttttccagctggttgcatgcagctcagtttactccttttttcattttaaaatttggcattgtgtaaatataccacagtgcattaattgtatttatgttcatacttgagggtacttaagttgtttccagttttttggtttagtaatgatgcttccgtaattaatgttttgtctgaccccaggtgtacatgtggcagagagaaggacatggaataactgggtccaagggcattttgtatcttctactttaatgaatattaacaaatgactcttgaaagcagttgtagcaaattatccttccatcaagactgtagaaaatatcctactgttccactgcctcaccagcatggatactgtgggattttcctttcaatgttcaccaatataatggtgaataaaggtgtcaaagtattgtttacacttcttgattactactgaagatgaacatcttcttttttttacatgtttattgatcgtttgcattttatcttctataaattgcctgttcatatcttttgccaatttttctactgggttgtttgtatttctcttattatttagcaaatttctttatatactttactggcatgtgttgcaaatatctttctccagtctaacgcttacacataaactacagttcagtttatgtatctttgttttacagaaattttaagtttagtgtacttaaatttattaatttttcaattttagtgcgggatttttgtgtgtttttttaaaaaagtcttctgaacagacattttatttaaaagttttaaagtcttaatttttcctatttatatctttagtaaaattggaattgagatttaatgtggtaataagcaaaggtcttaggttactccacaaggaaaatcaatagtcttagcatcctttattgattagtccatattgtccaccactgatttttgatgatacactgtcatttatcatattcctttgtttgtggtttatttccgtgctctttattttcttccattggtctatttttttaaatccctgtcgatatcataatattttaatcactctaactttagaaaaatcatatttcctggtatgccaatcccctcaatcttgatctacttctttaaaattgctttagcttttctttaaaacttgctcttccatataactattaatcagccagttaatttccacatacccatacaaaaacaaacaaaaaaacaactgtgctttagatgggttttgccttcaatttatatactgatgtggattaaactgattatcttcacaacattgaaacttaccacttataaatgtgcttatttctgtttgtttagggtttttattttttttcaattaagtatttgattacttctcctaaatcctggagcctgtttttttcttagactaatttcttgatatggtataacttttgtggtcactgtaattgatatagtttaaaataatatgggggggttatttttgtccactaatcatacacccagctatctaactagactttcttatcagctgtcatagtgatgtcgtagactggttacagagtaggctttgtgtgtgtgtgtaaacaatgatgttttctgtgggtaatgatagtttttcatcagtaattctgacatatctttttcattttctattcttattgcgtagtaattatgacgtatctttttctttctctattcttattgtgtaggccagggtatccagcacaatatcaaatagaggaggtaacagcatcattgtctcattccaattttaagcggaatgtgtctaaaatttctccattcagtatatttattttagtgtttaatcgaattaccccttatcagattaagaatttttttcttaaaaacttttattgtgatagatttccatttttatcaaatacattttctatgtttattaagaaaatcatgtggctttttctcttttaatttatttatatgaaaattttctttgaaagagttgtctaatatttagcaactcttgaattctgtgacacattcaagctgataataatgtattatttatttagactctgctaaatgcacattgtccctatattatttccttttattgtccctgtctacttttgttaccaatgttacactaaccacataaaaagggttggagagcattacttcttttactagctgatatggtttggctagtatggcagggacctggtgggaggtaattgaatcatgagggcaggtctttcccgtgctgttctcatgatagtgaataagtctcacgagatcggatggttttaaaaagaggagttcccctgcacaagctctctctttgcctgccaccatccatttaagatgtgacttgctcctccttgctttccaccatgattgtgaggcctcctcagccacatggaactgtaagtccattaaatctctttcttttgtaaattgcccagtctcagaaatgtctttatcagcagcatgaaagtggactaaaacagtaaatttgtaccagtagagtggggcattgctgaaaacacacctgaaaatgtggaagtgactttggaactgggtaacaggcagaggttggaaacaggcagaagacaggaaaatgtgggaaagtttggaacttcctaaagacttgttgaatggctttgacaaaaatgctgatagtgatatgaacaataacgtttagactgaggtggtctcagatggagatgaggaacttgttggtaactggaacaaaggtgactattgttatgttttagcaaaaagactggtggcattttgcccctgccctagagatttgtgggactttcaacttgagagatgatgtagggtatctggtggaagaaatttctaagcagcaaagcactcaagacttgacttgggtgctgttgaagacattcagttttataaaataatcagagccaaaagttcagaaaatttgcagcctgacaatgcaatagaaaagaaaatcccaatttctgaggaaatagtcaagctggctgcgtaaatttgcgtaagtaacaagcagctgaatgttaatacccaagacaacatggggaaatgtctccagggcacgttagagatcttcacagcagctgctctcatcacagacccagaggtctagaaggaaaaagtggtttcaagggccaggaacaaggtccccatactgtgtgcagcctagggacttagcgccctgtgttccagctgctccagctgtggctgaaaggagccaacatagagctcgggccatagcttcagagggtgcaagccccaagccttggcagcttccacatgatgttgagcacaaaagtcaagatacacaaaagtcaagaattgaggttcggaaacctccacctagatttcagaagatgtatggaaacacctggatgcccaggcagaagtctgctgcaggggagaggcccttgtggagagcctctgctagggcagtatggaagggaaatatgtggtgggaccctgacacagagtccttactggagcactgcccagtggagctgtgagaagacggccaccatcctccagaccccagaatggtagatccaccgacagtttgcaccatgtggctggaagacacatgggagggaggctgtaccctgcaaagccacaggggcagagctgcccaagatcatggaacccacctcttacattactgtgacctggatgtgagaaatggagtcaaaacagatcattttggagttttaaagatttgactgtcccactggatttcaaccctgcatcggttggccaaaattggccaaatttgttttggccactttctctcatttggaatggctgtatttacccaatacctctaccccattgtatctaggtagtaactaacatgcttttgattctacaggctcataggcagaaggggctggccttgtctcagatgagactctggattgtggatttttgagttaatattgaaatgagttaagacttttggtagactgtagggaaggcataattagttttcaaatgtaaggacatgagatttgggaggggccaggggcagaatgatatggtttggctctgtgtccccactcaactcttatcttgaattcccatgtgttatgggaaggacccagtgggaggtaattgaatcaagggggcgggtttttcccgtgctgttttcacgatagtgactaagtctcatgacatctgatgattttaaaaagatgagttcccctgcacaagctctctttctttgcctgctgccatccatgtagaacatgacttgctcctcgccttctgtcatgattgtgaggcctccccagccacgtggaactgtaagtccattaaacctctttcttttgtaatttgcccagtcttgagtatgtctttatcagcagtgtgaaaatggactaatacactagtctgtggtatagtttatataagattgggattttttgttcctttgaaggggtggaatttacttctaacatcacatggtactgaccttatttttttaggggacagctgttaaattaccaacacaatttgttaataattataggtctattcacttttctgtatcttcatgaatcaatttttgtaagcatatatttctgtaaaaattatccatgttttctgatttttcaaatctactgttagtctagctgtggtgtctcatgcctgtaatcccagcactttgagaaatagagacaggtggttcactccagccaaggagttgaagaccagcctgggcaatatggtaaaaccctgtctctcccaaaaaaacccaaacaaaaacaaaagtcagccagatgtggtggtgcatgcctgcagtctcagctgtttgagaggttgagggggcaggatcaattaagcccaggaagtcaaggctgcaataagccatgattatgccactgcactccagcctgggtgacagagcaagactgtctcaaaagaaaaaaaaaagtaatgttataaaattgtagagttctctaatttaaatatgttatatctgtagttaagtgccatctttcatgcctctaattgtttgggtgctttttttctctctcagtttttattctttgctgattataaacaaatattctttctagtcttaatccttccaaagaattagcttttgctgttgttgatcttgtttattgttatttttaatgaatttttattcttctctttattctttctttccactcttttaggtttcctctctcaaggcaaatttaaatcttgcaatgtgatattttattttaattttttataatttacaaataataattgtacatatttatggggagcatagtgatgtttcaatgcatcagaacagagtgatcagaacagagtgattagcatacccatcatctcaaacattttccatttatttgtgttgggaacgtcaatatccttctttatgatttgcaactatatattattgttaactatagtcatcctacagtgatatagaacactagagattattcttcctatctagctataattttgtatcctttaacaaatctctccttatccttctcgtccccatacccttcccagcctctagtatcctctgttatactttttacgtctatgagatcaactttttctagcttccatatattagtgataatatacagtgttcaactttctgttcctagcttgtttcatttaacatcatgtcctccaattccacccatgttgctgcaaatgacaggattttattctttggctaaggattttattctatggctaaatagtattccattatgtatatataccgcatttgctttatccatttatctgttggacaactaggttgattccataccttagctattggagtagtgctgcaataaaaacatggaagtgtagatgtctctttgatatagtaatttcctttcctttgggataaattctaagtagtaggattgctggatcatatgatagctccttttgatgaaccttcatactgatgaaacttcatactgttttttatagtgtctgtactagtttattttcccagcaacagtatttatgtgttcccttttctcttcatcctcaccaacatttgttattttgttgtccttttgaggatagccatcctaactggcgagacaatatcttgttgtggttttaatttgaattttcctgatgatcagggaacctgttttatgtatttgttgttttcttttgggaaatgtctgttcagatcatttgcttattttcttaatcaacttttttgttggtggtgatttgttgtttttttgctgttgagatgtttgagttaatcttctgtcaaatgggtagttggcaaatattttcttccattctataggttatcttttcattctgttttttgttttctttgctgtgaagaagctttttggtttgacataatcccatttgtttatttttccttttgtttcctgtgcttctgaagtcttactcataaaaccttttcccagaccaatgctctgaagcacttctacattttcttctagtagttttatcatttcaggtcttatatttaggtctctgagtcattttgtggtcatttctatatagaatgagaggtggaagtatagtttcactcttctgcctagggatctacaattttcccagcagaatttattgaagagactgtcctttccccagtgagtgttcttgacacctttgtcaaaaattagttgaatgtcaatacatggattattttctgggttctctagtctgttcttctggtctatgtttctattttcatgccaataccttgttgttttggttactatagctttgtagtatattttgaagtctgagaatgtgatgcatataattttgttctttttgcttagaatgctttggttattcagtatcttttgtggttccacaaaattttaagtttttttatttctataaagaatgtcattgccattttgatagggattgcattgaatctgtagattgctttgggtggtatagtcattttaacaatattaattattctgatccatgaacatgggatgtctttacatttgtatcttctttaatttcttttattagtgttctgtagtttcccttgtgaaggtctttcacatccttggttaaatttattcctgggtatttttttgtagctattgtaaatgaggttgccttcttgaattctctttcagccagcatgttgtttatgtattgaaatgctactgattttgtatattaatttatcccacaactttacttaattcatttatcagttctaagagtttgttggtagagtctttaggttcttctgtatataagatcatgtaatctgcaagtaggaacaatttgccttcctcttttccaatttggatgacctttatttctttctcttgcctaattgctctggctagagcttccagtataattatgaataaaagtggtaagagtgggcatccttgtcgtgttctagttctcagagggaaatgtgaaagcatccataagatgttaattgtgatgcaaaatattctaaactttattatattctcacttactttatttctaaaatgaaaatttatcaaatataatgcctttatctatatttctgatttaaaggaaatgtgcacataccttttgaatttgttaattagaactagatcaacaaggtcataatgaattgtcagaaggttggtggttaaaataagccttctataataagcagagtttacaatgttaagtggtaaatccagctttcttcagtaaacattcaaacaggtgtagttctctgtaataatcattttcagtgttgaaattataaatcgagtccatgaaaccattttagtaaaccttttgctactagtagaaagctccttacccatgttaccaataaactcaaagagaaacttaaccttataattgcaaaattgcaagttagtgtagattaaactttatctaatatgaaattataatgtctaccttagtgtttaccttctcaaacatttctatcaacagtctttcattttaccaatgtttcttattaaacaactttcaagtttcactttaagttctagcaaaaaatggaataaaaattattgggttcataattttctgtttccacaattctatttttcttttagtagtttattgtattggaagcttggctcattaatttttaatctaattttttgtttccttttctggtacaataatttaaatctacaaatttctgctagaggtagcaatttacctatatccaatgagtttgacatgttgtattttcattataggtcaatccaaataattcctaattataattgcgatgtcttctttgacccatgtatgacttaaaagggtgcttgtttgtttgtttgtttggttggttggttggtttgctttgcttttggttttgttctttccacatgggtctatgtgtattgggggagaagagttaattatatttattactgatttctaagtaatttaatagcatcatcatcaaagaaagtaattttttaatactaattttcttcgtaacctagttcttggtcaatatgtttttagtgttctttattgacttggtggggtttccagccattatgacaacccacttatatttccttcctgcaaatctcatattgaaatatccattgttggagatgtgacctagtgggaggtgactgtgtcacgggggcagatccctcatgagcagcttggtgccatccttgcagtaatgagtgaattcccactctattagttttcacaagagctgattgttgaaaagagcctagcatctcccttcccttcctcatccttcatccgttgccacgtgatgcctgtcctccttcccctactgccatgagtggaagatttctgaggccctcaccagaagcagatgctgatgccgtgtttcttgtacagcctgcagaactatgagtgaaataaactttttctttataaattacttagtttcaagtattcctttatagcaacacaaatgaactaaaacattcacctattcaatacaaaacactaatttcttcattcactattccttcttgtgttttgtgccttcctcctggattaaattttcttatcctttaaagatattctttttctagaagtttattcatagctaattaaatttgttcagaagtaattttattttatcctcacatttgaatgattttctacattatagaattttaaattggcagttattttctctaataattttgaagatatttttacaaggttttctaattattttttatttgaagatagtctatatttttccctccacttgcatttaaaatatcttctttaatggctctacagttttaatttataggtttctggaagtggatttgtgttttcctccctgggatttgttgagatctctgaatctgaggatttatatcttttataagttatgaaagatttctggatgttatttcattgtaatttaaattgccagttctccatattctatacttttctagaatgtgtatgagatgaaaatgtatctttacattccatcttccacatctcatctcatgtgccagtttcgtaccaaaatgtaaatcccttagcctccaagttcagaaactcccccagggttccttggttttagtttaccctcttagaattctggtttgcattcaccactgctcagggttccatctggtattcagctgctttactttgagcccctggggatttctcatatccttgcaagctctactatgcatttaaaataatatttgtaatgttttatagaagacttctgggtaatttttcgtgaaaatgtcttcagattatcttgtttataacatttcaggaaatagaggtcagtgaagattttaagcatcaaaaatatttaattatgttaataagtttgaactacttaatacagacatagtccttgaaaattttagaaaaacatgcacactactggggctgaatcaaaaaatgctttgtagttgacattattaaatagaagagttcgttattcaagacctcactctccatgcatctcgttaattaatattttactttaatgtttcaatttccttaaaacttttagagtgttgcgtagtttaaaacaattttattatcttcatttattggtttattttcatcattcttctgtcttgtgttaaataggaacaaaaggaacttgtatgtattaactaaggttaagtgagtacaattaaggtagggtgttgagctaactttgattaattttagatagatattctagaagtagataatctttgatcttaaattagatcaccttttatttaaatggcttaataaagacaatgcttttagtatgatctaatatttttgaggcttgggttcaaaactcatctactcttgacaatatttctgttatatatttgtgtattttggaatctttctcatcttaatccttgtaaagcatttattgctattacaacaactatagccctcaactgtttcctggcaatttcaaggtttctggtattgccttcccagcaagtatataaactgctccagggcagcaacagcacacagggttctctctcatgattcatcaccacagggttggtacacctagcagccaagcacaaacaaggtgaaagaaaagacctgattgcctgagtagcagctctatctgaaacagaaatttcactaacaccaatatataacagaaggctaaagcaataaaatatttatgaaactatccaagtccatggtgtttgattacaattcctgctcacagactgccttgtaaaaggacgtgttaaagatgaaagaaaaccaaatccctattaatcagttacaaagctagaaaaagccagagagaagaaggctggggaaagaataatattcttattataaacattttcaaagggtcacttgtaacttcaacctcaaacctagaattttcagagggctcaataagccatttaattcagtcattcaaatatttattgactacctatcatgttaagcactgttctaggcatttggtatacaatcataacaaatcaggcaaacatttttgccctcatggaacttgaattctagttaggaggaagaaacaaacaaatggatacacaaatagataaatgaagatataacatgtcagaattgctatgaagaaaaattaaagcagcaggaaagagggtctgggccaagtttgggagattatcattttaaatagatggttagcgaaagcttcactgaaatggtaacatttgagcaaatgggggtctgagataacaagccatgaggatatctgagagagaaatgttccaaacagagagaaccgcaaatgtggaaacattaagccagaaggaacctggcttgtccgaggaatttttagaggataccacggcaagaccaggatgatcaaagggtagttgtcaaaactgagaatacagggtctatggaaataaagaagagaaagctcttgtagggcactgaaggcctttgtaaacaactttgatttttcccctagtgagatgaggagccattggaaggaattttgaggcaagcgtgagacaattatttcgagcagaagaaaacggcaaaagctgaagtcagctgaggttaagagaagactttttttagatgagatgagagacattatggcatgcttttatatcagtaagcagaatccaggaaagaaggggaaaaaggtgaatgaaatgtgtctaagaaagtggaaaactgtcatagtggttactgggactagcagagagggaaacagacctagtgtatattggagaagctattcttaggaccctggagagttcactcacagtaccaggagagaaggcaatgtgtataaagcacaggtacaggcaggttgatcaggcagtgagccctgagagggtataaggacattttcttctattggtttcattttcatcttggaatagaaggcaaggtcagctgagaatgacaataaaggaagaggtaatgggggttggagtagaggaagagaacaggcctcacacagggctgcagaaggcaacatacggtagtgggaacaagcaaggttcatattccatctctgtcatgtatcagccatgtgaccctgggtaaattttttgttctccctaaactctagtttccttatgcaaaatggaaagactaatagtttcagtatcactagttgtagacaggatgaaaagagagaatgtaaaagcaatttcaacattactttatggcaagcacttagtatatggtaactgtttgctgatatgaatacattagcaactcaattacttattaatggataggttgtgatattttatttctactctctttgcaggaggtttgtcctcaccaagcttcgagtcatccaaaaaggtgcattttcaggatttggggacctggagaaaatgtatgtacctagcactgctgtgagtgaatgcctcaagggggctatagggagcaacctcagaccacatctagtatgactatctgcacttagtagccgaactgacatggtcagccaaactttctgcatctcctcacattttactgtgttaccatggttcctaaatgatagtgtggagtctttcactgaggccattgaaatgagcaaaagagcaatccaagcaattttcatcatttctcaaataaggggttgctcccagagtaccggtgaatggaattttcataaaccaaagcctcttcttttctgcagacatccactctctttcagagatactttctaccatttatgattaatttttaattgacagcaggacttaacatctatgctgtagagattctctagacttcttgtttccaaagtattcatgcaggcaagtagtaattgatatataagcatttcaaagtactaggaaagtttacagcactgattaagatttcctttgaaaagagaagcctcttttgttactgcaaacattcagttcacattgcgctagtctaatttagagttttcccaagacatggttttctcaaagtggggtgcaatagtaaaagagcaaatcctcctatacttaaagtaatcctccctccctttgaaagctcttggtatcacctcctgggcattcagggccagggaaatatgttcttctctgcagtgagacagccaggattcaggactttaatgccagtaagtatagcaatgaatagacagagtatatacagaagggaatgaaagcaaggcaagaaagaaaacctttagttcatgtgtttctttcttgaagtcattaactttatctttttggttcttttatatccctttaagaatagtacttcctgaagtctgaagaagcaagaaaggaatccaataacaaaagaatcacaaagtatagaagatgtcattatgttccagcaattaagccacctgcttaaaagagggtggtcagaatcctggtttcagtgctagttttaatataaaattactgcataacctcgattaaagcattttatctttcagggccctggtttcctcatctgtgtattaagagaggagttttaaaaaggggcttacgtgatttccaatttctatctccatgttgcaggagagcccgatttaagacctgtaatcttccgggtttacctcattgaggacattcaactatcacagggattagaagatggggatactaaagctgaacagagttcacaaaggaaaccagggagacagtagagtgggagagctttatgctcaagatgtattcgcgattcccttgcctggagctaacatagactaaatgactactggatatccctgtgtccctaaacatcactataattacatagaattctaaagacaggcatttcagatgtcacaaataagctactttaatcaagtttaatccagcaagtgtgaatgacccctcattgggtattcagtatcaggcaaaccttcctgtggcaatacgaatggttgagctgagctgacatatcaacaatccaagaaccacagcagctggctcagtaactcaacttgttcagacacagcttgtacatttttacctcatgtcttcattaatcatcctgaactggcacagcgatacaccaaaataaaattgatcttgtttttttaccctttttataccataaggcttcaaagcattttctagcagagggcccagcactgaactgaacctgaggagacttgcgtattcctcagtctccgtgctcacctttgtccattgtcttaccttacactcttggtcaccaagaaattctcatctcctttccagacctatctccttcacttgtgttcttccagttgttaatcagtttcctgaacttaataaatattggccttttcttcagtatctccccctccacaaatcacaaagtccttttcattcattctgcacatgtgaccaactttcacctatccatgttggaaagaataaaagaaaagtattctgtataaattccaccttcctattctgctcccttcttctctcttccccatcaagaccactgtgttgaaagagttgcctacattcactgcctctctatcctttcttttcaatcgcttcttagcctgcccacttgctatttggacaaaaattcttcaacactattaaattattctatcaaagatctcaaaaataccacagttacaagatccagtgaattctactttatcctcttctacttaccttatatgtagtctttaaatttcattaaccattaatgtcattcttctcaatgccctttccccacttaacttctgggataccacactctcctgcctccctattaacctcccagattgctccatatccagttctcttcatctctcttgttcttcaactgcccttcaaaaatttaggtattctagggttctattttttggccattttcttttcttctagctccacccttgaatgaccagttgtcagataatgtcttattaccagggttcctaaactttcatctgcaacctccacctctctcctgaggccataattcttgttttgaattggaaagatgcctaaacatctacatctgagtgaactgcaaatacctggaattcaacatattcagaactagcttatctttatttttaaatttctcgtattcccatattgcccagtgaatcatgtcaccatctgcccaggttcccaaacaaggaaaatccagtctcccttgactcaggtgcattctctatcccttatgccaaggtgctcctccagtcctactgactgcctctcagatgtactctgatatccagtcctcttctcattcctgttactattagacccaaagtctcatcatcacttacataacctactgtatgaagcttccatgcctatcccagctccaatcttcctgccactctgctgccagacttgcactgtttaaattctcttgcagaagaacttctagggatcttcctcgctgcagacttaagtcataagctcctggcacagaaatcaaaaccctttatttcccaccatatgcactgtgtaccttacactctcaccaggtggaataattttctattccccaagcactattattaccagacatcatattgcatatttagaatgtgacagcttgttctttggacaatgtctggcacataaagggatcaaaaataattgcaggggaatgaatcaacaaataaacaaatgaacaaaatatactttcacactgttcttatgtagatgctgtccctctgtctaaaatttcacttcataaaatcctgcttcccattcagggaccagatgaaatgcttacttttctacagaacttttccagaactttccaagttcttccaaaccataaccctgtattcataatattaacagcacatttatcagactgtactcagaatttacagtttctcagatcccttggttattcattaaagccaagatcacaatgtagaaacgtcgtactgaagtacaacaccaagtcctgttgtttttacctcgttacacgtctaacctatccacccatctctttctccagctaccacaatctttccctggtatcttagtccgtttgtgctgctataacaaaatactgcagactagataatttacaaggaacagaaatttattttcttacagttatggagacttgaaactccaaaatcaagtctccagcatctggtgagggctttctagctgagtcctcacatggtggaaggtggaagggcaaaaggggacaaacatgtccctacgtggcagaagaggagaagagagagaacccactcccaaaagccctttttaatggcaacactaatctcttcatggggatgggcccttgtggtgtgggccctaaaccactctcaaaaggccacatttcccaatgttggagtggagattgagttttaacaggaaatttggggaggaaaaaatatttaaaccagagcacttgtgtaactgcaacagccttcaacttgtgctgtccccatttaccagcatgctcttccctctccctcatccattttcaacatagagtaatattttctaaattcataactgattatgtcatcttccatatttgccccaccatgcatgtgcaaacacacacacacacacacacacacaaactcttcatgccttaccactttttttgttcttgttccacagttttttcttttttattattttttaattgacacataattgtgcatatttataataattgtaacacataataactgtaaaataattgagtatagtgtactattttgatacatatatacattgggtaatgatcaaatcagggtaattaacatatctcacacctcatatatttatcatttctttgttttggaaacattcaaaatctgctcttctacatatttgaaaatacacagcaaattgttgttaattatagttgccctacagtgctatagaacagtagaacttattcctcctattttgctgtacttttatatctattaaccaatcttttggtatcctctctcccacatagacttccctgcctccaataaccactattctactctctgcttctttgaagtcagacttttttagcttccacatatgagtgagaacatgcagtatttccctttctgtgcctaacttatttcacttaacataatatcctccaagattatctatgttgctgtgaatgatagaattttgctccctttcatcactaaatagtattccattgtgagtgtgtgtcacatacatatatatatatatatagcattttctttattcatttctttatttgtgaacgtgtaagttggttctataccttggctatttatagtgctacaataaacatcagagtgcaaataggtctttgacatatttacagcactgatgaagatttcctttgaaaagagaagaatcctttgttactgcaaacactcagttcatattaagctggtttaatttagggtttttccaaaatatgattttctcaagccagggtacagtggcagaagacagagcaaatcctcccacacttaaattaatcctccctccctttgaaagctcttggtaccacctcctgggcatttagggcctctccttgcatttgaatacatacccattagtaaaattgctggatcatatggaagctctacatttagtttttagaggaatctcatactcatactattttaaataatggctgtactaacttctattcccaccaacagtgtagaggagttcccctatctctacatccttgccagtatttgtttatgtttttggttttgggtgggtttctgttgttttttttataatatccattttcactggggtaagatgagaccttatcatggtttgatttgcatttttctgataattagtgatgttgaacagttttttcatatgcctattgaccatttgtatgtcttcttttgagagatgtctatttgacccatatgatcatttttaaatttgattattaattttgctgttgagttgtttgaattccttgtatattctggatactaatcctttgatgagtagtttccaaatattttctcccattctgaaggttggctcttcactcggttgtttcctttgctctacagatgctttttaatttaacataatgccatttgtctgtttttccttttatttcctgtgcttttgaggtcttctccataaaaatcttcacacagatcaattttctgaagaatttcccaatgttttcttccagaagttttatatagtttcagatcttacattttagtctttaatccattttgagttgacttttgtatatggtgaaatatagatatccagtttccttttctgcatgtgaatatccagttgtcccagcacaactcattgaagagattttcctttccccaatgaacgttctcaatgtctttgttgaaaatcacttcactataaatatgtaggtttatttcttttctgtgccacctgcatatggtttggtttttatgaccatagcacgttgtttggattactatagctttgtagtatatttttaagtcctgtactgtgatgccttcagctttattctttttgctcagggttgctgaagatgtatattctgcagctgttggatgaaacgttctgtaaatgtctgctaagtccatttggtctgaattgcaatttaaatttaatgttcataatgttgattttctgtccagatgatctctccagtgctgacagtggggcattgaagtccccaactattactgtattagaggctatctcttcctttaggattaataacatttgctttatgcatctgagtgctccaggtttggagataaatatatatatataaatatattatatttatatttatatttatataaacatatatagttatatatgactatatataactatatagttatatatgaatatatagagttatatatagttatatataaatagttatatataaatagctatatatttttatatatagttatatataatatatataaatataaatatatagttatatatagttataaatatatagttatatatagttatatatattatagatatatgtatttttatatatctaaatatatatacatttagatatatagatatatatctaaatatgtatatttatatgtatatatgtatttatttttatatatctaaatatatatatatttagaatcatatcctcttcctgaattgatccctttatcattatataatgtccctttttgtctctttttacagtttttgacccatagtttcctttatctgatgtaatcatgatagctactcctggtcagttttgatttccttttgctcagaatcacttttatccatcccttcactttcagtttatatttgtctttacaggtgagaggtgtgcttcatatcagcagcatatacttagatgctcacagcagctatgggggcagggtcccaggcttatggtcttgcatacctgttatggcacctgggtcttgaggtgcaagtttgctctccttggcaggattagatgtaggtttcccatgaagccaagatttgtgactctgaggcaccccctagcagcttgggttcaaggtgccacgttgtagtggtgattatgcccctgaggagcaaggtacagtactaccttgatccctcagaagaaggggtaatctggaggtatgggcagggggagaaaggtatggatgcaatttgagaacctgagccaaatatacccagtggcatctcccaggagatgaggcactttgcagtagtgaccatagaccctggaatggtggggcttagcagcattctagactctttacagccatgtgtagcaacagcaagtatcccagaatggcaaagcacagctctagtttgggccgggggggagtgggtacatggatgactgcactccccagggagagaggtatctcagaagcccagaatagggaactagtccggctccagggaagcaaggtactagaggtatttggcatatagggtggagtatttcagttcagccacttctctcttgcctgggcggcaggatactataacagctcagccttggaatatgcagctgttcagcttggccagggcattgacttcccaggggcaatgtgccacttcagctcaggcctgtgggatgtgactgttctaggcagcccaagccccatttccctggaatgcagagtgtcacatcagcttaggtactggggtgtgtgaccaccctggctggtcaaggcatcatttcctgggatgcagggcacagtttcaacttaggcactggagaggcatgacttctctgagtggtcaaggtaatgttttcccaggatactgagtttttgtttttgtttttttttccttttgctaatacctaatgggatcatatggtagttgtatttgcagtgttttgaataacctttttatactgttttccatagtggctttactgtttatagtcccacgaacaatatgtaagggtacctttttctctgcatcctcaccggtatttttttcgtttaataaccatcccaaatggtgtgagatgatacctcattatggtttgatttgcatttctctgatgattagtgatgtggagcatttttccatatatgtgttggccatttatatgtcttcttttcagaaatatctgttcagatcacttgcttatattttaatcaaatttttttggtatttttttgtttgagtttcttatatattctggatattaatgccctgtcaaatgagtacttggcaaacatattctcccattctgtggttgtcttttcactatattgattgtttcattggctctgcagctttttggtttgatataatcccctttatttttgattttgtttcctgtgcttttgatgtcttattcatgaaatcttttccgaaaccaaagtcctcaagcacttcctccatgttttcttcttgcagttttatcatttttggacgtatatttaggaatttgatccatgttgagttgatttttgtatagaatgagaggtgaaagggggcatctgttaggttgatataaaagtaattgcagtttttgccattactttctaatagcaaaaatcacagttacctttgcaccagcctaatagtatcagtcttctacatgtggatatccagttttcccagcatcatttatgaaaccgtcctttctccagtgaatgttcttggcacctttgtcaaaaatcagttggctatagatacgtgcattaatttacggattctctattctgttccattggtctatttgtctgttttttttttcccccagtaccatgctgttttggttactataactttgtattatattttgaagtctggtagtttgatgctgccaactttgttcttttttgattaggcttactttggccatgcaggatgttttgtggttccgtacaaatttaaatttttttttctacttctgtgaatgacggcattgttgttggctgttttattttattattatttttttaatttttagagacaaggtcttagtcaggcaggagtgtgatcatggctcagttatggctcactgcagcctcaaactcctgggctcaagtaatcttcctaccttagcctcccaagtagctagtactacaggcatgtgccaccatactcagctatttttttattttcttgcatagatggggattatgttgcccaggctgctcttgaactcctggactcaagggatcattctgccccaatcacccaaagtgctggagttacaagtgtgggccactgtgcctagaactgcattggtattttgatagtaattgcattgaatctttagattgctttagttagtaaggtcattttaacaatactgattattcacatccatgagcttgggatgtttttccattggtttgtatccttttcaatttacctcattagtgttttgtggttttccctgtagaggcctttttccacttgagttaaatttattcatagggttttgttttgttttgtagtttttgtaaatggaatgggcttctttatttttttttcaggtagtttattgctagtggatagaaatgctactgatttttgttggttgattttgtatctttcaactttactgaatttgtttaacagttcttaaaggttttttttaggtggggaggagggtgttgaaacagagtcttgctctgtcaccaagctggagtgcagtggctcgatctctgctcactgcaacctctgcctcccggttccagcgattcccctgcctcagcctcccaagtagctgggactacaggcatgcaccaccatgcctggctaattttttgtattttagtagagacagggtttcaccatgttggccaggatgttctcaatctcctgacctcgtgatccacctgcctcagcctcccaatgtgctgggattacaggcatgagccactgcacctggccagtttttccatgtataatatgtcatttaaaaacagggacaatttgacttcctcttttcaaatttggatgcccttcatttcttcctcttgcccaattgctcttgtttgaactttcaatactatgttacataagagtggtgatggtgggaattattgtaacattccagttgttagagaaaaagctttcagcttttcctcaatccacatgatattagctgaaggtatgtcatatatggcctttattgagttgcggtactttccttctatacctaatttattgagagtttttatcatgaaagcatgttgaattttaccaaatgctttttctatattgacatggtcatatgaattttgtccttcattctgttgctttaatgtatcatgtttactaatttgcatatgttaaaacattcttgcatttctcagataaatcccacttaattctcatatattatttctttgatgtcttattggttttggattgctagtattttattatggattctgcaactatcttcatcagggatattggcctacgttttcttttttttgctatgtccttgtctggtatctgagcaatgctggcctatgagaatgagttagaaagagttccttctgcttcaattttcagaatcatttgagaagaattggtattaattatttttcaaaggttctgtagaattcagcagtgaagccatctggtcctgggcttttctttgttgggagattttcaattacctgttcaaacttgtcacttattattggtctattcagattttctatttattcttggttcaatcttggtgggttgtatttgtctaggactttatccaggttttcaaatttattggtgtatacttgttcatagcaatctttaatgatcctttgtatttttttagtaaacattgtaatgttactactactgctactgtcattgtgtatgtttttcatttctgattttatttatttggttattctcccattttttcttagtctagctaatggtttgttcatttggcttatcatttcagaaaagcaactttttatttcattgatctcttgtgttattattttagtgttaatttcatttatttctgctctgatatttattatttttgtcttctactaatttttggtttggtttgttcttccttttttagttccttgagttgcagtgttaattggtttatttgaggctgggaaatctttcttgttttttcatataggggtttactgatataaacttgcctcttaattctgcttttgctcatcccataggttttggtattttgtgttttcattttcatttaagaaagatttaaattttattcttaatttcctctttacccattgattattcagaaatgtgctgtttaatttccatgtagtgtatgctttcaaatgtttctcttgttattgatttctaggtttattccattatggtattatagggtacttgacataattttgatatttttaaaatttttttgagacttgtttattgtcctaacagaaacaatatggccaattctgaaaagtatttcatttgctgatgatgagaatttgtatcctgcagctggtggatgaaatgttctgtaagtgtctgtttggtctgtggtgcagtttaaatccaatgtttctttgttgattttcactctaaacaatctgtctaatgctgagagtagggtgttgaagtctccaactactaatgtattgcggtctatctctccctttaggtctaataatatttgctttttatatctgtgtgctctggtgttggatatatatatatatatatatatatatatatatatatatatattccaattgtaatgatttcttgctgaattgatccctttattattttataatgttaatttgtgtctctttttacatcttttaacttaagtctgtttttctgatgtaagtatagctattcctgctcactttagggttttgtttataaggattatcttttttcaatcctttcaatttcagtctatgtgtctttacaggtaaagtaagtttcttgtaggcagcatatatttgggtcttttaaaaaaatctatttcaccagtctatatgttttaaatgggaaatttaatctatttacattcaagattattattaataggtgaggacttactcttgcaattaattgttatctgcttgttttgtatatcctttgtttcttacttcctctcttatttttaattattgcaattaggtggttttctgtagtgataggcttgattcctttctctttgtcctttgtgtatcaagtctaacagtgagttttagagttttgcatgttgtcatgatgttggtttcagtctttttacttccagatgtaatactcctttaagcatttcttgtttggcaggtctagttgtgatcaattcccttatttttttcttgtccatgaaatgttatatttctccttcatttctgaaatgtagctttgctgggtatagtattcttgtctcgcagctttttcttttagtactttgaatatatcatcctattctcccctggcctgtaatgtttgtgctaagaaatctactcttcatccaatgtggattttttaatatgtgacttgaggcttttctcttcctgtttttagaagtttgcctttttctttgacttttgactatttgactgtaatgtgccttggaaagaacttttgggattgaccctatttgggttttttttttttttttttttttttttttttttgagcttcctggatctggatgttcatctctctcccaatacttgggaaattttcagctattattttattaaatatgctttctatgccttttcctttctcttctccttctgaaattcctataatatgaatatttatttggttaactatgcctcataaattttgtagactttcttcattattttttattatttatttattgtgcctgtgttctttcaaaagacctgtcttcaagttcaggtattttttcttctgcttggtcaatctgttgttgaagctctcagctggttccttttatattttattaattgattttttaagctgtaagatttctgtttggctctttttttgtgatatctctttgccacttttctcactcaagttatgagttgttttcctgatttgattaaattgtctatctgtattctcttgtatctcactgagtttccttaattattattttcaattctttttctggcattttatatatttctttataattagggtctgtgactggagagtcactgtgttcctttaaggtgtcatgtttccttgctttttcatctttgatgtatccctacattgatttttatgcatctggtcaaacagtcacctgttccaattttatgaagtaggttttataagaaaagacattcatttggatgagtcttggggtgttgttttggtgaggtgctttgacttttgttctaggtggatacaatagtgtagtatctgtgtcatttctttttctgtaatccatgctagtaatgtttgcgagtgtctcagcagcctaagctgagagagtctgcagttgttgtgctgtggctttactaggggtgggcttgctagactgtctgtcaggtcacaggtacatgtgtgcacacagtgcgttggccaactcagggtctggctcactggggttggggccatgtggctattactttgatcagaggcatgggtgcatggttgctccactggcttgaaagcatgtctacctggggctatctctcaggcccagatgtaggcacatagctacttggctggcctgggggtatgtctgcttggggtggcccacagggatgttttgcaggccttggacatggttggatggcctactggctgatgtgggttcgtgtgtcttctttgggtggattctggggctgtttcttagattcaggatgtgggtgcaaggttgcttagccagcttggaggcatgtctgccagcagcaacctgtgggctatttcttaggccaagacatgggcacacagctagtaggttggcctgggggcatacctcctggggtccacccacagagctacattcaaccctttttcatccccccagttgcacaggagataggtaacatcattagtgctatgttatagataagaaaacaggcttaaacagatcaaattctctgtccaaggtaacacaatgggtaagcaatagaaaaaagatattgcagaatgtacctcacttacatggaactagactaatctggggagatgctgagttcacacatctttattttcttctctctttagatctgtctctatgttgtacaagtgtttcaacttctctaatactaatctccctaatctggaaaatgttaatactaaggtctatgtcatagagttgtcaaggcccttaatactcaatctcagtatctgaaacaacatgggcatttgatgagtttatttcttactcccatcctcttgttaaaatgattgggaaaaattccccaacccttgctgatgattcttcctcatttattatcccagtttaacccagcctcctctacttctatcagaagtcaacagggaaaggactgttttttttcttttttttaagaaccaggaatagaagtttgtgcattagaaatgaaatggccactgttcatgccttagcttttatctgcatcactatctcaaacctccctattcttcattgctttgagactttgtggggggaaaaaagaaatcattaaactctctgcaacatgaagtggctttgcaaagtgcactgtaaactgtttacattgtctttaattacttcggagccatatgtcagcttggtataaagtgtgaagattacattgaatagggtggggggagtaggtgacaatgtggtgatttatggtaaccagaaaaattatgtatggaaatgagttcaatttaaaaacacatctatgtgttattataacactggaggtggggggaaagctagtttataacaaaatatctttggaaataggagcatgatgaatatgcaaatgagaccaatcaacatcagctgaaatatggtatatgcagatgaggcggcaataagccaaaatgtgaaatagctcccaaaccataaatatgaaccacataaaattcatttgaaatattcatgataacataaggacaaaaaatataatcaagtgatttatttgcatatagaaatgagaacactagtctgacactccagcctccacccccagatcactggggaaagaaaagttaacttaacagagggacttttagagaaagagatttattgaatgagaattgttgcaaacacattaaaaaagttgaggatcctcccaattctcagttcttcaggctcactcagcacagataaaaggaaaggaagtaaatcaggtaaccagaactgtaactgcaacagtgctagaaaatttgggttccactcagctttgcccttcagagcacccccttgttacatgacttaagttccttcctaacccaaccttctgtgattctgagagttaatggtcaaagcagccttgagtcccgcttactcaaagcgaaaaggagaggctgatgattctactggctcctggtgaaaaatgaaaggccagtgttagactggttagatctctgaatgggaagaggggatttgagtccctgggaataacaaggaaatgacgttgagtggttctcttcttagactgcactttagaatcccctggagaactttaaaaataatgtacacacccaagtatcacttccagatatttttattccatttttccaggacgaggtctaagcattaatcattttttaaagctcccttgatgattctaatgtacatctaaaattgaaagccactgaggtagatgatagtttagtcagaatccaatttgtacaaagaacattcatgagtatgtaaagtgtatcatctacatgttgtagctaaagaagaataaaacaaagaggaggttggcaggacataagatcaaagaggaagctgggagtgaggtcatattagtacctgatagaccatggggatgtatttgggtgtcatatttagtgtgattgggattaaatggggtgttttgagcaacaaagtgacataatctgatttgcatttgttaaaaattgtccatacacacaaattttgatttgctaatattttgtttaaaatgttttatctatatttgtagcaatattagtctgtatatttattttcttgtcgtttctttgtttgattttgttctacctgtattataaaatgagttgggaaatgttctctcatcatctatatcccaaaagtgtttgttttctagaattcaatacggaaagaatagtttttttccacaaatgatgctgaatcaactttgtatccatattggaaaaacaataaatcccaacccttacctcatgttatacacaaaatttaactttaagtggataattgacttaaacgcaaaaactaaaattttaaaactgttaggagaaaaatattttacaatcaggggataggcaaagattccttaagtagaacacattaagcataaaataaaagtgttattttggacttcattaaaagaaaaaacttctgcttttcaaaagacaataaaaaaagtaaaaaaagacaccatcaagaaaatgacaaccaaatcacataatgagagaaaatatctgcaatacatatatctgaaaaaggacttgtatcaagaacatatctttctatatataaagaagtaaaaaataagtagacacacaatctaatttaaaatgggcaaaatatctgaacagatacttcacaaaaaaagatacacgaatcggcaataagcatacgaaaagatgctcatcattagtcattagcaaaatgcaatttaaaaccataatgaaatactattacatacccattaaaatggccaaaattaaaagctgataatagtaggttactggtgaggctgtgaagcaactggaactctcctacatgtttggtgagaatttaaaattgtacaacctctttggtaaacagtttgtcagtttcttatattgacccaagagaaataaatacatatatttctacacagagactgcaagaatgttcataacagatttattcataatagccccaaacagaaaatcactcaaatgtccatcagcaggccaatgggtaaacaaatggtatgatatccacacaatttaatactaagcagtaataaaaaagaatacactgctaatatgtaaaacaacatggataaatctctcaaaagcattatagtaagcaaagaagccagacacagaaggtataccatatgattctatttatatgaacctcaaaaaagaagaaaatctaatctatggtaacagaaagattagttgcctggttcccagggtggtgttagggattgtctgggaaggcagacaaggaaacttttttaacgtggtgaagatattttatatcttgattgtggtagtagtaacaggtggaagagttaaaatgaatgcattttattatttgtcaaattatacttcaacaaagttgatttttaaaatcagcaattattccacacctattctgggacaggtgttttaaatactacatctcagttaactcacactgtatagacagggatactgacattcacaaaaggtaagaaaccaagcaacatcagagtatccttatgtggtgaagctaggatttaaacccaaggtagtctggtcctttctgctacacaaggcttcttttagttggaatctaccattttcccacatgttcctgctaaggtaaaagagggattgacaggaaaattaaagctattagcttcctttggtgacatttattatcagaggagaggatgtctgtgcctaagcccttggaactgccacaaaccagaacctagagtgattctctactcctatagtcacagagtgaaggaaacctcttcttggagctattttcctttcaagtttcagcttgcaaactcatttctgggtaaagctcctgctaagagtagctttagtacaagggtttgcaaactgagcttgctgttaagttgcaaattaacttagccatcagttgggaaatataagatttgggccaattaagcagttattattgacccaggtcaaacgtgagttagtgtctagaaggtgaaaatccttatgtcatttcctattctccataaatattctgaaaataactatttttgttatatttattgcttcaaccaagaacacaagaagctattttcttgtcactttttgggttgatgtggttttagtgtttccattaagtctccctatttttaacttgctaggtgtgtccttaaaataaactctacagtatctaagaactgcccagatcagaaggggaataatttattagctttgtatttatatgtttggaatttttgcttctttcttttatttgggtttggtttttattatatatatatatatatatatatatattagagtaggggctatatgagtctgataaagaaagcagagttcttgagatctgtaattttatagatgttcccaaccttatactcataataactcttcacacctcagtcacttacgctttatccatgaggttagagtgggatttccttggctgaaagggattacaacgaagaaaatacagtaagaatacaggcaggaggcccactgtgagctaataagcttatagtaataaagatgtatgtcatagatgctcccttgcttggtagagcacagatatgccctcatttacatctctcatctctaatatcccccaccctcttggccatttgatactccaagcattcatggtcctgatgacttctgcttggtacctctcattgagcaactaagacttccaggtgctaagatatgacagaggttactcaaggcatttctgacttgctatcaaacgcaatcttcttccattttctaatcaacagccaagtgaggtcatcttatctatcttttacaacttctgcttcagcaacactttccctttggactctccttgacaaagcaagctgtgtgtgagaccttccagtgaattatatttgtcagtgctcagagatataccagaaaatgaattggccttttttttttcctccttgctggtaactcaatgtttttgtctatccagtgaagatacaattaaggcagcataatactcgagttaaaaatatccttgtggctctgctctggggatttttctagcttttttttttaatagatggtgttaaaataaaaagaagcaatctaaaggtaagctgcaatcaatgcatgaactatttatttttatttcctcatttagcccatgcccatcacaaccacatccatctgggctgtgtatgacttaataagatgctttaaacagtaaaagattcaaatagaatatggaccctcttgcctgtccaccttccaacaaataaattacctgaatcttacacttcataaacctcccctgcagtgctcagattcaccctggccagcctacacagcaatcaaatgaccaaagatgtgtttttatatataaccattccagaagttaagcaggcagagaggaaaagtccaggagctaggggtaaatgctagagaagcctaaatgaatgaagcagaagttagccatcccagtgggtctgaggttctgagagagtctgggcagagagatagcaattgtttatgccaaatgttttataaacacgtaatatgcacttggacgtgagcatgctttgaaaagttaaaagtgagtgcaaatgcaaggtatgaataataaggacagcatgtttgctctgtttcccatttatagtgtctcagcttgactgactacacgctgactactaatcctgccctttccctcttcccatattcctcgaaagcacctagcacagagttaggcacactggaatgataatggcaggtgatgtttattaatttgcagtctctacctcttgattcctttcccaacttttcagagccccaggttttttttctataagaaaaccactttttatttattttactttttttttatcatcctcaactttttctttccagtcttcttgaggtatgattgacatataaaaattgtatcaatttaagctatacaggctggccacgatggctcacatctgtaatcccagcattttgggaggctgtgactggcagatcacttgaggtcaggagtttgagaccagcctggccaacatgatgaaagcccatctctactaaaaattcagaaaaaataaaatagctgggtatggtggtgggcacctgtaaacccaattacttgggaggctgaggcaggagactcacttgaacctgggaggcggagtttgccgtgagctgagattgtgccattgcactccagcctggacaacaaagcaagattccatctcaaaaaataataataaataagctgtacaacctgaagttttgatatgtgtacatatttgtgaaatgatagtacaatcaagctaataaaatgcccatcacctcatgtttcttaagtcaagctctcaggtttttaaatcttgttcataattcttctttcccagtaaggataacagcatctgaagaacttattgacaccaaaagtctaaggaatttgtaaactggctcctccaacccaatatgccttttgtaaaaatcataaagtgggtaatgcccaatctaaaggattgaattgctaatggtgggattttagtcagggtggaacatatgcttaaggaccatctgctttaatacatgaaaaaccatatcctggctgacttgcttgtttggaccacaaagtctgtgtgtacatacacttaaatttgagagcagggtgatcgtgctgtaagcacactgacattagtgctttagagatcccgtcttttgatgggctcctcactctctgaccaggtggaaaactcagattattttttttctttactgaatgttgaaaattgaggtgtcagtcatcacatatttgtttaaaatgtactccttttatatcttcccttaaatttccttttctgcttctctccacatgtacatataacctctcagtccaaccaagttaagacagttgagatgtaacttttcatttagtaaagcagacatttgacttgggagataaagggtggtggtttactgcagcaccaagtcccaaaacaacaacaaaaaatcctacatatagagtaagttccattctaattttaaggatgtgaggccaaatctgagatcactggttaaggctttttaaaaggaggagatttatcgacttcagtcaaatacttgagacaagtgcaggctgatgaatgacaccagctaattcatcaagaaatttatcaaggttcacagagtaaaagactgtgacttccatcagtccctgtatgtctgtgggatgaagcttgtggagctaatgagcttccttgggctgagtacacctccttctgactcacaaatatgctgttgtgtttgttctgttctacttgtgagcaactataagagagaccaagccaactaagagaagcataatccgtccaccaatcaatgattcaacaaattcttcttgagctacaaaatgtgtgctaattagatgaggacatgatttgatgaaacttacctggtagtcactgatagatgctgtgagcaataaagatgaagatacacagtccctgcactcaaggagttctcatattgcttaacaacaacattaatcacagctgccatttgttgtgtgattattttgccagaaactgagctaagccactttatatgcattgtcttatctgatcataagaatcttactatcattctaattttatagtgagaacgttgaagccaaagtggttatgtgacttgcccatcagcacacagttgataagtgatgaagccaggaattaaatccaggcattcttactccaaagttcatgcattaatctactattctgagatatttatgaatgcaaaagtgtagcccagataatataagatgtaggacaatgataaccttgctccctaatggagagaagtaggacgtacataaacacaaattcagagttatcatccatttaatttgtagtagtagtatgaatatcttcatgtggctatcctattttataatttcaaaatgcctcatataccccttagctcattaatctcccacaccaacctttaagtagcagctgggacaagtatttgttcctacctcacaggtgaggagatgaagctcagaaaaatttggtaactggcctgagatcaacatctaagaagtcatgtaggtgagttttctctgacaccacatcctgtgcactttctccatatagtgttttgttttgtgccatgttgcctgtcatctattaaaagaaattagatcttgagagtcttatagtcatgtcagtacaaaatagtaagtgtgtccaagtctgaagaaaacaataacccttaaatttctgccaagtatgtaaccttcatatgcacatgtttttgctcaatatttctcatacttcccactcagcgttgagcacttggcactggggaaaaaaaggatgttttagaagcggatggatgtctaatccaagcagtaaaaatccaagtgcaaagctggccttttccacgccaaagagaaaatgctcaaataaggtgtatccattaataaaaattgacccaagctgtcccggcaaaacatttttttaaagaaaatttcctaagtcaactagacttattggctttcttttttcttgtttttgcctacctctgtctgccttcccttgaaattaacattctagtgacatgtagattcaaccagaacctcttagccaagatttcatctctgcaagagaggatttttcttttagttaaattcaatgagcatttcatgagttcctgttcaatgtctcctacataaagcacttcaaaatttaatgtgcatacaaatcactgaggatctaactactgtggagagtctgattgagtaggtctgggtggacctaagatttgtctgcctaaaccagctctcaggtgaagccaatgctcctggtctatgaaatacgattcctgtgttgggacctgtgtggtagaggatacaagagaaatggcacacagcctctgcttcagtgtagttgttgataaaatacacaggaaacaattagagaaaagcacataacaaacacataattcactgctattagccaaatgatagattatggggaaaaaaaacacttttcatattccctttgtcattgtcagatcacatttaattgttaaaatggtcctcagtttttagtacaattagtcacttataaaagtactgttgcagtttctaaaagcccctctcttggtgctctagaaacacagctggacactgaaaaatgcaattcacatacaactgtttcaggagcccattgtgtggctcatctgggctaattgagcctgagcactccctcttgtgacagaaaaactgtatctcagggaagaagcacaagtctaaatatagccattatgtcctggcagtctgaggtgggcaaaagtcagagggaaagtgcagggcaagttagcacataaggtttcttctagatcaaacacagctaaaattgtgagtgaagcaggttgggggaggtgaaatgaaagcaggcagtaagagtgctgggggagggggatgggggaaacagactttctttgctcctttcccctccagccaaggcccagtagcatttctgcacacctgatggagcccacaggaaacctagagcagaatgaaatctgtgctggtctgcatgagttccaaaggaggaatgctgcagagctaatcactggactgagattgccatttaatgcccttcctccacaagccattcatcaagtttatagcagcaataagagttcattaccatgttcccgttttgcacatgcttgaacaaggttatgcctccaattttaagtgtggtgtataaaaggaaccagggaaggtgggaaggcgagagggttcctggaagaaacagtaataaacaaaataggtgctcctcaccaaccgaaaatgtgagtttcccccagctgtttatgactttatataatcagaaaaaaacagcatatcacttatattctcatattcattcttactagtagctcctaagctgtttttatcaatctagctatccattcatcgctgccagtcttccatattaggagctaaaagaacagataggatttggttctaaccccgaagaaatttataatgtagttacagaaattggaattcacgtaaaacagagtataaaccagaatataagcaacccctaaatgttgctgtccagatctttggtgccaaagcagttgaaagacgtgggagttagatctatgtcaggcagagaagcaagagaaggttttatggagacagtaggatttccattatcaaagaagagaggggaaagtgttctgagtggcggatattaatgaaacagattcaaagtcataatgggaatccgaggtcttctcaaagaggttgcaggctcccacaatccatgtcattttgatcccattatgcacagtgggctcccactgagctctgaatgttcaaacaggaatagaagaaaagaagctgcttcatgcactgagataactgtatctgaattcatcggaacatttggtttttttatgccccacccgtgattctctaggcaagatgctaggaatgtgtccatcaatgtcctgatagtgcagtagtcagtgtagaacagacagattcaaattacatctaaaactgcttagtgtcattgacttaggagagccattgtcaagtgaggtctccaaagaatagacataacttaggtttggctcatgggaaccagagaaatgtgagatttatatgtgcccatttatctcagcctaattacatagtcaaatcagggtacatgtaaaattctctttagggctattattaatttttcagtttctatgtttttatgggttgcatttgctgagtaaataataaatgtgcacaccactaccccaccccctaccctgcccaccccagtcagaagcacacataggagaagtggcaaaccacacctgggatagtttagtgcaaccagagctcttagctctaagaagtgcttctccttgaagaggatacagtaaaatttctcagtccttccttaaacttggaaaggaatgaagccataaagggaaagagtctgctcctactgaaaaaacaacagtgttttcctgatgtcccctagaggaagtcaagtgaatgatggctattctcaagcttggttttctcatttgtagatatcttggatggtcctggtatgcttcttccagtgctataggatctgctatattcttccttttttcctaaggtgttgtcaatgttaggcataaaaaaatagacggtgcctggtcagtaagtttatgggtgacatacactatagctagtctctgccccttagcaatcctctatttatatgaaaatggaaacgtttgactgaaccaaatatgccacatcttcaggccttcctcattaacctctgtctctctgtcactaacctcctcctgtccctagagtctaggaatgacaaacctcatagatacatttggctctttagagctgactatgcaccatttgaagtcatgaaaaaaggaaattgctgctccagtgttcactaatgagtgattaaaagcaaaactatgtcctgtgaaagaattcaaaaagatttagtaatatataaacccatgtggacattctgtgatcatcctgtatagaggagaaaatattaatggcaatgaattcttcaactctttattaagggaagtgaattttgactcccacctttgtcaaattattttccctgccccttgtgagacttatcccattgccctgatgatcctgtttttaggatgttgtgtttctctgctcttgttctatcattccttctttagcatgcaaaaatcttctccttcccccattgttatctagtctggtttggttctcatttcaaataatccttaatgattggggtggcagaccagccacaggtttaatgtcccagaactaagtcactcgggggaaaaaaattggaaggtgagttttcaaaagcatctctggactccatagtatgcaatatgatatggaagaatgtgtactttccttgtctatgcccctagaaatatttctaaaatgaatggctatatacctagtgggcaggatgtaatcacagctcactgtagccccaacatccctgggcttaggtgatcaacccatctcagcctcccaagtacctgggactacaggcccacaccaccgcacacaactagtttttgtatttcttatagacacagtcccaccatgttgccaggctggtctcaaactcctaggctcaagcaatctgcttgccttggcctcccaacatgctaagataaaaggcatgagccattgtgcccagcctggttaaggtactttaggctactatcattgcaccatttcttcagtgtgctttctttttttttttcacttctttaaatgtctgatgctgagaaaggaaggaagttccctaaggctgagagagtctgtcttcttcctttcaggtaaggatgtcaaggggataatctcaaggaaataatgcattgcctggtatagatctccttggattcccttccaattccagaattgaaagacccaagacctatcttgggccttcctcagaataatctagaaatagtaaaataaaatcctctaggaccatcaatcaaataacatgaagactaaaataattcttcatacagcttggaaatcttaaaatagatatgcacgtatctggaaggaagacagggtctcagtcctgcccatcctaattacaatttccattttctagtataattcatgatttctgtatggcaggaggagctccctgacatgtcaccctcagaagctaggctaagcaaaaaggcttgctgtctcttttcagaaacagcaaaggcgtgttcattgtagcatgtaaacattttacactgagtgagttccatttctatccatactcatcacaaatgagcaccacaaaaatactcaaatacatattcacggtgtgcctcccaaatgcgctgtatgaaaaaaatcagagctaagcatgaggcacagatccatttcatttaattagagtttcaaagaagcctgaagaaaaaggtctgtgtctccctaagtgttctgtttctgcatgtgtatagccgtcttgcattgtcaggtagtttgaagagaaaataattccaaatgcaaagcctttaaactctgaatgtttagctcaggtaatagtatcatagaccgacaatgaaagaaaccatctatcccattcctattccaaatcgcataccagtgtccacttttcctttccagtaaatcaatcaatgcttctttatcaatcaacgctgggccctgatttaaggccatgtcaggaaatcctgcactgcttctcagcacatccccttgagtatgctaactccttattttgattctcttctgttttattttacagtcccttttatcatcttttcccagtccaatcattaaactttgtttgctattattcatcttcaaggaccctccctgctgccaggccagactccccatggccccacatccatgctattctttttcttatcttcttatctctactcatgccattcccttgcctgcactgtaccatacctctctccacatagacaaccatttcacatttattccttcctactttcaacacatatttactgagcacctactgtgtaccagatgccacagacaaccttgacaaaacagacagagttccttgccttcatatggtttagattcttggaacaggagagagataaatgaacaatagacctttttttaaaaaattgagtaacttatatagaaattaagatgataagttctggaggtggtcagggagaaaaattagagcagggttagaaggatagggaggtactcttctaagaaagcccactccccagtctgaggtacacagtctacaagacagaagtccatgctggtctaaccatctcacaatatctccatggccacttctgaaacactttataaggcctttttctaaaataaacctgattgcaattgaataggaaaaacaaagtagacatcaaatttgattttcaagtagcgcagcaaactccagtatatacgttgtttcacagaacacctctatgtattcactgtatgccttcctttgataacctatagactctccaagctgtggatccaggaatgctgcctcttttggaaatgcttttggaaatgcttcagattttatttttcacaattaagataggacatttttatgattatgaaagtaatacatgcctgctatagaaaaaaaaaaaccaccaatgtagaaagttataaagaacaaaaattttacataattccaccataagatatccatggttaatattttgatgaacagctttccacaactttttctctacttacacataaaacaaaattatattacacatgctcttttataaccaacttttttcacttaactatatacctgcaaaatattttagaggaaactgatggccattaaaatatttaaaaagacaaggaagaattcagagatcaaggaaagcagaactcacacatgactgtgacaagtggaaaggattcagctaccagtttggaaaaaagtagaagtctgcaaggaacatgtcacctctagtctaagccaaaagccttgctgaataaaaatttaaaaatcaccaagaagacactttgatgagaaaagtaaatttttgttaatcattttggaaagataacaagaaagtggagcactgttgacctttgtatactgctctgtgccctcctccacgaaggctgagtctagacagtgcagcaggtggagacttctctgaaagggactctgtgatatgttgtcattatagtcaatggatgttgaatatcattagagagaaatcaatgtaagagacatcacatcttcaaattacaggcttggtaacacaggaaaaagaaagaccctgggcttcttcaaaaactgaccagaaaacaaaagatgtaagagggtccctagagtgacctgcagcctggtttcccagagaaaaagaatctactgagtgcagcaacatatataattgtacttgctacaacaaaataacctgtaaaaaaatatatatcattctgagtctatggatgtgtgaaaactgtactttagatttagttaggacatgtacagggcctcatggaaatagagatattttttgaagtctcagaaggcatactcatccagcacatatgcacacgttctcaaatacacgtacaataaaatctttcccgttagggtttgaaatgttatcattacaatttctttagcccttcttttctccttctctattgttctggaagttacatgttctattcatattatgttatagttactttataattcttaaaaatatatttatgaagtctcaaaattaatcagtgtcactttgttctatttgaacaacatgagaaccttagaatgttttaattctactcttcctctcgcaattttctacatcgtttttgttcagtattttagttgtatcttgtgtttaaattcccctaaaccagtattattattattattattattattattattattattattattattttgagacagagtcttgctctgtcgcccaggctggagtgcagtggcgcgatctcggctcactgcaagctccgcctcccaggttcacgccattctcctgcctcagcctcctgagtagctgggactacaggtgctccccaccacgcccggctaattatttttttgtttttttagtagagacggggtttcaccgtgttagccaggatggtctcgatctcctgacctcgtgatccgcccgccttggcctcccaaagtactgggattacaggcgtgagccactgcgcacagccaaaaactagtattatttttaactgtgtaagtatttaatattactattacttgccagagacttcacttcttaaactctatttgtttcttctgggtctaattttcttcttgttgaagaaaattatttaattatccttttaattaaaatttatgagtggtaaactctcttcagttattgcatgtctgaaaatatcttctttattcctcctgaactattaatgaactcataaatctgagctgactgtaatttctattcagcacataactctattatcttttgatatctcttgttgcttatgtgaagtcagctgccagtctaatttttagtaatttgtctttcctctctggtgggttttcagatttttatctttgtagtttcactattgagtgtggatttttttaatgcttgtggtttaatgatttccttaaactgaggcagcctttcctcagttctagaaatgttcttattgttatttttatcctcttcctctttcatcattttctctttctggatttcctgttaggactatgttggaatttcttatgctatcctccatgtctctttacttgtctttccaatttaacatctttttatttgtgagcaatatcatgagtgattgcctcatccattttccaattcattaatttcattgtttatagctattctattattcagtccacttattgagtgtttaattaccttaactttatattcgtgtattagtattttccatttttttaaaatctgttcttcttcaaattttcttatttttcttataatttctatatctttctgtatctctttgagcaattaaagttactcattttaaaatctgctgcagcttcttaaaaatcctcacttattgaagtgcaaatattccctctaatatggtgtttccttttatggtttctaatgtttaccctcatcccatgaagtgggttagaagcaggaaggatgaagtgtgttcaatggggatcacatgctgtaggtatgaaaatatcctaacatttgctgctatcaagcattttaattttctccagttctgttataacatttaaattagtttcttgaggtcactgtgcctagtggatgctgtgaattctcacccaacataatcatgtgtcattggcctcatgttataaatatttgcaggtgactgtttccaccaagggcctcaggatactgctttgatgttttccctggtttagattccccagtttctctaatgggaagattttccttactccaggctttatgcaagtagttcatctctaattcttctcaaagaactgtggaacttgggctcatgttcccaagtgggttttgaagctccaagacccagccattatgctaattaaaatttttccttggttttttgcttcaatgcatgctcagcgttctgatcatgttgaagatggagttacttttataatttctaaattttctaaaaatttttaaatgtttgacatattttattcagcattactgtgtctggatctggagaggcttttgtctcagacttccatgtcagccagaactcgcaacatcactgttttagtctttgtgatagtttatcaccctctcctttaaagatacaaaaatgccagagagaggtaaccaataaattagtaaaagacatagtttagattatgttctaccttgacaaactggggctgcctgatggtactgagcatctagacaaagaagaaatgctagaaagagggaagacattatggaaacaagatgctgagaacacacacaccaaaggccaatttgtccaaagctgcagccctgactgtgccctatgtatttatatatagatatagatatagatatagatatacagatgcaaatatagagaaataggtaagatataacaatatataacatgattttttaatttatatataaaatatatccatataaataaggatataggtatttatatataacaatgtttaagtggagagtaaataaaataaatgaacataaaaaagggtaactggagatgatgaaacacagatcaaagataacaagtctaacctttttttggtggtaataaatttcagaccccaaaagaggaagaaaaataatttccttgagaacaaaatcagccaccgtacctctcatcacaatttggatacatgtttccaatgggagtgtccctgaagtataaataatcatggctacagatgttgattaatgtccatcataatagagaatctaaaatacatggtacatatatctacctttctttttgttagaatctaacagatacagtatctatatctacctatccatgtatcgatcatgggtttgagaagaaagaaagggagtaagagaagtgttgctgaacttttcaaatgaaatctacatgcttaaacttgctaatgatgttgacctcaaatgaaagttactaagttctgcatcttatgatctaagaaatacctatctacagctctacttgctcaaagatttctcctcctactggcttctcagagtgcttgaaattttcatcttcctcatgctttaaggactgtagtcctttattaaatgcaaagctgttgcctgtaaatagtaacatacaaaccaccagcacccatgagtggttttgaccagtcaccttcttgaggccttagattcctgagagagccaaaataaataatctcttaggtcccttctctcactaagcgttattctgtagttctgtaattctataatatgatgatctcataggctgatgttttgatagaggattaggagtcaaggtggatcaagagccttaaatgccacttagggaagctggagtggagtggaggggtggttacagccaaggtaggcatagccacagaggcctctggatccaaaacacttccctggtgggaggcagagaagaggataccactgaggaattacactccatggctttgccccttggatgggcatgatgttaatacatacctaaaatgccaattgtccttggtctcttctgtcactggcagagacccttcgaaaatgaaaggcaatgtgaaatcaaataaagcacgtaagaaaaccatgctcatgggagcaagttgcatacaaggacctgtttaggacattgttaacatttctgtccctgtccctctcctgtaattatcagtgatttgccttcagcagcaataaagaacatggtttaacacagccatcccaagttctaaaagagcaatgctttatataaagtataaggcctataaagaccaggcttgatgcttaaagacgttgaaacacgtcgaatgtgacactgggtagccacctgtgtaagcagaggaagcagccccatctgcagcattgcgtgaggggcactgggagggcttgttgccacaaaagagaatgttaaaataaaacacctttgctggcttatccctaatgcccaaattccaccttcaaataccatcttctgtgttaaatgccaccctccttctaacccttccatctatttctccaggggtgagaaatgctaggtctagactaatagctctgggagtccatgtatcaagtcgattatgagtttcatctcaaaaatgggtgtctggaagaaaagaataatggcaaggagaaaagggaatacagaatggggcagggaatcgcagtatcgtcaaagaaaactgtaataacaccagggataataataattctaatcattccaaaaaggtgtttatgtgttaaatgctttacagtttaccaaatgctttcacagacataatttaatctttacattgatcatatgaagtagataagagacagttttttactcactttacacttgagatttggagaactaaagggtcttttccagaccacactactaataagcaagtggaaaactaaaactagatgccagctattgacacctgcatataccactttgctctaaaggtatccacagggccacagtgactccttaatagaggagatttggggaagttaaccacattctttgctgatcagacttttcttaactccttgggacctcggaaggggggtcaggcaatactctgaaaatccaaggcctcatctcaccagctttcatgagctctagctctcatcctctcctgtgttagaactggcttcctcctactcagtcctcaggttaagaataactggggaaggggagaggaagggagtggcaggcagaaagtcaatcactgtaagttctcctacagatattaaacatttgagccctccagactctgggtcttgtttcctcaacacaaatgctccctgatagctggctttgtgtttactttctgcagtgttgcactgtgcctgagagacgtctacaattcagccactacaataattacctcacttcatcttttccttcagtggctgaggacctaaagcccattgatatccagcctgctataaaatcatagtatatgacagatgtgatataaggggctccagaaaggacttaaagctctaaaaatacctccagtccctgcccctttgtgccctgtattcatgacaattctcttattaaagctttgctccctattaaaatgtaatcccctcccctccaaacagactttagtcctcagacactggcacttgggggtaaatgattttttttcttacagcagagactagtatagggaacaggggggaggagggctctcaaaggggcccagggatgcagggtgaaaggctcgccatgcttcccatgatgctgtatgccaggctccagcttgcacacagcccccagtgcaggcagcttggttgcagaccatccgttttcctctcaaatgccctctttccttatctgagctgaaaacagccctcctgcgttggcctcttcatcaactcccctttcagctactacttattctcactttcaaattggtgattttcccccttacttttgcacagcatttaggtgctagaagaaagaaaaaccaaccataactgaacatcctttagaatccatgctcaggttcttcttggcaggttataaactgtttctactataagacatatctttaggttacacaagcagcaagcaatgaaaaaaaatcacactcaactctggggagagatttccaatagttttcacgtttcctcattgtccctgcacatctctagctctctttaagtactttgggcttactcagtcactgaccttgtctaatcatattgattgtcagcaattgcagtctaattggaaagcaagttgctatggtaattcctgtatcttctgtcttacatttaaagacacaatgatcctaaaagggggaaaattgcttgtggttggtgacagaggaaaacataattagatatgcaaattgtgaaactaatgtattcaaatgaattctgaaatctaagtaaggatttgatgtaataaattggtcccagaatttctaccaaaggcacatttggtcagaaggtattctttttctccaaatacttatatttttaggaaaaaataaataaagacaatgtatcatggaagcaggaagggggtggctattcacagctgaaaattggggataggatccataacaccagtatgctgcattgcgtgcttgaaggaacaccagctcaggagatggcagacccagatcctgctcctccttctatctttcactcactgtgtggccttgggtaaatcacctaacttttctgtgccttattattcttcactagcaaacaaaataacagcttttgtgcttttcatttatttcgcccatcagtgatcacttactgggcacctgctattagcaggaaacattgaaagtcagtctctcttgtcactatgtactccaaagagagtacaatttctgttaagttagatgctccttgaaggcagaaactatactctttcaaatatgtatgaagaagaggactgcaaaggaatttgagatttggcaccaaaaatactacagtattgttaattcttgctccctccaactaaataaaaattgagagcctgccaagtgtgatttgaggggcctggtattatggagaatgtgacagttgccacagctccagcactcaggggcctacaaacagaagtgcagctggtgtgacagcctgactatgataaaataccctgataaaggcaaaagcaatgtgatagacaaactcagagaaaggaaaatgtcttaattctggaggattagggaaggcttccttggagaaaactttaaacgttgggccttaaaattggaatggggtttctttcccactccactgctcaggtgggagggtaaagtatatgtttacttgactcaatataaggcaaaggacttcaagccctgaggatgtcacttgttcattcaacacacatttatggagtacctgctgggtgcacagatacaagctatgcatataacaaaatccttgaccctaagggatttatagtcactagactagactctagtagaaaataataacaataattataaatatcattcctttactacttactaagcttcagatacttaacatgtaactatttcataaagaattctcacaaagttttatagaagtaaataccattatccccatttcaaagatgagaaaaccgaggctcagagaggctaaataactttgccagcttcacccagctagtaagtgcttatatggatctacaatgctacctctgctgcctggctgataacctagatacctccttccctggaagtaatagctttcacccattggttctacagctccagcaagaagacccctggaactagagtgcattaatgaaaatgcactcctatcatcacatatcaagaacatcttaacctagatcagttccattattaattagccatgtaattatagcttcttatacctttgttactttacgtgttgaaaaaagggaaagggggcatgtgtaggaaaataaatctaggagatagctgataaaatctcttcctttgctgattactctgaaattctaatttcagggtcattggaaaaacaaaacaaaatttctaaaaggtgtctttctaacaggatccccattacctgaaattattttagtaaaggacaaatgcgtgcttcacaattaaattatacacatcaataggggtacagaggaccccttcagaagctgctaacatgaggaatgagatctggtttctcttctccctccgcacagagccagtaccctccatcctcaataggagccattccactgtttgtgttgctactctctaagtttttatttaaacaaagggtcccaaaggtacagcaaaggcctgaaaatatactgaaccaggttgttgatccccaatatcttgggtggcctaactggctggatcactaacatgaaagactcatgttaaaaaataatccagtcttcttattcctccctagaatgatggcgtttttctctaggcattggtagtctcataaaataggaagcatttaaaaaccatttccttttcctgaccttgcaggtcccttcactgtaaaaacacggacagtctcaggaccaataggagacaaaggaggtgcaggagtagggcttttgcctataatttgggggtagaatgggggataactactgttcaaaaatggatataaaaccagttaaatatggagtcagagaatacagacctgtaaatttctgaattgttgcaaagggcaggatggataacagctttgcatgcagggcactcataagggtgctacattcaaggcttccaagggataaaataagaccatcagtgtgactcaaatacaaaagcagccaaatgtgagctccttgttgctccttcactgtggctcataaaggaagctctttcaagccaagataagatttaaagaggtataaaatggaggggcataaaaaatagagtaattataaattacagagtgaaaacagaggctggaagcaggagaaaagccatttggggaagccatttgttacaggtacggtatcaaaaaggcacaatcgaacccagagagaattattaaggaaggttttggggtgctctgtggtgccagcagtggacaggacagcctccaataacacacacacacacacacacacacacacacacacacacacacacttgctattcctttagcaaagagcctcaagacatatgtcaaggaggaaatcaacactggcttactggcttgtagggggtatcaatggagccctctttaaactgacaataaaacatatgctgtctttaagagaataatggctcaggccagaagtcctttctcacacttgtccagggcttcgagtggtaaatggcccttgctggctaccctgctgctactccctgataggtctgccgcagagccactcccaaagatgcagtgccataagaaggatgcggcatggagccccgcctcaccctagctttttaaaaatgaaagctggctgtcatagaggactgccaaggatgaggctggctgccttttaataacagaatcacagaaataattaaaatcacagaattccagggctagcagggaccctggagatcatttggatcaacagtgttgttttatagatgaggaacaaaggcccagagaaggtaactgatttgactcaagaagagtggttaattagtggcagagtcaggactagaacctaggcctcctgactccagtgaaataataaaaataatagtaagcagcacgacctttgcataacactatgtgcttttatcctagtgcatgacatgcattattcatgtgatcttcaacagcccagccaactacaaaggattgagtataaaatgtactgagggacagaggaccttcacacatcttacagaggaaaatggatctcagaaagctccagtgatttgccaaagtgatgaagggcttcctttggcccactcaagagacctttccaaatgcagctttgcatttctagagcttagagagctgggggttcaaatttcttaaccttaacaccctctcaggctgtgtgtgctaatggatttagtagcccccattgttaaacagttgttctttctagcatgccaagttttgttgttgttttttcacgaaacagttgaaaaagggaataaaacagccaagggcccgtaattcaataaacagcagccacgatgtgtgctcacaagagggaaggcaactcaatcacaggtagtaaatactgtgtcactgaagaagagtagtctccggttaaattaggtcaaatatagatttcgttttgaggaagaatttttggttatttcttttcttcaaattggccaagcaatactaattaatccatcaataaaaatgtacttaacacctactgtatgtatccacttttcaccagatggtagatataaaactcttaccctgccctgatgtgagaagcatttgctgaacaagtgctagcaaccacccagggtactagactcttaaccttagatattagagtaggacagatgacaacaaactccaaaatatcagggactttcagaacaagtttctttctttctcatcgagtggtctgggttggtatttctcagcattttatttaagaccccagggcaaaagcagctttgccatcttcaactgtggccttcaaggttgttctgggcacctccaaccaacagctaaaaaggagacagtgtatggagaagcacaatggtgggtgaaggaccaggcctgaaatagcacacaccacttctgttcaccttccacaggaagagctttcttctcacaatgctacaactaacagtaagattggccaagaaatgtagtccagctatgctcccaggaataagaggagggaaattgatttttgaggacagttagcaatctattccatgccacatatttatctccaatattctcacaaaaaccctaacaggtggataattattcccattaaaataaatgtcatgcatattaattgacttgtccaaggtcacacgactgggcaatgataaggctagaatttgaatctagacctgtctggcttccaggttgatgctgccactcacacatgtgtgtcaaccaagacaaatatgagtcagcagggccctgatgagacaaagccattagtgagattacccatgcagagcatttagcactgtgcctgctacaccgcaaacatctaataaaggttaattattatcattgtcatcattattcctgcagccttgagttacacaactcaaacttacaagtgtctcaaacctatggccactttactgtccctgtcccttgtatgtcaaaggctactccaacctcgcacctcacttttttttgcctctgccaaaagtgtcaggtcacatgaaacccaaacgacctgatcaacatgcctttcctttctcctctacacagcatatccactcccttactacctaccaaactccttgtctttcatcactaggaactcagtaaattcctgcttaagaaagaaattgactaccttttctagcttccaaccctaatctgactctacctccagaaaatctttgtccttccttcactcttttttttttttttttttttttggagaaagagtctcactctgtcatccaggctggagtgcagccgcacaatctcagctcactgcaacctccgcctcctgggctcaagtgattctaatgcctcagcctctcgagcagctcagactataggcatgtgccaccaaacctgtctagtttttgtatttttagtagagatggtgttttgccatgttggccaggttggtctgaaactcctgacatcaagtgatcggcccacctcggcctcccaaagtgctgggattataggcgtgagccactgcgcccggcccttccttcacattttctcatcttctttcaattccatttgctttcccaaataattatcctatgcatggctcccaagcacaaagactagctgcaccactgtgtccaggtagggatagactcataggctaccagcttccacttcactattttctctactcatcccttcattcttagtcttgcatattatatacataaacttaaatctctcccaaatattaagtaaataattggtacactttattcatttgaaaacagatgacctatgaccaacatcaaaccactccggagtcaccacacggctgttaagaactattggtggtggaaattgcaaagctgacaatgatggtgggaaataaagggaggtttgcaagaaatacagaagagagtaattgagagaatttaagatctgtttggacaaaaatggtggagagaagttggagatggcagcagaattaaaaacttaggttagtccagtgggccagtagggatgtcagacagagccgttggcaggggtcgtgactagggaggggaagagagtttggagaggaaaagaatctagctgctctagactgattgtctgtgatgggttcacaaaacatgtatccctcaggttgttacagacaagggatgctggtctcagagggcacctcatttgcctcatcagcagattcatcagcagagaggtcctaactgagggaatgaggtgacctcagggggtcaacaggaaaagcttgagggacaccaagacagggattaagaaatggtgacatttagagagtgtgttggggtaaatatggtgtacagggaaaaataataaaatgtattgaagccccactgtttactcggctgtgttgggcaccgggcatccttcccacactgtcctccacttctgttgactctgcactcgcaacttttcatgcgtatgcctaacctgccgatgtttgcaagataagggcagtaatatttaccatcttatatgctttatacttgcacagaaaatgtactaaaaggtgcttattatatgagttgctgcttggaactttgacttatgtgtgctgttggggaaattactgaacttctgtgtgccaccctcttctgtaaaaggggctaaggatggcacttagctgacaaggttgttgtgaggattaagcaacctaataaatgtgaagcagagaaaagttgcctgacacgtaagtgcttaataaacgttagctattatgactgtgatttttagtccctttgctcatctactgagggaaacaagggaaatatattatgtcaaattttagattacttaaggtttaaattaaggtaaacctaaaaatgaacacaatcgtttgttgttgatgtatttgaaaccaagtgcatttaattcaaattactgaattaggctgagccactgaaggtacttttatctctgtctcattttggggatatctgtaggatgactctagcaaagacttatcttgcccatgagaaggaagcagatctgggaagacaagaccatctcaggcatgtcaggaaaggatagcaccactggctgtcatctgaggaggtaaaaggagccttgtggcaacatcctcaccacaccctgacatgtcccaccttgaattgagcctctcctaaagggaaaagcatgctttttaggttatgatttcagtggtggagacaatccatgttgaggcacatacatgctctacctaatctcctttatgcggtcagcagaccagatagccaatctcactataggatttaggaaggggcttgggttcggaataataacatagcctggtttaagtatttaaatgattctataggtgaggttaagggaataacctgaatttctctaggacctttgccagtagagttttccctcagcacagtggttgactgtcacaaggtctcccagctgcagatgaatttagtcccagactccacaaagagagttttatgaaattttctggaacatattttcatgggaattttcacctgccttcttatacatgacatatatatattacacatattataattatattatatgcatattacacttcaatatcacaaggtatacaacatatgtcacatatataatatgaattactatatgcacatactctatcttgttgtattgaaaagcaatataccaaaagtttattttttctagtaactaaaatgtgccccatcaaatacagatagcaccagttaaggaaagcctagaatactactctcactgagttagagatgattgatgaaccaaggatccattttattcatctttagattcccagcactgatcccagtgcctgaaacacagaagctccttaatcaaaattcgttgaacatttgttgaattagttctccactcgcttaaagattcactccaagttttctgctaagaagcttccctcctgtgcgaatacacaatttgatttgcaaatactctgtttactgcaagttttcaggaacacggttttattgtacaaaagcaaaggtggaaaatcttttataatctttcaaagataattcattcattcagcaaacatttgactgggagcaggaatattaagataaagggcaatgtcactgtcctccagcagttcttagcctagtgagggaaacaaagcagaatgcaaacccaatgcaatatgcaaggggcagtaacagagggtctatggaaatcctcaaccactggggactcagggaaggaaaacagtcaactgaatttagtttgagcttattaacaacaaaagaaaaatttgattcagtgactattacaaatattttaatgcagttgagtctcttaatttactgagttagggagaaatattttggatatattggagaaaaatgctctgtgaagagaaaggcaggggaggagggacaagatgggaaagacccagagggggactttatctcctctatcagaaagaaagtgaaaaagaagtttctgtttttgatttcttattcttttatttttattgtttattttattcatttcagggatatattatttactcaccaaaatctggagtttaggcacagtctcggctcactgcaaactcctcccaggttcaagtgattctcctgcctcaacctcctgagtagctgggagcacaggcatgcaccaccacgcatgactaattttgtatttttagtagaggtcaggcttcaccatgttgctcaggctggtctcaaactcctgacctcaggtgatccacccatctcagcctccaaaagtactgggattacaggcataagccactgtacccggcccttatttttttttttaattttactttaaattctgggatacatgatgtgcagaacgtgcaagtttattacataggtatacatgtgccattctgttctccaattcatgtcatcgaaatcctagtgaggcctttaactactggtcacagctcttcagttctttgtatccaataagtcagtaacaactctactcggaataaaacagttcggcacttgtcaaatgagtatcagttataatggtgaacaaattaatatgactctgtaagaggttgaaatttcatgctggagcagaccaaattctgtatgcttattcgctccctaaagtcctcaatattggaaaacaccctaccccaaccctccatcaaatgtacttgtatatttgaaggaaaggaatttcataatggctctgaaacccacaccagagagaatgccttgataacccccagtacctcatggaagcacatgtccctatccttcatacaaacatggaatctcatgtacagaaggggccttaaaagtcatcttccctaatccccagtcagacactcagtgaacccttatagtcacccgtcctctctcctgttttattttctatgggtgttttgtcaattcaaggacctcaactgatagccagagaaggcctagggagagagctgtgacccagagaggcacggataaaggtatccagatactatctggtcagcagaccaaatatttttgtgtgtcacttgcatgttatactctgtattagtaaaattccctggaacaaaatcctaagtcatagacaagctaggctgggctgtcacctgctggacttagacatgttgcctgcagaaaagggggtgaaagaatgccacaaacttcatctccttcagtttagtgatgatattcataggcctgaagatttcttttccttagtctaccctttgatccattcattcatccagtaatcatttattgggcactaactacatatcaaattatcactagatgctagagatacaaaaacagatgaattagacaatgaccaaaaaaaagcaacgacaaaacatggttgtgattgcttcagctgagaaatgaaaaagatcttgtgagaagctagacaataggaaaacttcagtgctggtagagtaaaggagggcttttcagagggaatgcagatttttctaaaccaactacttcattctcctggagctcctctatcacactctgcatatccacctatgaatatgtacattgggtcaaaaagtctggtagcatattattactatttccctaaagaaccttgcagtacaaagtatgaccagcacctgggctattagaaatgcaggacctcaggccccagtcaagaccttcccaatgagaatctgcattctaaaaagatctctaggtggttctcatgtgtgttagcatttgagaagcgctgtcctagaagatgaggaaaggagagactcatctctgaaaattgtcttctgcagagcttctgtgcttgaggatgaaggcaccttgcactgttctggaaaagacttgacaaatgatctcatcgtatccccttattttgcaacaaagaatccaaggcccagaggggtgctcaatatggcacgggaggcagggagggtagaagaaagtgtgtgagcccttctgtcagccacagttggttcctcatacaggtgggaccatttattaatgtggagaccaaaataccaacctcacaagcatgtcaaaaggattacagagtatgtaggtaaagtggctgataaacggtaaacacccaataaattataatagtaataactagagacagaattgggttagatcggaataagatgtctaaatttctcattgaaggacttttccatgactgtaccctgttcacctgcccccaaccctcgtctggccaaaggcatccccctacccaaccctaacacctggtactgtctttgaagttgagaccgtcaaatacggactactttctgaaatcactaatttagaagtgtttctttactttgttctaataatttctagttccttttgaaaaacaaatccagttaagggaattctcaatatgtgaacttcggcaaggacatatgtctctacgagtggtgaccaaatgtactgctaactgctagtgaacctggaaatagcttttagaggagatggccttatttgcatttgagcccttcctgttagctagccttttcctgcatgccttattctctacctgtgccattctttcactctactgcattcaaatgaaggctttcttcttccatccctttccccctccttctcaattctgtacctctcagaactccctgtacttacaggataaagaatgagataataaacggccaatagccagcatggtgttcattctctctctctctctctctctctctctctctctctatatatatatatatatatatatagagagagagagagagagagagagagagagagaaacacataccccacccttatttatgttcaactgtgcaaatggtgaggactttaatttaccaaataaatcatgaaagatgttattatggaataagaggagctcttctcacataatgtctcctcattcatgggggcttctgagaaatggccctgccaccactgggttaacaagccacagatgtcaccagccccctggtcacagatgcaccagtcacagatgcaccagcagactgctgctgctcacagtcacacttcccctcccccaggggccttcttttttccctcccctccaggcctttctcttgatcaagagcctttctagaactcttccgctaaatcctaggccagcagacagcacttctaccccagccagtttgaatgcatgctgcctgtgagatttcctgagacactcagctgccgcattaaaactgcataagagtcttcctcaggaggcctaataatagcacatttcatctgtgagacactttataaatattaactgattaagctgccctctctcctcacaacctctgggcttctgcctagtggacttcattctcttctgccctcaaattactctgggagaaaaaaacgctgagacctgaggaatcttttctgtgtattctaggccaagacatcattaatggcaatggccttgcaacaacctccacctagttaatggcatggagtggaaagggatttaaatatatgttttattttattatttttcttaatttttaagttccagggtacatgtgcaggatgtgcaggtttgttaaataggtaaatgtgtgtcatggtggtttgctgcacctatcaacccatcacctaggtattaagcccagcatgcattagctatttttcctaatgctctccctccctcaatcctaccccctgacaggccccagtgtgtgttgttcccctccctgtgttcatgtgttctcattgtttagctcccacttataagtgagaatatgcggtgtttggctttctgttcctacgttagacattaatggggccaacaaacatatgtgtattttaaaagagactggattgaagttctcatctctcaaagccagattagcagagagaaaacaactccacgatctaggacagtgtcactgaactacagccaatggatcaaatccagcctgacacctgtttttatgaataaagttttattggaacacaggctaattcattcatgtgttacctttggttacatttgggctacaatgtcaattgggcagttgtgatagagaccaaataccacagcaagggcaaaaaagtatttactatctagccctgtaaaaaaaaaaaaaaaatgtttactgacccgtggtctagggaacttaaattttgttctcatcctgtatattccctaaatatctttaagcaaatctcttccttcctggacctcactttctacaactatagactggataatctccaaggtgagccacagccttcgacttattctcctcttgttcggtaagtgttagcctctagtatgttagttttgccttattactacagctgacttctttaatggcaggaaaggagttttgtgtgtcttgtgaatcctcccagacacaaggctctatgctgagccctaaaaatattcaaggagtgtaactgaactggcttgacttatatatttttttctccacagagagatctctcagaatgatgtcttggaggtgatagaggcagatgtgttctccaaccttcccaaattacatgaaatgtaagcaagaagattgggggatttgctcatggccattcttgaaaaaacccttaaagttcttctacattcctgggaggccctgattctgccatggcctcagatccctagattgtcattataagatgtcaaaatcagcctaaaaggcactgtaatgtgtctctatctggtgacccagggaccagctcagagcctagtctcatcctgttgcctgcctgtcatcattttttgcatcatagacccaagaactttgcccagtgactatgtgcaagcacctctgtgtcatccttccattcagagttattccagtcaaagcccaaaataagtcccacatgatgtagttgaagttgattagtcctggtctgactactggcctatgccatatattcaccatgaaaccttggccaagatagataactatctgagactcagttttctcatctgtaaaactggaataataaaattacatatgtcataggattaccctgatgaataaagaagataaatgtcaattaaatctagcatactgactggcctagagtgtgtatgttataatgatccttggttcctctactactccagccaaatttactttctcttgttgatgttccagttttacataatagcgctgctcacacagatccacttctgtttcataccagtttattattactataaattatttcatagaatcatagaatgtcaaagccagaagagactttagagactggtcaacaatttttcaaagtatattctgtgtatcactaaaaactcagggaattataaggtatttttaaaaaggaaaagatttatggtcaaataagattaggaaatattaggtaaataaaattagataggtttgcttcttataggaaaacttttcagagtctataatatgctaatatgcatttagaatctccaagaaggatattgtgtgtttgtcaactaatgtcactggaaagttttctttagagattggtgattaccatctcacaaaatccccatggaacacatttaagaaagccaatgaactacctcctaattttacagatgaagaaggaaaggcacagagaagttgtaaggcttatctaaggtcatctgtccaaatccacacacaaataagaacttgaacattaatcttttgactcttttgtatctttttaacaaggatgaatttatttttatcatttgccaaatatcagtagggaacagatacacacacacacaaatagacacacaggtgtgtgtgtgtgtgcatgcgcgtgtgtgtgaatttctttagtctgctcatttggcaatctcccctctcccttttacttccttctacccactctgcctcctaccttcatttttcctcgttgcctctgcactctgcaagtgatgttcaccctccctctccccattactttcatgcttcttcctttcttctctttccacttggtctagttgggaagaacccacagacattatcagagaaatgaaccaaagggcagccagccctctgggcaaggtcaagcaggcatcccttgaaacatttcaatggacagtgaaggtagtggtttgggtctttcatctcttccttgcataaagaggtgctcacctccatgtagcactgactgtacttaaaatgattaattgcctggtacttagatctgggtagctacagtttacagcaacataaaagctaatgaaacagggaggaagtaactaacagagagcatgtctacaaatacacattgatccagcaagacaaggaaagggcaggctgtctgtgttggaatccaaatgtgaacatgctcacttccagactgttgatcaagacacagcacaagccaaaatagggcagaagtcacccctttccatgagctctgagtgagcagcctcagtctactgcataaagggaatcaatggccattcccagctactgtatgcttggatttcatgcttaaaagcaaaaagatatcgattgtttttctcccaactttctttttctttgccatttcactctcttttcctccaatacctttttgcccctcactttttccttccttatcttcttttcacctcttttccatttttcattgctctttttcattactttcattcctttttctcttgcctcccgaccagacaaacactcatttcgccatattagtctcattcctaacctcttagcctcctccaaccctgggcgattcttactggttaaagatgcagctctgctcagggtgacaagaacccacccagccaatgctctgtttgcctccagcggacagggcccaggtaatgagaatgaaacagcagggagacagggttaatatttagtttgcacagcttagtgtgataaaaggcactgcatgctccctcaatatttattgaaatgatggatggatggatggatggatgaatagatgggtggatgagtggatgggatgaatgatttattatgtactctgtaaaatgtgaaaaatactacagcattccttaccatcaagatcactagcatgttttttcttcttttacagtagaattgaaaaggccaacaacctgctctacatcaaccctgaggccttccagaaccttcccaaccttcaatatctgtaagaactcatgtagtttggtacccccactatgattaaatagtgcaagcctattttactaaaaggcctacttgatactctggggagcaattacttttgatcaaggatggtggtggggggcagaagtggaggtggagagatacttggtgatggattttagtttaatgagcaaattctactaacataattgtatcttgttttcatttgcaaaaacagacataagaaatgccatttgcattaatgggacggtcacatggacctcgtacagaactcagtcataatttagtgttaatgagatacagccaaaatttctgctagcatttagcttgtgaccttgacttcaaagccattgtctctcttattctgcatatatgcatttttcccttgataaatatcagcattttattttgtttattttgtatgttttcgttaataacacacatggtattttatcagcagagattcctagtgtttcagctgcattctttgggcctgcccctatcagcaaaagcactgcttcctctactcaaatggctttcggattagctgagggcttgacagagccatgagtgttataatgggaccccacaaaataacagttaagaatttggtcgctggagttaaactttctgggttcatttaccagctactgatcataggtatggacttaacctcgcatattgtttcatcaagagaatggaaataataatccttgaatatctgttatctattagcatcataatcatgcataaccaaccaaccactacacaaagatagaggcttaaagcaacaactacttgtcattttttacctctctgtgagttgatcagtggaatggttctgctgatctggactaggtctgcctgacctcagctaagttcatttatacatctattgttaattggcagatcaactggatgttggccactctggatggcctcaattgggatgactcagccctcctctaagaggcactcatttctagcagggtagcatagtaggcttgttttcatggtaatcccagggttctaagagagacagctgaagactgcaagcatcttaaggccaagatcctgaactagcacactatctcttctgatgcattctattaaccaaaacaattcactgaatcatccagattcaaaaggtgaagatgctacttcttgatgggaaaagctgcaaagtcacaacacaaggcatagggaaggatacagaattgaagccattttttgaagccacttttgaaatcagtttaaagtatttaaacatttttgtactacgcctctgatagtagatgctcagtaaatattagctattaatgatattacgattctgtgcctaaattttcattcataagaactggacttaacaggtataataagaaacactgggccatcatgtgccttagctctctgaatgagaactgaggtaataaaagacttaataggagacaattcatatgacctggaacttctgctctctgacagctaccccagaaagggtctgaaaaagaaacaaagtcatctgcttctaagttactgtcagaggtaggctggcttcatgggcacacaagtgcagttgtatagggctttgtgctcaggagggcccccgcactcagaggactgctgggtttcattctctgctgttaccttcttgaaatgcttaaacaagaggctctgcatttttatttacacagcatcccacaaattacgtagccagtcctgcttagaggttagggttatgagctcttctactttcaggcttaggagtcttgatctctaagttcatcatgttccttagggatggaatctttgctatgctctctgcagaggctaacatgcctaggcacataacagtagaggaaatacgtgacaacagaaaaagcatgcacctcagaatcagaaagtctaggtcttcatcctgactccatcattcaatagttgagaaatcttgggccaatcaccggacttctgagagacgcacatggcttatatgaacctcaaacaagatttagatatgaaaatattttgtcaaatacgaagtgctcaaaaacattaataaatgtatttgtagaataattatttctggtcaaatactcaaggtctaccagcccatcctcaggaaaattctagtaagttgttgaataattatgctgccgattaagaccttcagcttttacctacaaatgcttggcaagggttcaaaaagaggaagttggagcatgcctttgcatttaaatgaacagaatggaaaagaaactatatatgaaaaactatgaattcagaaggactggaatccaaatagaacattgatatttattagctagctggttaattactttccctaaacctcagtttgcttatctatagagcggctgtaaaaaccaaataagattatgcctttaataaaaaaacactttgcaaattgtttttatataaaaactataaagaactatagaaatataaaattattagtgcctgttacccagttagtttccttcattctttcttcctttctcccaactctatctctcccttccagatccttctcttcttttgttttggagaatgccaaagtggaaaatggggatcatagagccttcagtgacagaacaaatgctctctaggacatgaagaggcatccccagagacactttcattcataaactatcacatatggctaatgcaaagcactcctgccaaggacaaacccaagaagaaaaccagctcttcacatagatatccctagcccatgataataatagcatatctgaaaatgcggattggaaacaggtaaatgagaaatgaggaatcattgcaaaatttgaaaccaagggattcagaatttgacctcatcattgacccacatcttgcagccagcaccatttgttcttatgaatgaggacccccttggcccttcccttaggagatgagggcaggggagatacttgaacttgtaaggatgtgggcatggaaagcacagctccagacagaggaagggagagagggagaacagaggaaacagagctatgcctttgcctctgaaaaaggctgaaatctgtgccacctgccactaagtccatcctcctctttgtgtctttctgtctcactttggggtgttgagtagtcctcagtcctgtatcaagttcacaaaaagctggaggtgaccaattccagacacatctttttctgagagaagattattgttctcagggcattttaaacctgctttctaaggaaagaaaagcacaagaaaggatttagaagggattatgtcactgtcgagggattctccttgattgctctgaaaaatagcatatcattttcttagtcagtttgggctgctctaacagactactgtagcttgtgtagcttaaacaataaacatttgtttctcatggtcctgggggctagaagcccaagatcaggatgccagctggccagttcttggtaagggccctcttcctgggttacagacagccatcttcccattgcatccttacaatgtatatgcacatggccttaccttggtgcatatacacagagagaaagagagatcccatgtctcttcctctttttgtaagggcattcatcctattgtgagggtcttgccctgatgatcttatctaactctaatcaccttccagaggctctacccttaaatatcatcacattgagggttaggttccaacatataaatttggggaggacacaaacgttcaattcattgcagttatataattctacactatacaaaatgtttgcacatccactgctatgtagatttcccattagggagttgagaccaagagttgtctatcttaaggctttgacttactgcccagggtggacctttcccagctatgtactcctcctcagtgtatggcaactctgccctccaaaggcacttctacctgcaataaataaataaaccatatatatatttatttatatatatatttttatatatatttatatatatatatatttatatatatatatatttatttatatatatatatatatttatatatatattcagggctaagactctagctctttgaaatattttccaaactgctaagagggatcacctaaactcataggtggccctctaaatctgaaagattttgtcagggaaacaaaacctaattaagcttccacctcacactagttagcttgggctaccataacaaaataccatacgctaagtaaattaaacaacagaaatttatttctgacagttctagaggctgggaagtccaagaggtactggccaatttggttcctggcttgcagacagctgccttctccctgtgtcctcaaatagtaccaagagtgagagtgagaaagtgggggtggggggggaagatagagaaagagagagagagggagagagaggtggagagaaaggagaaagagagacttgagtgagcaagaatgagtttctggtgtcttatcttatataatggcaataatcctaacaggtttagggccctacacttatgacctcatttaaccttaattacctaccagaagttctatttccaaatacagttacagtggggattagagttttaacaattgagttttgagaggacacagttcagtccatagcatatcttccatgcttattttcatctgagcaggagtcctaacagcttcatgctccagcagccaggtagaggtagatggcaacgatttcagatattctttgggatgatgaactacttgcttcaagagaaaaaacgcaaaatggatgaaggaattcagtggggaccagtaggattgagttgttggttttgtttcattttgtttttttcttaagccaggataaatgttaatcatcacagccactgaagcaggagattacaaggggtaggggtgagttgctacttgacttgaatgtcctaatttctgcatacgggtacttaaaaatgttgttctgaagctctccctgttgatgccatctcatgctgctcatttgatggcacagaattcaagacaactagaaatcagtgctcttcatcaatgccttcatgcttcactgaggaaccttaagtggttaggaaaaaaaaactcatgaataaagaagtgttcttaacttgaagaatatgcatcaaaggattcatctgggtggatttttttaagtcaatattgtatttacaggcaatatttctttctttactgctctgccttcctggagctgaccttttgtgtatgaaagattgtctattgatctgtaaataaggtttacacaatattttcttgcctttgcatcctgttaaagtaattctcaggcagctggatgtttctctttgctgctcaataaaccataattccattttagcaaacctttcacacagtgctgtaagccccacccccatgccccactgacaaccatcttccactcagatgtgggcctgttagacctccttatgatgcctgttaatggctgccatgacatgtgctttcttcaggtgggaacaattccaggagattcttcactgggactcccctcagcaatccaggctgtttctttcccaaccctcagctaagtccctctctctcttttctgtgtttgtcccttaaatttaatttggtaggagtattaaaagtagcttttctggttataaaagctgaactgcttttggaggtagcacggcaaggggacagagggtagggagtcaagaggcagctcagagtagcaaggaagcacaaagaatccagtggcacctgtctgggcacaggtctcagctgcttcccttatttgctgcataagcttgtataatcggcttaactttgctttctgaaaagtaggaaccttaacattgcctgcatcaccgagttgtgttcatcgagttaaaacaaatgtttagacaaatgatcgacatttagaaaattcaaggatacccaggaattgaactcagctctgcaccaagcggacctaatagacatctacagaactctccaccccaaatcaacagaatatatatttttttcagcaccacaccacacctattccaaaactgaccacatacttggaagtcaagctctcctcaacaaatgtaaaagaacagaaattataacaaactatctctcagaccacattgcaatcaaactagaactcaggattaagaatctcactcaaaaccactcaactacatggaaactgaacaacctgctcctgaatgactagtgggtacataatgaaatgaaggcagaaataaatatgttctttgaaaccaacgagaacaaagacacaacataccagaatctgtgggacgcattcaaagcagtgtgtagagggaaatttatagcactaaatgcccacaagagaaagcaggaaagatccaaaattgacaccctaacatcaaaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaagaaaagagagaagaatccaatagatgcaataaaaaatgataaaggggatatcaccaccgatcccacagaaatacaaactaccatgagagaatactacaaacacctctacgcaaataaactagaaaatctagaagaaatggataaattccttgacacatacattcttccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagaaggaatcctccctaactcattttatgaggccagcatcattctgataccaaagccgggcagagacacaacaaaaaaagagaattttagaccaatatccctgatgaacattgatgcaaaaatcttcaataaaatactggcaaactgaatccagcaacacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccggtcctattcaacatagtgttggaagttctggccagggcaattaagcaggagaaggaaataaagggtattcaattaggaaaagaggaagtcaaattgtccctgtttgcagacgacatgattgtatatctagaaaaccccattgtctcaggccaaaatctccttaagctgataagcaacttcagcaaagtctcaggatacaaaatcaacgtacaaaaatcacaagcattcttatacaccagcaacagacaaacagagagccaaatcatgagtgaactcccattcacaattgcttcaaagagaataaaatacctaggaatccaacttacaagggacgtgaaggacctcttcaaggagaactacaaaccactgctcaaggaaataaaagaggatacaaacaaatggaagaacattccatgctcatgggcaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacggcatggtactcgtaccaaaacagagatatagatcaatggaacagaacagagccctcagaaataacgctgcatatctacaactatctgatctttgacaagcctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacttggcattaccattcaggacataggcatgggcaaggacttcatgtctaaaacaccaaaagcaatggcaacaaaagccaaaattgacaaatgggatctaattaaagtaaggagcttctgcacagcaaaagaaactaccatcagagggaacaggcaacctacaaagtgggagaaaattttcgcaacctacttatctgacaaagggctagtatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaagggactataaatcatgctgctattaagacacatgcacacgtatgtttattgcggcattattcacaatagcaaagacttggaacaaacccaaatgtccaacaatgatagactggattaagaaaatgtggcacatatacaccatggaatgctatgcagccataaaaaatgatgagttcatgtcctttgtagggacatgtatgaaattggaaaccatcattctcagtaaactatcgcaagaacaaaaaaccaaacaccgcatattctcactcataggtgggaattgaacaatgagatcacatggacacaggaaggggaatatcacactctggggactgttgtggggtgggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaataaaaaataaaaaaaatttaaaaaaaagaaaattcaaaacaaatgttatccattcttattaaattcctgaccctgccatttactagttaagggtgcccatgcaagagacttcatctctttgtacctcagctctctcctctgcttaaaaaaaaggaaaagataaaattataataattcctacattttaagaccagtgtaggattaaatgagatactgattgtaaagcttctggtatattatccattcacaataaatgtttctgatttgatgatgatcatgatgatggtggtgacagtagtgatggggtctcttttcctttccgttattcctaatgttttgaaggcctctgtaactgcttctttaggacatctactactcagcattctatcatggaaatacatcattcatgtttctcaaaagacaaaaggagccttcttacagaacccctgacatatccaaaaaagtccttccaacaagcaaaactacattatcctgcacaattctaaaagttctcaaccctgccttttatgtttattttcaacactagtggtccacaagctcccttgccatccctattcaaaataattccagttttttacacaaacagctggttgaataatgcttcccatttttatgtttatttataatttaacacttatcatcctttgttgcatttgaacctcaacaatccacacagtaggagggacacacagccattttacaggagatgtaagctgacttgtctatagtacttggttatagggctcttctgacaggaggatgcaatgtccctacacaatgaatcattcttatacttttcgtgcttagctatgtttacttctctatgatggtgggaaaagagccatacttgggctcatttttagaagttatggtagccatgtgcatggtggaaaggcctggtggctccccatttctcctccatcctttttgaagtgaattggccaatcagtaagaactcattcactcagccaatcattcaacaatcaattactgaggtcatagtacactccaggctttgttgtagctattagtctctccaactaaaatgtaagctctataagggcagaggcttcatttgtcctgtcaaacaatgttggataatgtcaggtggtgatggtgctatgaagaaaaataaagtagtaaaagtagagagtcgtgctttagaaagcgtggttgagaaaggatggaagggatggcttgtgtgagatataggagatatcgatggacagctctcacttcaaggagctcagtcctttggggagaaaagtctatcaaacgttaacccctggaaatagcaatacctctgtagagctgtgtggcactgatcctgagtgagaagactgaccctgtgcctcaggccagactagtcagggaaagcttgttgtgggcttcttggaggtaacatagctggaacttgagtgataaatatgatttggagagacataaaagaagaataaatttcctgggaaagaaagaagtgagtactgtaaatgaatagaatgaaataaccacggaaatgataaaggatgtaaagaaactgagtcccaactaaaaagaaggtgtgtactgagaaagagtatgactagatttggatggatagggttgggtaagattgggagaaaaattaaggcagagaagtttaagcctaacgcagtaggaaaaaataagttataacatattcttgagcagcagagtgacataatgagaatgacttggactgtaagttgaccagtagcagggtacagactatacaatagggaaacctgttaagggtcatgtattagtcaggattttttagagggacataactaataggttagatgtatacataaaggggagtttatttagtagtattaactcacacaatcacaaggtcccacaacaggccatctgcaagctgaggagcaaggaagccagtctgagtcccaaatctgaagaacttggagtctaatgttcaaggacaggaagtatccagcctgagagaaagatgtaggctgagaggctaagccagtctaatcttttcacgttttttctgcctgctttatagtctggccatgctggcagctgattagatggtacccactcagattaagggtgggtctgcctttcccagcccactgactcaaatgttcatctcctttggtaacaccctttcaaacacacccaagatcagtactttgcatccttcaatccattcaagttggcactcaatattaaccatcacagggcagttgccataatccagggatacagtaatggtggtgcttagagggatagaaaggcatggttcaatagggacacatttctaaaacagaatcactggaatatgtttcatctctgggtcagacatccatctaagtggttgcagtgatttgtttttttgcacactcactttcagtaacccctaaaaccctctcttcccccagtacctcctcctaagcacttcccacacagagtcatcttgcagatatcactcatcgagaatccagacatcttatgcaggactatcattatagtgaagaaattattagccatctcctggctgtcagtgttgcaaggatctaaggatgttgccatgactacaaggatgtttgggcacaatcgagatttacaattgctttttttatcagtaatctgcctggcagagccaactttgcctaccatcttcaaatctaggaaaatgtggccagcttttccttccagaacactgatgttgaaggtgagatttcagcccaagccggtcatctccagggaggcaaggaccacctcttgattgtaaaggtggtgacattttcatgctgcttacctttcctccctgttctcccctaacctgttcagtatgcgttctcctgaaagaagcccaagtccttcccatcagcaaagagatcacttgatccatcaatttatatcaacatattcagactctgatattctcctttcaaggagaatttgcatttttgaaagaggaacctgaaaaaggtaatgctaaactcaagagttggtagtgatggactccatgacgggggatttctaagagggagagaaaatttctacaggacccactcaaatagcacataggtgaccatctactctacccatttgcagattcggtgcaattttattttcataggatatgccttcttacaaggtagttgtatccttacctcattaattttgaaataagacctgtctgtctttcatcaccagaaatcagatataaggacaagtctagagaggactgggtgaaaagcaagtctcagattagcctagtaaagcttagctctgatttttttcttattgctatatcatcctcatcagacactcccatcagccagtgatgtactaatctcttcaggtctcagtttcttcatctgcaaactgaaaataacaaaatatgcttcaagaggctagtcaaatgaggaaaatagaaaatcctctaagatctactctagccctgaagtgcttggtttctgaactgtgatcttcatgaatctggggctcccagtgtcactgcctgtcctgagttcatcatattcaggccccacacgaggggccctgtatggaaagaggaagtgattctgcaagataagaacatttggcatcttgcagaccacttcacttcccagctcctcttccccaggattcaaatgctgagatcttgcagaagcagtgagaagcttaaatcagctgtaaattactcataaattaagcacagctaaagtgcagctcctagagctaaaggacagtcatagatgtattcctgccaccccagtccctgacaaatgagaacaaccacctcagcagagcctgagaggcactggatgtggaaatgatatttaagaggcagaaagcacccagcagccattagagctggcctgggaaggagaaatccttggcagggcctgcctggggcacagacagaatgacagtgtggacagtggaaactgaagagacattaggcaaataccccacctccatggaaaataaactgttgcctcttattccactactaaagcctcatattgggaggtttaaaaggtatctttgtccttagagacccttttagatttgcaattatccctgggacaggccacacattgagagctacccatctccatggggatgggccagaggaggcagggcagggcagtgggcagcaagggtagtcaggacatggagagaagggagagtgtcactcaagtgacagattctgcactactccaaggggtgggggtgggggaccaggttttctccatcactatatccccagtgcagggagggaggattattcattttttcttttatagaaacctggctgtgatccagatgcttgcacctggtcctcgccccactctgaaatacttgctgagagagacccactttttccctgcttccatctatttgttcatctcttctactttatctttcataacgtgtattcttaggcgataagatcctggtacaggaatattctagctgaattgtcccagctgcccccaaactcttgatttatccttctgggaaggacgttgtcttccccaagggcaagtctgcaggaggaatgcatccagggactcacaagtcagccagatcaggacggggaaaccacaaagtagctggagatttccccactagattccactgacatccaatccagagcaagggctgtgtccagtttatctctaggtccccacagaatacagggtctgcacacagtggcccttcatgagaatgtgggccggagtggttggaacctttttgtttgggtagagaggggagcagctgctgtttttagagaaatatcttggggcatcacagagtgtgaacactgaagtgaaaaatgctccacaaaagaatattttcatcttcaacagacatcgcaaaaatgttctgctgtggtttaatcacgagctcacccacagaaaacaatccacaaataacatctagttcaagaggcagtgagcttttccctcacccatttggaattcaaagatagcagtgctaagaagagaaagcctggcatgcttgaaggacttgcaagggaagcagctaggcaacctccctcacaatgatcatccatcatggtctctctggacaatgaccaaaccacaggagccacatagacacagattcacttagcaagacatcagggataagctcttttctttacaggagatccaaagacccaggttccagccctggccctgcctgtgagaacttgtaagcaagtaacagggcctcccggggtgatatggtctggctctgtgtccccacccaaatatcatcctgatttgtaatccaaattgtaatccccacatgttggggagggacttcatgggaggtagttgaatcatgggggctgctacccccatgctgttcttctgacaatcagcgagttctcacaatatctgatggtattataacgggcttttcccctttgctcggcacttcttcttgctgccaccatgtgaagaaggcatgtttgctccccctttctccatgactataaatttcctgaggcctccccagccctgaggaactgcgtgtcaattaaacctctctcttttataagttacccaatctcaggcatttcttcatagcagcatgagaagggactaatacactgggcctcaaggaaaatggagaaaaaaatagctgcctcatttcttaacaaaaggttattgtaaagagagaagaggaaggaaggggcaagatgaaactgggtgtgggaacattttgaaagttaaaagcaatgaagaaatgcaagcactggtagttgtattaaggtattgctgggtgatacgggcatgagtaacagaaatcataatgcagaaagctcttttactttgtattaattaactagtcttacaaaagacctgtaaaatatttactggtggatccattttacagaccagaagcttgaggttcagaaatgctaactgaattccccaaacttacaaaatgggattatgaaattatactggggaagaaggcccagggacactgagcttactgagcatctactagatggcagattctgaactaagcattctgttcacccaagttaccttccaatcttctaaaacagtgaggtatgcatttttcccaatctacagatgaggtctttgaaactcagagattacatagttgatataattaagaactgaagccaggaatgtcagactccaacccagttcatcctgcattccaacacagcacagctagagagatttagaatgtggatgaagccaacatcaatgtgcccagtgctcagaacacaatattgacaccttattaatacgtttgccacttggaatttgtgatcatcttcttgggctaagttgaagtgtacctaagaaatagctttctaaataattaatattagaaatgagttgtgggaagggtgtgcaaactgtttaaaatattaactcttttgcaactcccttatgtaatttaaaagtaattgcttgccacaaattggtagtttaattcaagttattctaacatcagcatccaagaaggtctcaaaagtttgctgcttggcaactctgttagctgcgaatctcacctagagatatctttaggttttaaaagttcttatacagccaatgcagtatgatggaagcaacatcaccaagaggcaggggagccagagtgcctgggttcaggttccatctgttctactttctatcagacaagctacaataatttgaactctctaagcctcagttttcttatctataaaatagagtttataatagtacctccttcatagggttatgggcagcgttaaatgactttaatacaggcaaggcatttacaatggtgtctagcttatggcaatgaaataggtgagtattaaccattattatttctggctcagatctagaaattttgagcaggtcagttactctctgtaagccttgcctctcttatcagtaaaatggtaatcataattatgtttaccttagaaggctattgtaaagtcaaatgagatcatatgaaatacctttgtcaggtatgtgctacacaaataataaggctagtttattttcaagtctttttttcttagaagaaaaatctgggtcagacttgtgacctctgtaaccagttcctaggactgcagttccttttcagttagcagtgttctggtctactgccactttagccagcctctcactcagctcaaattcagacactggtcactgtgttccccaagctagagggagcagctatgaaactttccacatggtctttctaaagtccctctttcaacctaagtgaagcagcaagcagcccccaccctttccatggtacaggaataggaagggaaaaatctacagctttctccagaaacccttctcacaaagtctttccccgaatttaactctccacactactttcatgcccaatgtgcatgagaggttaagaattgtgtaactggtttccagaaacctggaatgtaacatttcttctaccactgtgtctcagggaaaactccaactatgacattggctacactgagctctgccttagccacggaggtatccgatagcttgctccaagttaaaagcacaaacatcaatagtgacaactacacagtagcccatcacaaacttatttatttttttacattcaagtcaggcctattttctcaaagatttctcctaagtttacttcccttttgacttagtttgccgtgattctttttaccctaatctggttatatgtagaagttaattgtcggactaggggtaggaaactgaccttgagactgatatcatttacaaccctagcgtagttacacagagtcccttgctttacctcccctagttataatctaagagatccatcctaaaatgtgcaaacttggtggtggagagtaaaccaaaattcactggacatagtctgccctttcaccaatacagttctgattttgtgtattgtgaactttctgatgtacatcacggtagaagaatggagtgtgctgactgatggaatactcctcctaagacagagtttaccaaccatgtcctaatagtaatagtctttttgaagaattagtctacagtaaaagaaggtgacataaatgctttagcttttagcagagcttccaaggttgaactaggaaacaccaaactcaggatatactatacaatgatgtgggagtccaaagtcagtatgtttgggaaagccagccgactatttccttctcttggaaacttataatgaataatgtcatggtaaaggctctgagaatcctgcaggaaacaagctgcttaattaaccttattaacccagcattccctaaacgtatttgaccattgtaacatttcattcacaaacaaagtatttgtatttctggaaataccgtttctagagaaatgctcagtttctaagttggaaggcatcttagaggttacggagtctaaggccctcttcaggaataaaaccctccatacagttacttggacatagtaattctatggttgcagagataaggaaccacatgcttagcagcacaatccatttcttcttgggcaactctcataatgaattagaatctgtctttaaggtaagacaacaataagcacccaaattttacattaagaaaaatctaaattcaacctctagctgtgcttctccttatgtggctttgagaaagctactggacttctctcagctgagcatcctcaactctaatatgaggatggtaagggtacctgtctccaaggtagtggagaggaatacattaaataatcgatagtaagtgcttggtgcggtacctggtacataggaagtgttcaataaatgttgaccattattattatgaatcctgtatctactttccagaacagaatagcacatatctattaccatttccacctggcagctcttcagaatcacacaggcttcttttcccaagcaaagtatcctatgcactggatggtatgatcttgattcctcaccccatcagcgaacaaacacacaaacaaacaaagcatatgtttccgaataagtttattgataaagtagatacacatatgactgcagtcttgtgtgcattaccacacatacacaaaaataatattttaaagaatgaaatcaagatgaataatatgcttcgatatttgcatcttctcttattatgtaccatttcacatagcacaaaatcctgttttgctctcactaaatataataacaatattttgagaaagcattttcatggaatatgctttttttttaatccttagtttaagaggtcattgtaatattagattttaatggctgtcaaagttgagaacaaaacttcactaaaataggtagatccaatggaagaacagctccatacctatagtcgctgagtcatcatacttagtgtttataccccttttatgcaaatactgttgtaaaattcagctagtatatttttttccctaacgtcagtcaaatgttctggctgacatcagggaaaaaatacaccagctgaattttactagtacctggaaactacctggaatatgttgaattttttatacttttaatgaaagcattcaaaactccacgagaaacaaactggttagaaaattgcatttccttatgtttaaaacatatactatgagagttttcatatataatgacatacatcactttcagcaataaattaacaatttccatacatgtttcccaatgctttatccatagcacagatttttttttcaaatcctgttgccttcctcctcattaatataccacctttcacttaaaaagacaaatcaagtatgtctaattagaaaatatctgctttgtaccattatttctgacagccatttgtcaaagaaaaactcaacaaatttggatcacttgtctttttgaaaaaaaaatgtataagtcatctttaatttatcaactctaggtagtagttttccttgacttcaacaaacctctaagtgatagtatgatcctgatcagaaaacccaggagccagaggctaaacagagtcagacaggtaaaaaggtaaaaaggttgatccaggcaggtttatcagaaggaagcagaaggcaattagagaacgagggcaggaggaatctgggaaagtccactgtgacttccaatgttctcagcagagctcaaggagcctcaggtagaaggtaacagaccagcctactgaagtgtcatataagtcccacagggactcaggcaaggaaacagcatttgagcacccaagagaactagggagatgtaagacatgacccaggtcctagtggatcaaggaaatcagaatctcagatatggcaactggaatacaaggctggagcatgaccacagcagtaacaattcctggtcacggggctaagttgtcctaaaaggtaaatcttatttccctgtgtaaaatataagagatctgagccctggagactccaactaacccctaaggctacacatcttaaaaaatgataaggccaggaggacttgaaaccagaccatctggcaccagagctcttacctttgaagctatgctacatgccctgctcaaaaacagaggctgattgcaaatctaggatgctaggtccgaacagaatctgcagccaagccgataggactgacctctcctctaggaaatgttacccttgagctccttaaatttcccctgattactaaggagtttggtttccatggagactgagacaaagagttccagttaaatatgagagttaaatacttctagttttgaaaatgtgagatcgaaaaggcaagaaaccaggctttcctactgtctcacataatttcttacacaaaatcattttacagagagaaactgagactctgaaaaggtaagtgaactgtttggtgttatccagaagctagagagaccactggaacccagggtctctaaaccttaagttgaagacctttttcatacgccttcttacatgctctgccatctaactccacgattctgtgatactatacctagcgcaatgtttatttaatgattcagaaagcatatgttagcatcttttatcatgttgtatatagatatacaaactcccagttaagaaggatctgtaattaatagaaatatcaatattagcaagcctcataaagtagcgagtcttttcatatacagttgatcctcattatttgcagattctgtatgtgctaattaatctacttgctaaaatgtatttgcaatccaaaatcagtacgtgaaacacttttgcattattcctagacatgtgcttttgcagaaagacaaaaatttgagtgtcttgacatgggttcccaactgaggttgaatgactctgcattctgccacctcgtttcagctgtcatgctgaaaatcaagtgtcctttgcatggtctatctagggccttttatccccatatttgtgctttttcttggtgatgtcatggtttaaaatggccaaaaatatatgtgtaagataagcttccttcagacatgagttatatactccagaacatgagttgtgttaatgaatcaacaagaaatattaaataaggtgtctttaaatagaaacatatataaaacatggttgtatattgatcaagccatgacaaaaatgttgccaccaaaggcttataggaatctaaccctgaatttcccatggggccagtgattcactaattccatgtttgaggtgacttttagaacatactgctgtggataatgagaatcaactgtatatagttaagctcagcccactcttcctagtcttatccatcattgccctaacttctctcagaatggtcaggaggaaggagtcaacttcaactttatgcaagagactttaaaaatgtaattaaaaatgtaaaagagtaaaagaatcaaatggcttaaaaggaaacaaatcctatatcataggaaaccaattagtaggtagagaaaagagttcaacttcaaaccctcagccttggttactaggaaatgcgctttggctaaaaggataaactggacacacaactggcagcatcctctctcttaatcaaatttgcctaaagcatctcaatgatctactcaagccatagcatgaactctgtggctgccttaagtcctagactaagagagagctgtttcacacagtctcagaatcgatcattccatgccatggtagatttggtgtggaacagaggtaaaaaaaaatgttttccttgttgacatatgtgataaaaagggatgtcttgtccttcctggcttaattttctcactccagtaggttaagtattcacctccacagttggttctcaaccaccatcactttggtctgattacttctgtgaattcctgagatgatgggctggtgaaaacatgggccagctctgctcagggaaccctcaagtcttcttgcttccccttgcagccccataaagtggcttctaatgcttgcccataagtggggaattaacaccatgcttcttctttaccatgtttctttaactagctttaaagtttctggaatcctgcctcctccctgccttttaatttcatttttgtctgcttcccatcctttcatccacctcgtgtggtccggatatacacacttgctactcttagtttaggccagaaggctctgtagtttctaagatacttgacttttttcctcttcctataagcacttcttcttggctactccagcccatattgttcctccagccccttccctgaactcataaagcattcacaatcagtagcatacagttttccaccagaccattctgagtgtttcacctgtgctagtcttaactcactcccaaactccctgaaaccggcacactgtgtctgccttcctccttggataaaacagagattttattggaaggatggcacatagaccagtgcaacacaagcaaacacagaccctgttaactcaagaaaaaataagagcccatcaacactactgaagcttaataaaagcattaatgatgtttaggacaatgagccttagagcctcagggtcacctgtttatgaaaggcaagcatattatcctatggcagaataggtaagaatggttcccagcaattacaggaccccgctaagtttatcctgattggagagaagctcactttcactttacaacctgaagattaaggacaatcaggcatgaaagatgctaacatcaacttagaatgtaaaactggctgtagagagggaaaactctgagtcagttacctttctttaaaagactcatttgcagaacttaaattcactgacattttaccctcaggcctttaactgttttttgaagataaaccatggttgagtgaatcaaaataattttgcagcaaacagtcatttgacaaaagcaaacccattgagacatacagttcctagctgattacccacttccagcctccatcagcatgaatttattgatcagaggggaaaaatgaattgaaaactaagtgttcgtctgaactccatttcctgtattatcttggggttatagagagtctcagctacagaattatcaccaataatccatctcactagatggtcactagatctttttaagtgccttaaactcagcactactggaataattttagccattttttgcagtgtgatttctttcctataaagatcaaagatctcaatgtgcatctgcagatatctatagatatttcataagtacagtggctatggaagctcatgcaattgatgttaaatgatgcactcataactttattattgagcaatcatgaattcttcattctttcaattatataaaacctattcattcactaagagagatggggaagttgctacccaaataacgttgaatgagtaagctgtaataaacataggcagtgaataattccttgtgagttcatctcttgacaaaacatagcacattacctggcataaagagcttggcaaacattgagcacattttatgcgtcaactactgtgccaacattgggttttcagggaaaacatgaatcttgccctcatatgattcacaatctggttgaagaggcagacattggataaataacacaaaataatacatggctcagagttttgaggagtgctaaaacagatgcagttatattgagaataaatcaggggccagaatttagtttagcatatatggagctcctttttgaagaaatgacatgtgtaactaaactctgaagggtgagttgaagttcgccaggtgaagaatggatggttagccttctagagaaagtacatgcaaatatttggagaaaggaaagaacttaatacagctgaggaactgaaagaaagccacaggggctaaaacgcactggggaaatagcataagataaaggtgcaagagtaggcagtaagaagtataaattttactctaagttttatgggaaagaactaaagccttagcagcaaaggagtaaaacaatctgatttacatttttgaaaagaaggcccagagtgctgtatggagaatggattggaaaagaagaggaggataatattgcagacattcagagggtcttttgggaatggtgtcagtggagataggcaaaattgcataaagtcaagacatattttggaaatggaatctaagaggactttgagatgggctggatatcggaacgtgagaaagaagaagccaagccaactttaactgtcaaattaaaattgatggatagcaattctatctatggagagtaattgagaagaagccgtttggtggaggtgataatggggggaacaagtttagttggctatgtcaatgagacattcaggaggatatgcaaagtaagctttaattagcaatagactagtgaagtcagacagcaagtatgaatctaggagtcacacaatattgatgctacttaaaatcacaggaagcaagatctatgtagtgagactatagaaaagagaagcaaaaggcccagagcacaaatagagaaaaaggaatcaacaaagaatgctaaaaaggagtaacaggagaaggagcagaaacgaaagaatgcaaaatgacagaaaccaatagaaaagagagtccggaaaaaaaatgctaaatgatccagagaggcctaataaagtgactgtttaaagtgtttcttacatttggtagttggtgagtttgtagactttggcatgacagtcacagtttcagttatgagttatgggatgaaaatagattggagcaggttgaagatcgatgggatatgagaaaatgaagacagcatgtgcagacaactctttctagaagctttgctgtgaaagaagaaagagaaatagggagttaggctaagtgaaagaagccagacccaaaagttgcattctagatgattccactgatagagacagagcaagagggtggaatagaaagctccaccaattgtcccctgggcaaagacaccaaattaacagctctctacacagaaaaaaacaccttcatgagaaccaaaaatcaggtgagcactcacagtacctggttttaacttcgtatcgctgaaagaggcactgaagagatagaaaagacagtcctgaatcactgacaccactcctccccacttccctggcagtggctgtgtggagagcatctttgggctccagtgggggacatcatggatgattccattgacataacattttggaaaaggcaaaattacagaaacagaaaactgatcagtggttgctagggatatgaagtaggtgaagagatgaactacaaagggaaaacacaagggaatttagaaagtgacggcactgttctatgtctgtattgtgctcgtggttacgtagctatatgtatttgtcttagcccatagacctctatgctgaaaagagtttatttttctgtatataattttttagcgcattaacaacacaacaaatccttcaaaaaagaacctcttttcctggataaaaagcaaagggagactaactcaagggctgttgaagtaattaaaagagaattgcccaagacagcttctatgtggacattagggaatcaagagaggaaaaaaagaaaaaaaaatttgagaaccatcaccgagaacccatagactgcattcacttcctctctaaatacagaagcagagaacaaggcaccaaatcttcttgagtcataaacctcaaaaggacatatggtccttcacaatgattaatatatatcaatgagtgttctttaggttgcatgcaactatcaccacctccatcttgagtaagtcacatacagaaaagggaatgggagtagagaggtagtagaaggatttcaaataactcacaggtgttagagaaatgacaaagaacaatgcgtccaataattcgtatgtgcctctaaaaaccctcaccattgttctggcagccagttccacccacatttcatccagcttcactcaagtgcaactggacaacacctggcctagccttgtacacctctcacttcctactctggggcttcttgggcaccactgtgagagatgcccatcaggaactcactgggtgctcacaaatgtgcaagccataagtggggaattaacaccatagggtcaccttttaccaataggaaaggggagtctacagacacatccttcccccactactctccctcactcagatcaacagttctgaggaccaattttttaaatatcctaactcaagtccttgggattaggaactaatcaccagtagtggtagtattgcttagcttcacctccttgccagtttcactccctgtcctgaatgctctgaaatcatgctatcagctatattacccacagctaggcttcttctcaggctctgcttcccgggaaagccaggccaatacaaccagaccttgggaaggatcctgggtaggtctgaaattttcagctatagaaatttataaccatctcgtaagggtaatgacagcagaagctctaaccaacctctaaccagttcccaggagagagtctgattggcccagcttaggtcacatacataccctagggtcttagggcatggaatctcatgctctaatcccaagagaatcgcttggagtggagaaaggagttttccaacaagtatgatgaggttggaaataggggaaattttaagaaacttttgttactagttggaagttgctttagggtcacattaacttatcaatcgttttttttttaatgtatactgtggcatcctaatccccttgtgactgaagtgtaagtttcttttctctgaggaatcaacagcttttaagaccgtggaacgaaccttaaaatagaaaacatgagcctaattcacgtatatacgggcttttctcgtagatttttctgatggttcaaaattgatatttttattctggaaagttcatgctctaacaactgtttaaacagccagtttcattttcactcactctcattttgtttctctctaggttaatatccaacacaggtattaagcaccttccagatgttcacaagattcattctctccaaaaagttttactgtaagttttttccttgagtgactaccaactctttactcagtatctgtcttgcccaacggctatctgggcctttaatatgcattgtgtagtctacatcctccaaatgtattgctctgggttagcaaagatagggaggccagaagtgaggtccttgattttacctgcaggccagtcaatattagtttggaggaaactgaaagacccttcaataagagtattgttcacaaaaccagcatgtagcaaaatcaaaaagtggctcattttttcactatttagcgctttaattactgccccccacacacataaacaacaccccctgtattccagcatcctctcctcttctttctagaattgctatgctgccctgggcacaaagaaactatctaacaaacacattcatattaaagagttaatgacaggctgtgtttgccttttcccaaggtatttgtattttgaaaaaggaagagaaaaggtagcatataatggcaactattcccaatagtgaaattgtaagaatatggacagatccaaaaggaggagatggggaaggggtgtaaggagctaagcagagaggaaggagataagcagggagggaggagagaaagaggaaaatatgaaaatctttcagaatttctcaaattgttccaagctgtttactacactacttgtacagctgttacttccacatttacttctccatattagatcagacctaacagggaaggttgacgggggaaatgaggaatacaaacagaaaatgagagtttcctcatcctttcattcaggaaaagaaaaatcaatgataaagccattctgagacccaaggagaacaggcagaaggaaactagctgtaagaaggggattgacatgaggagaaggcccaactaagatgaacagagaagttagacaagaggtgaaaggtcagcttaagtgtttgttacattagggtgaaattatttaagaaaaccttcagaagaaaaaagtaagccatgcacagtggccagtggctctaatccagtactttcggaagccaaggcaggcagatcacttaagcacagggtttgacaccagcctgggcaacatggtgaaaccctgactttacaaaaaatacaaaaattagctgggtatggtggtgcacacctgcagtcccagctattctggaggctgaggtggcaggatcactggagcctgggaggttgaggctacagtgagttgtgatggcaccactgcactccagcctgggtgacagagcaagagaacctgtcttaaaaaaaaaaaaaaaaaaaaaaaaagacactgaatgtctgcaattccatttgtaagaacatactaaagataaattagagacaattttttctccaaactttgagctgatcatcttctaaacaacaactagttatattaatacattacctcagctgaagaccgcatcatgccagttaaactaaattttggaaggttacatgagtagagctgatgtaagtatcttatttgtctgtactttcttctagtgacattcaagataacataaacatccacacaattgaaagaaattctttcgtggggctgagctttgaaagtgtgattctgtaagtaagggggaaaaaatccaacagagtaacatttgatttttcatttagtgatctctttctcataattggatgctccttttttgtttgggtaactttggcatttctccacttaaatcactctccagttctgcgttcctctctcatctttacatttcagaatcacaatgtggagtcatgttaataatttatgattctggggtgtgattcaagtatttaaaattgctgtttgaatgatgatctcctgtgatacaacatctgttccaaaggaaagaataactcatgcatcaataaagctagttattgcctggcaaggcttttgttgcccaaagaaaaagatcaggaaggaggcccaatcaggaagatatggcgattccctcataaccatgccaagcagttcctgttcaggcccatgctgagcataggatgacttctcattttcttgaaacaatcacattttttaatgagcttgagttactctctctgacttttgggaaatctcttaaaagcattctgtgttgttagtgaaagaccttctactcttttatgccagtagcccctgtagcagtttatccactcacaagtatggccaagaaataggacactatgggctatctaagtatgcctgggatccatgaaagttagatgcacagaatgacatttggggacccagcaattgcacttacatctgtaagatatgaaaagcattttatctattttacaaactgttgtgtttttaaaaaaatataccagtatgagtttttaaaatatgcctatatgtacaaaacataagttccagtccataaagaattttagcccccttcagttgtatgattcagagaccaggctgttgaaagaaaaaagaaatagtagacagattataacactttgatgagtaaagctaagcactgtatttgatgtaaattaatcacagataacaatggaaaaagtttgaaaacagattagcatagaaattgaatgtatggagggaacaataaaattaaatcaaaggaatgtattcaaaatacatagatattaggacaaaagctataggtgagtgatactgaatcatttcacataagctcatgatatttgaagtgaaggggtgtgtgtgtgtgtgtgtgtgtgtgtgtgtgtgttgagatgaggtgatggggtgcagaaagggtaagaaagagaaagcaaaaggaataaactaaaacgcgagcagaatgaatgatatacaaagaaaaaaagagcaatcattctaagaggaaagaaggaatgatttaatctcactagtctgtgatgcgagggttaaaggaagagttaaacaagggaaaggaagctaagaaaaagaggttgtttttaaaatgggcttttaaagatgagcagtagttagctagggaattggcaaagggcgtgcagagggaacagaataatcaagaccaggaagagcacctgccttttataaaaataaaaataatcaggtgggcgtggtggctcatgcctgtaatccaagcactttgggagacagaggcaggcagatcacgaggtcaggagattgaggcaatcctgtctaatacagtgaaacccgtctctactaaaaatatataaaaaaaaaaaattagctgggcatggtggcaggcatctgtaatcccctctactcaggagggtgaggcaggggaatcgcttgaacccgggaggcagagtttgcagtgagccaagattgcaccactgcactccagcctgggcaacagagtgagactccatctcaaaaagtaataataataaaataaaataaataaaaataataatacaaagagcttgtggaaaatagtgaatacatgagtcatattggcctgctggattgtgaaacaaacacaacagtaaaaggattcctgggttacttcacagagggagattggtgataaatgtaaacatttatacctagatgtttatgtttatttggatctttcttgaaatatatgttcattttaaatagacttaaatgaatgttataatatggcaaacttattcaatttttttatagaaaatatataattaagtgggagtgtgctcatatcattcttgtagttttgcatagtgtgcttatattgttctcacagtatcattgatctgacttttttgtccagaccgtaagacagaaggcaaagcactttaagtgacctggtctcaactctccccaactagaggcaaagaacctgaggaaataagaacttctgacatagctttgcaaacccaaagctacaagggaaacatatagatcctgtctgctctttcctaactcctgttcatggacactgatctctcagaatttaggaacacacttttcaggaaaggagttttcttttaagagtgaatgtttctcagacatgtctctaaaggataaactcacttttgtggaaacaatttctattgttcttattttggctgtcccttaatccatagacaataaaatcatgtaattcatacttaacacaacttaagtctccaatcgtttctagtttggcagcttcgatgcaggggtgttttcttcccatggggacatttgagcacactcagaaaaaaaaaaaaaaaaaagcatggcaaatggcgctgatgactgttgaagtattctatggatagcaattttcaaaattctgggaatactacacagctataaaaaagaacaagatcatgccctttgcagcaacatggatagagctggaggccaatattctaagcaaactaacacagggacagaaaaccaaataccatatgttcactcttgtaagagctaaacaatgagaacacatggattctaggaaaggaacaacagacaatggggcctacctgagggaggagagagaggatcacaaaaaatatctattgggtactatggttattacccaggtgatggaattatttgtccaccaaaccccatgacgtgcagactacctaatgtaaaaaacgtgtacatgcggccgggcgcggtggctcacgcctgtaatcccagcactttgggaggccgaggcgggtggatcatgaggtcaggaaatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggaacttgcagtgagccgagattgcgccactgcagtccgcagtccggcctgggcgacagagcgagactccgtctcaaaaaaaaaaaaaaaaaaaaaaaaaaacctgtacttgctcccctgaaactgaaagttgaaaaaaattctgaggccctgttctaaaagtaaatgtatttttaaagcaaccagcaatgaaagattatcagacactagcctagtgaatcagagaagtgagcaataaaaacccactgtgtagaggcttctgagcccttctgcacccgcactgtgccctggtaagcagagtgcctgaatggggaaagcacctagctatggccagccaggagaataatgtcctaattcagaagaaataaaatgagtgatatgcgttacagtgcccagcacactcgggcctcaggagagacctgcttcgtgcgtgtttcctctgttcctcagtctgcccgtctcccttgcctgcccctcaatgagttttaaagggccaagtccccagcacctccactctttaggatgagagcaaagttcacttctgtagcttcctgagcctctgctgagtgagcacactggcctcatccccaaggacacaaaagggttaaggtaagcctgtgatgcagtaactccttagttgatgttctgcccaggttgttgtagtcatcgtcatcatcgtcatcatcgtcatcatctggttttcaaataggtacttcctctcttaagagaccaggggtgcgtgtaataaatgtgggtttccctttgttactagcttgagattcccacagataacgtaaatccaagggcagcagttctgaacataatttgttttttttgtgtgatgatccactgctgatatcaagaaataccatcctcctccccatataatggtatctgttgattgagataatccataaagacaaagggatatttgaatacaataattatttaaaattagtttatgttttatttgattatagcaacatcgatttacaggacagtaatatgcaagaaatattaattatctagtcaataggcaaataggtggaacctgtatggattaagggtcagccaactacatataacccagaggccaaatccagctcatgagctaagacaggaaacactaacattagatctaagttaagcaaaatgttatcccccactaaaaattctcttctcaatattaggcctatattacaaaaaaaaaaaatacccaattattacactttgaatttggtcaataaaaaattgtggtaattgttttataagtacataaagtacttatataatattttttatttttgccttttggcccataaaacctaaactttactatcaggccctttacagaaaaagtttgctgaatcctgtatttgattcaaatccccagggatccacatgccacagctacctcagcaactcccactatcctgcaacagtcaggagtccagatgtgcctgggagaggctttctcaaatggcattgggggtgcatagccacttctttgccatcagaacccaccaattgattgtgaatgttttaaaagatttgcctcgcccctttctggatttttttaggtaattggttttcaagaggaggaaaaagacatacagttgttctcctgtgattttaagtgttttctggctacccatggcagcccaggaaagagagtcctggatgcacaggagcttctctgggtcagctttctgtacagtgttatttgcaagcccactaagctggacagggaaaagaacctgacagcaaaacaagagcaggtagtcagaggttcttcgggctaagctctcctgaccttggtatctgtttttgttttcagatccactcaggagcagagcaaggcagagctgtagcccaaggtgtccttgggctcccctgtccagggaaccctgctcactgaccttcttagcgcaatcaggatggctgttctacacccatctccacctcccccagaacctcctcccctgctcattcagatcacctcaccctgccacagcccacattctctgtaattgatttctcttcctttctggcttaacccagagccacctccacaaacctccaataaccaggtccctatgggtcacaggagatgttcaggttgtctgacaacttaattagatcacttttgatgacagccaggcctgctgctgtgggtgatcatgggtgaaaggcttaaggccttagagaaaggtgacacaaaatgttctttctctgtcttataaacacttgttcaataattgtacgattcctgtccttcaggatgagaaagatctgtcgctccccgcattgcttctctacacacaaatgatgtgtgtaaagaccttacagttatagaatccaggctgctctgcctaagtatgcctttcaaacttaaatttcatttaatcctttgaataggtaatacatgcaagtaatacaaacttcaaaagttacaaaagattatacagcaataaatcagtcttcctcccacccgtgtccccaagctttaaaagtggcattttctttatgccactaacctgtgctgtctgcccttgctcagtgcttccaattatgaaacccgtgtattgtttgcatctgacattattggttttttaataggccttttatttcagatggctgaataagaatgggattcaagaaatacacaactgtgcattcaatggaacccaactagatgagctgtaagtagccctgactattcttcaaggccatttaaagggaaatggctcttacaacagcaatatttatgtggctttgtgttttccttcttctttcctcaaccccatccccaggaatctaagcgataataataatttagaagaattgcctaatgatgttttccacggagcctctggaccagtcattctgtgagtagctttccccatttctgtgtgtaagagctcagtttgtgtaagttagaagtcaactctctgcagctaggggagaagcttccaacacagggctggccatcaagttcaatttttattcgtgtcatctgcaaaaatttatagagacaatttaaggcttatccacggtctaactctccattaaaaagcaacactaataataacatgtaatgagcacgtacagagtgtcagatggcgttctcagaagttaagatgcattttcttgtttaatccttataatcaccccctgtggtaggagctattattcccgttttacagaaggaaaaactggcttccctggagaggttaattcacccactcaaggttatacaagagttacagcagggatttaaactgatctaactcatggtacagacccacaaccactcgatcatgtgtctcttccctggaaaggaaagcacaattctccatcatcctcaacactcaggaggttccttcaacccaatgagacctatatacacattatttttggatcctctttccaaatcccttgggatgcattccgtgcctcacagccctgcatcagcacccctccctcttgtcatttccttacttccatctttccctccaaaagtgactttcccatcttctcttcttacctacactgccccttccatcaagcatcattccaaagtcctctacctcctcaagtctctctgacaacctcgccatcagtgacttcttcccgtggctctcatggcctttaaggcttctttggtggggggacaatctgcatcacaatcacaaaaaggctttttaaaaatgtgttcctgggctctaagcaagacctactacacttactgactgaaaaaagtacttcaagatgaagaaaggaacccaaaaggagagaatgaggtacaagaaggaatggtgagcagagcaatagataaacatgttaataaatctacagttttactgaatgatccttatgtagcctgccttaagtcaagtcaggcgtttagaagccacctgcctgaacctcttatttggcagttagcataggctaccatgtgtggttatctacccacctaccgaccaaccatctatctgcatcacttttgtctacaccaaatagctaatattctccttcaggctggaacctgtgtacctctagaattagacttggtatggagagtcagaattttaaatatttattattaatgataaagggtgtgttgtgatctatatatgagattctgctgctttgaagaagaaatatacacttcaaggtagatttatcatcctgaccatgttcaaagattattcgagaatgcctggcttgagataggcaacctatacaaatggagtatccgtgtgattaaagcggagatacagagcagactgccttggtttagaccaattcttttacctctctaagccttggtttcctcacctaaaaaaaatggccaaaacaatacctatttcctaatattatttgaagcataaaacacacacacacacataaatattttttcactcatcagataaatttttaagcatcagtcttgtgccatgcaggaaacaaaggaaagttcctcctcatagaaagcttatattctcattgggggtgggaatagagaggagtcaggcaatacattaaatatacaacttaatatatcaagtcatgatctatctatgaagtacaaggaaggacccagggctaacaaatggagagtgttgggcatatagtccatgtactcaagaatacaaagtactcaaaacttgtactgcttagttcatgtaccctgttcttagagtactcgggagacaaatgaattttgacaagtacttttgatgtctttgatccccacaatagcagcatgtcagtttcacttagcaaaaagccctgaaagttttgaatgttcctaagaaggcatctctatctgttcatggcagaatatgtcagtgatgggtgtgtttatatatgtgacctgtaccaggtacaatattgaatctatagcatcttaacctatctgctcccgagaataatgaagttggatgagatcccccaactccttcattatccaactgaagaaatcagaacccagaggagagtgatctgttaaagatcacactgcaactagaaggggcagagtctggaccagaaactaggtcttctgcctcacattccatgtattcccaccataccatgttgccataaatacgtttaattgaacatctaaaagttattcggtgaggccccctgaaactggttgtgagctaaaatagagaggaaaataactattaacaccagcctcccagcctaagaacaccagtcaatgttagataaacgtggcacagaagaacatctcctgaggttgcacaagcagattccaggcgaagatactgcacaatgtatctcataagaatgtttaacagagaacacaaaacttgaatcccccatctagccccactgtgaacgcaggcaggaagagagcctctgtgaaagcatcggaagcaattctacaaggtcctcaagttataggcccattgttttgtccttcttaccacaggaacacatctgtctagaattaagggaatacaatttacagaaaatccatggaattaggaagcactccccatgacttaaaaaggtagagagtgataatacattcccacatatttccatctcagtgcaggatcctggctggaagcccagcctataattgcgaatttcctcttttccccctggggccaaaagaattgttcaccttaacatcaagcccccctttctggggctttcagatcagtccatagatgttcttcaagcctctccccctgctgacctgagatgcaagaagactaatagcttattccacatctcacttctgcatccagatacactaaaccatctaaaccctggcctgagaggtgcttgtgtaggtgtgcagtagaccagcccacctcaggtgatgagttaagaggtaagagtaggagtatgcgtaggctattcagaccacagtaggtgcaaatcatgctgatcttgactgtgccttgggtcagattgcagtccccgctcccacacacacacacacacacacacacaaagactgtgatatatctgcatgcgggaggtttaccggagggtgctctcagaatgtacagggaacccttgatggaagcagaatcagggtaatgcatttgcaacaaaaggctcagctgatcccatggggagatctggagttaagatggtccttcaaagttgtactgaattaaggtaaggggcaagtcctccatatcaagaattattgggtgcaggctgtccctggggaggaaccaaactcctggggaggagaaagtcagctgagggcaattcccagagtagactcggctatgagccacctcagctgtgagtggttctcagttgtcctagagcagcatgttcagagttgagtaggttttgggggggtgtttttgtggttttttttaatcacccatgctggagtgcagtggtgccatcatagctgacagcagcgttaaactcccgagctctagtgatcctcctgcctcagccttctgagtagctgggactacaagcgtgcaccaccacacctggccattttttttgttgcagagacagggtctcactatgttgccaaggctgatctcaaactcctggcctcaagttattctcctgccttggactcccaaagcactggaattacaggcgtgagtcataacacccagctcccacctttagaatttttgattcagtaggtcagggttgaggcctgataacttgtatctctaacatcttcctagtgaaactgatgctgcttgtccagagtgctctctgagaattactgccctaggaccaatattgggaattgggaagccttgctcagtctccaaaatatctcctccacaagccaaatgtggtgaatcttcctccctcactggctcagtcctttttctccagtggatatatgcaaggaattctaagaaaattaaggggcacacactcaaactgatgatagctgctttcctgaaggcaaaatttgtagttgagggaagaatagggagcctctgaacacctgagggtgcaagggtgcactgttccacacaaagaaagatagatgcagagaaagccaggggcatacaaacaagtttcatcgagtttcagaggagcagctcagcatcctcatttcccccttgtgagtcttgaccttgaacatcagcagccatctgagtttttacctgatattctgaactcactcaaggttgtttttttttaagcaatcgaacaattgctgtttctttgggaaacagtttcctgtggggaaaatttaatgcattgcctttgcaggctggagccagtacaatcatattctgatggtttatcaaattgatttggctatagctcagattcatttgatagttcagattcaaacactgagttatttgtataagaatggttctcttccattaccagtgtacccacagtcctatagatagtaaattgcctttttatccagcctgggatcatgaaagagaggtcttctagccatctgtcagtgtagtatacaccagaaatgtgctctcacttatggaaatgattgacctgtaataacatctttgctgggaaaaatagaaattgttcaaatcaaatttgtggcactggctataacacactttattaaatggggcacagagtgctttttaactcctgcctctcctgcctcagcctcttactaccctcctacccatgcagtctctcttgctactctgtatctcaaaatgaagagtactaacaatgtggaaacaattttaaattactaagtctcttctgtgcaagtcataatcccatggggtatccactggtcttttcaagatttaaattctcaaaactactcactatctgaatatagcatgtgttgcaacgttaaaagtgatatttttaaaagaaagaccaaaatcattagaagagaccagcctgaaagataaagtttaaaaacaccagtccacaactacccctccccgcttgtccagcccaccagttccaggcacaagggcaggaataaagtaaacattctcaagcactcattgagggcatcaagtcttacatgacatacatttagtggatgttgattaaacacctactgtgtgtctggcaaggggtaagaaatatatgtgaaaacagaaaacagtacctactgtaatgcatctggccaagggatgaatgttactccccagtacaatgagcactgcagaaattttcacaaatggctatagtaatatacagcagatgcctaataaacccttgtcatcatgtcacacaatgacttttaacacgtgaagtgatagtgtgggaggagacagcctctgtcatcctaggcctgaatttctgcaaaagccacgttgtccccttcctaccctcagtcctttccccttccattagtttaccaactatttattgaacacccaccatatgctggtatcaaggttctcaagactaatcttacaaaaatccagctttgaataaaccattcttctgctcatataaatcctaaactcttctgcatgactatcaaggctcagagatctaatcccgtcccatggttccctttactcctccaagtatgattgcccagaataactattctaaataaccctccctcactgtgccatgatttatgttctgggcctctctctaagcctatctttagcaaatagtcattgtattagtcaaggttattcaaagacagaaacgagagagagagagagagaggagaggggattttattattattattatattttaagttctgggatacatgtgcagaacatgcaggtttgttacataggtgtacacgtgccatggtggtttgctgcacccatcaacccatcatctacattaggtataactgaaggagacagagacacgaaaaacccctcaaaaacgtcagtaaatccaggagctggcttttggaagagaataacaaaataaacagactgctagccagactaatgaagaataaaagagagaagaatcaaataaacacaataaaaaatgataaaggagatatcaccactgatcccacagaaatacaaactaccatcagagaatactataaacacctctatgcaaataaactaaaaaatgtaaaagaaatggataaattcctggacacatacaccattccaagactaatccaggaagaagatgaatccctgaatagaccaataacaagttcagaaattgaggcagtaactaatagcctaccaaccaaaaaaagcccaggaccagacagattcacagccaaattctaccagaggtacaaaaaggagctggtaccattccttctgaaactattccaaacaacagaaaaagagggactcctctctaactcattttgtgaggcagcatcatcctgataccaaaacctggcagagacaagaaaaagaaaaatttcaggccaatatccctgatgaacatcgatgcgaaaatcctcaatgaaatactgacaaactgaatccagcagcacatcaaaaagcttatccaccacgatcaagtcagcttcatccctgggatgcaaggctggttcaaaatacacaaatcaataaacataatccatcacataaacagaaccaatgacaaaaaccatatgattatctcaatagatgcagaaaatgccttcgacaaaattcaacaccacttcatgctaaaaagtctcaataatctaggtattgatggaccgtatctcaaaataataagagctatttatgacaaactcgcagccaatatcatactgaatgggcaaaaactggaagcatttcctttgaaaactggcacaagacaaagatgccctctctcaccactcctattcaacacagtgttggaagttctggccaggacaatcaggcaagagaaagaaataaaaggtattcaaataggaagagaggaagtcagattgtccgtttgcggatgacatgattgtatatttagaaaaccccatcatctctgccccaaatctccttaagctgataagcaacttcagcaaagtctcaggatacaaaatcaatgtgcaaaaatcacaagcattcctatacaccaataatagacaaacagagggccaaatcatgagcaaactcccattcacaattgctacagagagaataaaaatacctaggaatacaacttacaagggatgtgaaggacctcttcaaggagaactgtgaaccactgctcgaggaaataagagaagaggagatttcttagggacattggctcacatggctatggaggctgaggagtccatgataggctatctgcaagctggagaaccagggaagctatagcatggcttggtccaaacttgaaagcttcagaaccggggaggccatctaattctcagtccaagcaagaggcctgacgtgcctgtgtcaacaaggagacagacatgcactggggagtaagtagaatgatacattgggtggactgacttgaacaccatccagtgttcaggtgttggattgggaagaggcctgagaaccagggaaattgatggtataactctgagtctgaagtcaaagtcctgagaatccaagggggtgggggagggaaactggtacaaatccctgagtccaaaagcctgagaacctggagttctgatgtctaaaagtaggagaagaaggggtacccagcttctgggtgagggcatatcttccttactcaatccatggattcacataccaatctcttctggaaataccctcagacacccagaaatagtgctttaccaactatctgaatattctttaatcccctcaagttgacacctaaaattaactatcgtggtcacaataatgtactcccatgaagatgtgaataactgatgtctttttttgttactaccccccacccacgcccatgtatatttgcatcataaaaatggagagtgttttcataaaggaattaaaatcaaacatctgatttttaggccatgcagaagaactgtagccaacaaatagacctgtgtgtgtatgagtgtgtgtgtatgttttaggagaacagagcaaaaaagggaatatactatagttaagtctctagccaagatctgaacaagatctacttatctcatctttgtccctggctaatataaatttctatggaattttcttaatccatggagatactagagatatgttgtattttctgtcagttcaaaatttggaagtcttgacaggttccatgtttgatcacttcagacagtaagctttaagtaaacacctccacaaagacttttatttccctgtcatccaggaaccacttttgcttaaaaatttgctttactgaactttaagtgactttgcctctttcttaccaagagctccctccttcaacatccaccaatgaaagatctcaatcccagggcactgacaagatgccttcgtctcacagcatcaaagccaccatgtgcaaatggcagcagcacatatgtcttgtagccgtgataagaaggaatccaaaataacaagctagctccagaacactgagcaacggaaaggcaatgaagtttaccaaggaggcttcccaatctaacacctaaacactggattgcattcaagtcaatctacccagtgtatcattctgcttactccccaaggcatgtctgtcttcttgttggcattgcacaaggttgctccctttcttggtaacttttatattctcagccacatatacttacctgctgcagaagcaccattttcctgagctcactttaagtctagatttctggatttctcggtctgcctttcattcatctccccttagaattagctcttttgtaaaattttctccagcctctcatttttattacaatgctgagtcatgtctgcttatcagacaactacttactcaatagatttcatgagcccaaatctatgccagaaatgatacagaacacaaaagcctgctctcagggcacttgaaatctggctgaggagacaaacaaacatacatgaaaagacaaccataggaaacaatagaagacataacacaaggtgcaatattctgcaatttctggaagtcggagaacatcacagttggctggggtgatctgtctatttcctttcctaatccttctccaatgtcactccccagtatatcttctaacaaagcaataagtttctgggtactcactacatgaaaggcaccgctgagaatgcgagagccttataccttcaaggagagataaaatacaaatagctagtacataaagcaaaagatagtcagtggtaaaagaggcagaaagtatacagactataatgctatcgcactcttactggttttcaaggaaaaaatacttcttcaactgttaaacattatggagacctcagtggagtttgttttggttctctattgcctcattaaaatttaatggcttaaaacaaccattccattttgctcacaattttgtgtcagacatttggatggctggccctgatccatgcaatgtcagctcaggcggctgactgcggggcggggggtccacttccaagtagtccccatcacttatgtgcctcacacatctgtgtttattgggtgtgtgtgtgcatttgcatgtgcatttgcatgtgcatgtgtgtgtgtgtgtgtggtgtcttctctaactctgtccatacgggttctcattctccaggacctgtctgcatggtttaggcttttaccaatatggcagccttaaggtattcagagatctttcatggcagctgaagactctgttaagaccaatgtagaagatgtcagtgctcttaaaggctagatctataatgaatagcaacatttctatcatattcttttatccgaagacatcacagttctgcccagattcaaggggagaacaaatagacccgcaatgggaaagagtgtaaaagaatttgcagtcatctttaatctaccacagagtatatgagataatgggatgatattccatggagtataaaaatttgtttctctttagaatcttcaattaatccaatttttatactgtaaactcaagggggagacataatcaagaaaaataacctgctttgtattgctcgttttgaaaaatgtgaaaaatgttcatgagaggcaatgatggtcttggtctaaattgttcctaaaggacttctaaaatgttttttttaatctcatttcttggagggagtcctgaattgttatagacaaaacagggagttgggtctcaacctttgttctttccacatttgagaaaaaaagaggaacccaaatgacagataagaactcagtcacagaaaacagggcaagtgtcactaacagaactggctagaagaggcgttgccaaaagagagaaaccagaaagatctcctgtagcaaagaaaaaagttggaaatctctaaaacaatgggaagtataaatggagagaaggcagagacagcagcagagatcaaagattcatcaaagagacaagggttcatggaccagactctgatctccagggaccccaaatctgaagaatcataatagggagggagctagacaagatgccctggaccaccagaacgtttaccttgtggtgatagcaatgagtgttgtgagaagtaattagattccagatgtatgtggtataaaaagtcaagaagtttttctgagagttttgatatagggtatgagagaaagagaggagtccaggtaggcatcaaagtttttgcatgaacaactggaaaggtggaacagattttcagaaaatatcaggaaggccatttttattattcaaagtctgacctgcatattagacaactaagtggagattataaggaggcaattgaatatgactctggggttcaagaaaaagaagcaacccagaaatacaaattttagcgccatcagcatataaattgtgtttatgtcataagactggataagcttatctgcagagtaagtgaagattgagaaaagaagtctaggcactgagttcattggcactcctaaagttggaggtcatggaggaaccagcaaataagaagaaactttcagcgagctaggagacaattattactagagatacagaaagttaccaggaaggcataaaatgtataaatttgtatgagccttaaaaagtcatcaaacatataaaaggcaaaaattgacaaaactagaactatacaaatccaaaatcattgttggagatttcattataattttctcagtagtgatagaacaaagaagcaaaaaaatcagtaagtatataggagatttgatctaattgacagctaacaaagaggggactatgtataaaatacacacacatacaaatgcacacacacctaacaaaggtaattgttctgaaaatgtaaatcttcctgaacatcaaacaggggatcagtagtccagagattggcaatagtaaccactactaaccctaggacttgaggaacaaatgaggaagtcatcttactgatgtccaggaactggggcaactggtagaagctggatcctccaaggatctgttcaacgagagctgaagtcacagagaagactcagttgctgcctgagacagagaagggatgagatttgcacttttacctattctccagtatcccactagtgccatttgctaaacccaattgaaagctgattgataaggtggtacctgggaaatggaactgcagggatcatccttcctgcaacacagagaagagcgtagagaagggcataacatggatgtgggagaaaagaggcaaatgatcaacacactgtatacagtgacttgtccttcatcctaagagcaatggggagtcattaaagggtcttaagcaggaagtcacaatctaataggcattttttatatctgcagtactaagattgcaatagatggtcatgagggcagttataagacctttgcatttgtctaggcagagattgtggtgacttagaccaaagtcacaggagaggagggaagtaggctgatttgaaacacatttaaaagttaggcttgagagaacaagacactgatgtcccatgagggagtcaaggatggcacccaggtttccattatgaaaaacaggggaaactggaagagtcatttgctgagatggaaaaaacaaggaggaacatatttacaagaaagatggtaacttcagttttgatgcaagtcatcaaaatggtggagttcaaagaacaactgattatgtggacctggagctcaggagtaggatctgaatggggacacacattttggaagccatcagcacatgcctggtatctgaaactaagggaatgaatgagatcacctgaaaagattgggtatagtcagaaggggtctaggtataaagatatactaatatttaaagaacagataaaagagaagtaaaacaaaagcatcagaaagaagtcaacggagatgtcagaggaaaatatgtcaaggagaatatgacgccaagaaagagagtatctcaaaaagaaggagcattctacctgtgaaatgtaattacaaaatcaaggagatcagagctaagacatggccttagtgagtactatttcccgagaggctgaagagaaactcaactgaattgtgagatgaggaaataaaagcatgaacaactagtataaatttgcttgggaaatggaagtgacaaataaggcagtagttagggatgggtttcactggacaataggaagccattataaatttttgagcaagataattatacaatgaaagcaagactttgaaaatgtaattttcaccagattgtgagaacatatggggtagcaaatatatattcacacccccaagtttcattactctgagtgcctactgctttgatttacagggaatgccaacattaaaagactcttcttactcaagtatatccaagggtccccaaggatgctaaaatgaactcatcctggtcatcacttgctaccatccccatcagaagtacccactcacggccaagctgttggccccaccaggtccaagctggtgccatttaaatctccttgttctcaccagccggtcttggttttgaaggttgcaactaccagtggtgctgccagaaaagcgcccacatcactggtgctgctgccagaaaggatggaacttgcagcccatcaggggcagggacctggttaaactggtcatttgtgctgaggtctaatggacaggcagagactttcctaccaaacaagaacaactttctctctctcacactcagtgttatgtttactaagaatagttgccagacactaagtgttgtctgttggtcaggaagttctttatgcactttaactcatctaattttaacaacaaccctctgaggtacacataggatttttgtcttcccattttacagctgaggaaactgaaacatggagaagtgacatacttgaccaaggtcataaatctaatagggagaggggcaaggtacatatgcaggcaggtctgctgtagacgccaagttcgtaaccaccactctgtactgccacttggactttgtgctaacactgcccctaccgcctgccagactcttcttcctcttgtagtatatttccttcttgtccctttttctgaaatttggccacagattctactccagctcatcagaaatatttttatagctagttttatggtacagacaaatggtctcaatcccttagtcccatgcaaattagcaggtacaaatagactgtagaagggaaggtggctaattctactcaccagcaacacttaggccccaaattagccaggatgtaagtatatccaggaatcagagtggcctgttatctaactcctcctaccaggaacagaaggaccaggactcctacagaaccaaatgtcctattagccaaatatccatctggccaaggtgtgttggaggaaccggagtctctctcctcatccatgtaagaatatcactagtgtgtctgctattttgcctgctaaccaagagcagaaagttttaggtccatagtaatcctgttatatttaccttttctctttatagagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatgtgagtccatcctttaagccctgctcaggcatttccccaatgtagaactttgtccacaatttctacctatctgtgacatgaagagaatctacttgcagagagttccctgtctcaagccctttggcacattctgggtcaaaaattcagttcatggagagtgaggaatagttgaactctttcatttctttgaaagtgggctcacaggagagggctacccatgtggcagaacatataccaagtactaaatgagaaaacatgaaaaatactaagcatagtgcctcagagttggtgcataatatctgttccctctttcctttgtaccattatagatttaatccttcaagtcccaaactgtgcacctgataaatgccccatccgtgtcatctttggtggggagatgcataaatgccatgccagagactgatgtacatatctgccgcacatcccaatcactctaagcctctctaatccaccttgggatcttcctacctcacagggaggataaagattaagacatctcattactttggctttcaaagaaagccgggttcaaggaagcccagacttaaagagggccatctaaacagagacaagtcttagtagctaactggttaaaaaagtgaggtaatcatagacaggatctggaaagagtaaagagaaagtcgccttggagattgtacacatgttccagacatttaaatgatccattggaggtaagaacttactgagtatcagagttctcaaagctctcacgctcctctgagctcacctacataagccacaccatgtagttgcactcatcaaatgatgtcttttcattactcttatatactagcctagaactaatacagctttcctatgatattatttctctgtttaacacagtctcctccattattcaacctttaacatacattgaccagtccatgtggacatattccttgctccaaagcaaaacaaaaagagcaacaaaacagtacccaccctaaaatgtttttcagagtagctggaagtccctactcagacccttttggaggatttgtagaaaaatagctgtttttcagaatctgcatgcatcattgggatattatccagaatgggcactcttcatagatcagctcaagagccaggaaatttcttcctgacaatcagaattcttaaggtcctgggctgaagcagtggcttgcctcttttatattccagataagaattattctatccagagtgagaaagataccaattttgcaccaagtccatgggactgaataccccaaaggagaaataaagaacattaagattggccaggcaaggtggctgacacccataaccccagcactttgggaggccaaggcggaataactccttgagcccaggagtttgagaccagcctgggtaacatggtgggacctcgtctctacaaaaaaaatgaacaaaattagccatgtgtggtggcgcatgcctgtagtcccacctactcgggaggctaaagtgggaggattacttgagcccaggaggtcgaggctgcagtgagctataattgtgccactgtacttcagcctgggcagcagagtgagaccctgtctttaaaaaaagaagaaaatgttaagatcactgtgagagcagcttgcagtgtgctatttggcccagttccaacacaccccaagaatttgttgtctcatcgtgttactcagactcctctagacatagcctcaaggctctcccaaccagaatctccacatctaccttatattgtcacaggacatgaggtcttctctgatccctccagaccactcggctctcatccctctaggttgctgctctaacttaccatccaggcctgttggggtatagcaagggagaggaacatggttcttacactacatgccaaaatggagtaacaaaaattgtgataggtggttttcattttttatttttagcaatgggtatttgattttcatatttatcaaattcacacacaaacaacacaaaataattgttattcagaagataatttcagatttattccttcaatagtgacatttcattgtatatcatagtagatgtggtttggtagcgggattcaagttttaacttgtatgatgaaattcttcttttgatcctcatttggaaataatgcccagagtgtaaacatgaggcccctgtgactaaaactttggccagtggtcctcctggactcttcctgggctcttcccaaaagttcgtatcaactacagtcttcatttgtcattgaacctgatatttccttgtcataattctgtattcattttgcattactttgctctcattttattcttcaatttttaatgttaaatacaataaaaattgtgtttcttcacaactcaatgttgtgaaggccatttcttcacaattcaatattaaattgacatgctgttgcatatgcttctaagtacccacacagggcctagacctcaagaattccataagtaaccaccatcatttgtcttcatactgctgacatttgccaagtattcactaccaagcactgtaatactctgtatctttatttcatttaattcccacaatggtaatatcattattattcctttctcacagagacagaaactaaggctcagagatactaaataacttgacctacactgaccaaacagatccaaatctggtctgcctgcctccaaagcttaggctctgcgacactgctatgccacccccaagcatctgttcactgactgatcagagtccaagagtgccactttttcaactgaccctaaactgaattcccaactccttatgataattaggattttccaaagtactgcggaggcaagacttgatgtcctttggtttccacttttgtttctgttcttatctcagagacataagttatttacttttctccttacttcatgtcagtgggtcacttcagtttcagaaaaagagaagcacaatatttaaaatatatggacagcagtatcaacaataagaaccttcacagacagcgaccataagccataggaagtgaaggctgtttctagagagttaagtcagagctcagtccaatgaaccaaactgcagtcagcaagtaccaggttacttactttctcttcctggaatcaggctgcaactaattcagtaacagggtttaagagtctagagttagactaaggaccacaggatacccctcttctcccctctatacccattatggagcttgcctcacctttcttggaagaccattgactaaaccagaacattttctgggctccgtttccattcactttcaattctgtgtatgttaatcatttagccttaaaaaaacaaacaaacaaaaagaatcccttaggccaagagaaaatgacttcctggcaattcaattcacttcccaggggtgagagaagagaggagagcactcttcctaacagacccttctcatccaggttgatggggcaaggttcagtccctgtataataggttggaacacctggcaagactcatcctttagcatcaaatggagtctttacctcctccactcccctagccacctttttccttcttaagaaggtttgatacttacttcgccacttatatctgaggttatgtcaaggtttaaaaaaaatacagtcaacttaatattgctgtgaacttgccccttggggaaggagggaaaggtatgcatgtgtatgtacaattttttttttttttttgcatccaaaaaggtcctaacgtaaggcttattcccattccacaagcctttgcttccaaacagaagtattacctttcttgtttctacatccagagtattgatatactactctggggtagaatatttatgggtatactcgtggattgaatatttatcacctggatttcattcaaatccctctgtaagtacctctatcctgttgacaaggccccttgtacatttgggtttaaaggcaaaaccaagacagtaaagtgagcccaaggagagctaggctgcccagaggatgagttccattcttagaataaattaggtccttttgcagcttgcattgttctttggggcactcactaggaaactgttcaatatgagagagccaggcttaccttgcagacaagcacatgctgaggcctattgtggcccccagaaagtgagataataaagaacaggaaagaccctggtaacatttccggcaaattagctggcctcctaatagcctgagtaccaaagagccagggaataggggctggctgggaactaactacagattttgatcccctaatttatgtagataagagaagcaaataagttctcatttgagtcagcgaacagtctggatcttccagtgatttgagtgtagacgaataggaatatgtcctactcaggtgtattaagagatagctggatcaagatgggagaaggaaaagggtcgagttgatgccagctctgtaaattattttcacttaacagcaaggcttagtctcaggtgccttcctccccacattcaggttgtggcaagatggtttccccagtgagccatccaactctagtaatatatatacaagttgttatattcatttacagtaagcagcattaacccttgaggttagcctcaagggcaggtatgatgtgagaagaaaaaaaaaaaatctcaggaagaaactcatcatttctaccctgcacaaagacagtgatgtatttgctatactggatctgagatgttgattctatttctttttgtatttttctagctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtcttgcctttgaagggtatgtcacaaagagctgacagtgcttctacacatttcatctaatttaatattcctggcatacctttaaggtaaattggtcaggaactattaattccatgtgatacattaggaagctgaattattagtaacaacaataataattaaagaatgcaatactgtattacatattttatccttatatatgttatttttgcacgttatgttcaaagtgcttttgttcagatatctcaagtgatccctgttaaataagcaggacagggattattcttggagttttacaaatgaggaaaccacgactcaaagagttaagtgacttgttcaaaattgtttagtttgtaagaggcagagccaggattaggtattccgactcccagagaatttcccagagaagcaccatggtattcattcattcattcattcaacaaatattaattgaacacccatctgaagcctttgtaatgcgtcagtgtggataggctgaaatacatttcccagatttcccttcctcatgtgtttccagttagtgtgggccatagtgaggactctaggaaaacaggagggcagaggaaaatggcagccattttgtagctcagcacactctgttgctgatgctgactcagctcactgctgtgaagcaacggctgggtctccaattgctccacctttccctggatcctccttcaggttctcagactcgtcctgggccaggtatatttgttaagctccatgataaaggctccaacttctgtacggcactttcatcaccaaggtcagaggcaacaagaatgtaagcagggctcagggtgtgcttgtggagttctacctgtgctgctgcttccagcatgctgtgatcttccctttatgatcgcccaccctgaggacttctagttctggcatcagctgtggagacatccttacaaagacaggttaaccagctccccacaactgtgtgagcctgtaacaaatatttaccacctatatatatttacatgcatgcaaatatatcactggttctgcttctctacttgaaccctaacacctattatatgacatgcatatggatcgtaatgttaagaacacagcagtttggaatcagacagcactgcgattttattaggactccataataagccaggacctgacctcactaggctcagctgccatttctgtaaactagagacggttatatagctaacttttgagcttattgtaagaagtagataagaaaatggttgtgaagagcctagtgctgtaactggcatggtaaacgttagttcacttctctcctcccagacctgtgcctggtctagtgccctctcctgaccctcagtctagaactcattccattatagcatattgctctcaataaataaccatactacccacatctattttataaatgaccccatctggataatttcggtcataaatatcaactataaattccaccaagctctgtgccttggctagcagacaaagctctgcgtcttctctttctatgtcagaagccagcccttcctcctcttaccctttggcaaacatttaaaaacttgatcccaaaagcattttggaggaagtccttagagagccagaagaaaaagcaatcgtctcttcccatctgacctggcaccattttgatatactgtgagcatcaagtgcaaaataaaataattgtccttgtaaagagtctagagctttactgtctagcacagtggctgctagccacatgtggctactgggcacttgaaccgtggctagcctgaatttagatgtgctgtaagtgtaaaatacacatgggattccaaatacttcatataaaaaatcataaaatagctcaataattattttattgattacatactaggacaatattgttttggaggtatcaggacaaatacatttaaaaattagtttcacttatttatttttacattttttaatgtagctacaagaaaattttaaattacttatgtggcttgcatttatggcttgcagtttatttcaattggagggcactgatctagaactatacaaaaatgcagggctttcagctagcattttctccccagcccccacacactcgtttgctgcactgctgggctgtcccagctccatctgcagtcattcatcttccttatttttgaccagaggcaatgtatttctgaatttggactcaaaagcaagttgcagctaaattaaaaatacgatagagtattaattattccacaacatagctgctgatgacacatcggtttaagaaatcatggctctgagaggcaagaatgtgctcagagacaaatatacagcaagagacactcagaagacattttttccatcactataatacttcctggtaagagatgagacttttctcaaataagcaaacatatttatgggtagctaaactcagtgcttctaaaccctttagacaaatctaaagggaaagaaaaacatcctacacttcctgtattataataaaaaccattgaaatcactcttccccctaaaggtgattatacaggtaacacccctaaagttgtacctcctggagtggcagttcagtcccatagtggtgacccagagggaacacacacacacacacacgcgcacgcgcgtgcacgaagtttcagattaatacaagtttgttttttctattttttaagtttgtattgcaaatctcaaaaaccatgaagaggacaatagctcccagagattacttaaagtacccatatctccatgggtaatactgaaaatatcaatacaaatactgatctctcatgatggatattggctttggccatcctggtgcaaaatgaaatctttgcctcctatccctgaccacacactggacctgctcccatgtctatttcctcagattttcactcatcataaatttattcagccccatcctggaaagcctctcattttgtcttcccttctccaccaactttcctccatatactcctttgactaaatcccaagaaaatctgacaaggtaggatcctccttggtggggttggagcaaggtgactgaatggataaatccagagtgaatgggtcagagtgaagagatgaactaggtacacaagttgatcaaaaatttttatcttgtcacatacagatgcattagttttggtgaaggggatggaatggggggcactggagagtactatttcactaaaagtctccatgtgctgatcatggggaacccttcataccttgtttctgcaagagcaaatggagggaggaagagaataagagaaaaagccccctgcacttgcatcactaagatactgcaactcttaccacaggcagcactacaccttatttaggtcagtatcacatggcattagaaaaatcagaaaaagatcattgaaactgatggccacaaccttcaggttcataaagtattttattaggaaagtttgtaaaggcacaagcagggaataaactttcagctactacatactaagggacattgaagaaagaagacaaatatataggatgtgttgtttgtttaaaatataactgaacccattaaagagactaaataaacgtccacacaaaataaagctcaactataaggtggtatttgctgaccctcatcaaagtgctttcagtggcaagaagcagaactcttattttaaaaaagccttaaacagtaaggccagttatataaaatgttccaggcttggattggcagctcaatgatctcaaagacccaggacctttccatctttttgctctgtcatctttggagtcttcagccatgtcttccctcatgatagtaggttgctatagcagttccagatgccccaagcagacatgaccaaatccagaaacaaagaagagatgtcttttcttctgtgcatctctcttttcaaagggaatagaatgtctcattaaaggccatgagaaagcctcctttctattcactatccaggactgctgccctggttgcaagagaggtcacaaaatgagcctctgccacattcagcctctatagtgaaaggcaagttctgtcagtcaggaatgtggaagcaggtactagaagagggggaatgaatgggtaggcaacctcatcctccaacgtgagccaacccaaatcctctctcatgggatgaagccagtgggattcaaggtcagaatacatatggcacctttacacctcacatctcctgtcttcattcctctgtcaccctccctccattataacctgcagtgcagctcctcctctccatgtagtctgttccatccctccctgaaacaaaccttagagactactcagatctaaaggcaaccattggagtcacacattgtccatgaaatcctgtttgggaataggaatggaaaaggaaaaaaagaaagaaaagagacaagaggaaaaagaagtaagaaaagaaatgcactaggataggaaggaggagacatgaggaaaagagagaatggcaagacaaatatcaaggaaaggggcaatgtgaaagaaagccatgccctgatcatgtccctttgtgcagatacttgtttatctttgtcttaagaaaacctttccaacttgttgcaaagagttcaattcaaaacactgaatgagctcagttttagatcccagtagaaaagcccaatggacatatcatgatggtctaggtttcccagggctctacataccatggtgtggggcccccagatctagttcaaaaagtgagacggagtctaaccaaagagataagggtcagtatttggaactataaaaatatttggtgttggggtaaattatatcactgggagccacctagagaaatcaaaaactaactctgaacaagcccacacaattctattttccacttatgcattccctcattcaacaaatatttattgagtgcctactttaaaccaagcactattccagtcactggatataaagtagtaaataaaaaatttctgtccttggagactctatattctagtagaggtgaccaatgacatacaaactcagtaaaatgcattggtgctaggcagtgacaagtgctggtgacaaaaaataaatcagggaagagggatatgatgtgcgacattgggggcctccctgagaacgtgacttgagtagacctggagggaatggaaagtgagacgtgtggatactgagggaagagtgctccaggcaaagggaacagcaagtgcaaaagcccagggacagtaaacctgctttgctccagaaaaacaagatcggtgtggctggagcagagaaaaaggggtgagggagagtagcaagaaatgaagacaaaaaagtacaggaagctatatcatttcaatttctctatttctaaaagggtggaagcagggtgattaagaataaaaaaaaaagacacctgaaaggttgtaataagtattaattgagcttgtgtgtgtagattgcctagcctagtatttaacactaggaaattttgaatttcagtcacttttcatttcttttaacagcttgctgcacctaatcctcccccttttccactctctcctggtttcccagccctcactctaattctctcctgccatcatctctccaaccaccccacagcaaagctgctctcctgtggggctgtcactttctaaagaatatgatacatggttcacaccacggtgataataatctcctatatttcaatgggttttttttacaaattccagaagactttggcttgcattggctcattagatcctcaaaacattcctgtgaggtagaaaggaggacagggtttccttgttataaaagaagaaattagcattcaaaggttaagtgacctctctaggttgtgcacctatacaatgacagaataagcgcagaattcaaatcccttggttccagtctggactgtctctttaatgactgtcacaactgaatgtgtccacttcccagggtcacataaaagtagaggtattggaaacaccagccttaacatgaataagggcagcaacctagttcagacacttctggcagcaagaccaggccagcagctgaccagggactgtattctcacacagctgatgctcactgtccatgctgaagccttgatgatgtgaatttaatcagatgaacaaggaaaatagagtcacaaagcaaagcccagtgatccagtgagcagagctttttctaattccctgtaataccttttctcctcctgatcccaagcacagggcaccccctgactggcacgcagttgagctcagcagaagccaggaagagagaaaaataaaagtcaatgaaatgtactgtggctcaggagagccctaactcatgggccaaacttgactgtgagccagtgtagttaagaaagaatttgacagctctaaggtgtttcctccagaggagaataacctttaatttaagcatgtctttgttcatccctaaaagagaccatttgctggaagagaataagaccattgcctggccgtggctattttctctgctgcaatcaggcattttacatttaggtgctggtttgtaatgaagcaagttaagggcagatatgtggtccccttcctggacaccatgctttagaggaccctgctctctcttgccctcctctggccatgccttacccataggcaaggaatctgggagcccatgaggccaacggcacatgagcacccaaatttgcactgaacatgttctgatacttgaggccccaaaatctcctgcctgagtactcaaggtttgccttgaccctctccacccgagggtggattacacccacagtgtgcacactacaggcctaaggatggctgtttgcagtgtgtaaatggaactcagaggtgcaggctgagtggcataatgcatgctcagtgcaaccagggcacacacagaaaaggagctctgcagggcagggcttccatttgtacccttgcttgagtcctgaagatgtgagtggtggtcttcatgaagaagtagagatgagtcagtgttctccctcgccgactgctgagaaaaccattcaaagcacagcttgcaggccagtgttgtcaccttcacttgggacacatgcactttggctatggctctgccattcagatcattccatatttattagaacccttggcacttaactcagttgccatctccttccccacttctgcaccttcctgatgacttcagcatcctcatagatcacccagtctggacctcagcctcacaatgctttgacttacccgttcccagtgctttacactttaatagacctgggtaacttgtagcgacaatcccaatcctgaaatatccagaaatcgtcccctcacctcggaaatcttcaccttcagaagccgactccctcctcccttgctattctaccaacctcctcaactttcctcctggagcatgccttgccttttaggctgccatgcctttgcttatgccatgtgccctgcctaggccctccctgcatttgtctgctggatatgccttctttatctataaaactcagctcaaatatcacttttcactgaatgtccatgactaagcactaggaagcaggcaccatgctaggcagcaggattacaaaattagtaaagtatcttccttcccccacacagaccaactcaggaaatagacaagtaaacataattccatctgtgtggtcatttgaacaagttactatgagagcacagaaggttttaccaaattcagttttaccaggcagggcactgtgcccaatgagagagaaggatgccctgcctggagttttacacattcatttaccttcttcaaaacaatatattcattggaggcaaaatgggaatagcccatctgatttcttctactgactggcatgcactcagacagaggttcatcttaggaaataaaggagctaatattagttcagctcttatgatgtgcctgtcaaagagaaagtttcctcaacctgcctagggttggcagagaaagattaataggagaaaacgtacgaatttatttgatcaaagttgtacacgtcacaggagctttaagaaatgaagacccaaatatcaaggaaaattgtccatttgtatgctcagattcagtgaagaacagacagctgtgtcaaatttgattggacaaaaagggtatggtctaatggtagcaggcagagggaggaaaccccgcaagacctgtctgttcacattcttctttgcctctctgtgtggcagctctttctcctgggtttagggcaggactcattctggaatgagggtctcatgatcatgtatcagacaagttaggtcagagaatttctttatggccagcccctacacagaaaggcaggggaacgttagagtaatatgtctaggttttatggctgtctttagggaagagctctggtttctatgacccaccttggggaaaaggaattctagtttctctggtctgccttggggaagaaaggagagcaggagaaagaaaggtgggagaaggccagaaagactttgtttctgaagctctttcagtttccttcagttcaaagcactcatcacaccaagacaccatactgtggggtatcacattctgagccctaacacttccaatattatgctatgaatttacatcatgatttcaggtaattattccaacaatgccacaaggtgagcatttgtgttatccagtttcacagatgcagaaactgaagtggaaaaaattgactagcattatatggctggcaagtgatcaaacaggattttctcattatttcattcactcaatagttattgagctcataatatatgccaggcattatgtcagacttcatggatacagacaggtacacagtaaacaaggtggccactgcccaaatggagcttgcattctggtggggaagacagataataaacaacaagaaagaagcaatataacagattgggacagtgctattaatataagtaaatgaaggagggatatcatcaggagaatctgggaaggagtggatgctacctgagacaggatggtcaaggatctgcctagttgcaaagcactagactttccacaaccccttctaccctccagtgggcctctgcagtatatatggcaaccaattctggtttcatgtattctaccacttactccaactctagtaaatatctgcaaagcttaccattgcctacgactctcagattatttccccaagatgctgcagaatccttataatgtttctcagcctcaatagaatgaaaagcaggtctgtgcttatatcacttaatgaccaaagaggaaggaaatttacaattaaagtgtactttgccaactgtggatgaattagttaggtcactgtgatctacaggttagatgtctgttcagcagtgtcctctacttgagattccaaggaggttgaagctcactactcgccacccctcgcacccccctccgttctcttctttcccttacctgcttcctcacactgattcaaaatctcccccatggcccgggcacggtggctcacacctgtaatcccagcactttgggaggccgagccaggtgggtcacctaaggtcaggagttcgagaccagcctggccaacatggtgaaaccctatctctactaaaaatacaaaaattagccaggtgtggtggtgggtgcctataatctcagctgctcaggaggctgaggcaggggaattgctggaacccaggaggcagaggttgtagtgagttgagatcataccgttgcactccagcctgggcaacgacagaaagactccataaaatgaaaaaaaaaaaaaaagaacaaaaaacaatctccttcatatcaccttcatatcagtacctcacaacacctgaaatccccatcctatcaatcagatgcatgatggtggaaagagcgtgaaacatgtccaaagtcctagtttgaactagcttgaagtttgaactctacccttcaccctgttttggaaagaatgtgtgagttggagtatgtgaaagaatgtcagaaactgcccaaacatcatgaatatgggtccagctggaatacaaatgttgttgggaacagtctctaactaatgggatttaattagctgagctccttccaccacatcactttacccttagggaatgggtgcacacagcgcttgtgtgatgcagctggaagagtcagggcactggggagccagagtgaatccatgtggaatcagtgcttactaggcagccagacgggcagcattaaagctttggggacgtgggtgcttaaggagaagaaacagccaaaaggaaatgaaggagcattaaacagcaacccagccatgtcacgtgactcacactcctcctgcgccagagcccagtgtgagcccctgtctgacagtcagtcacagaggacccagcagcaaggcatgattatcaacagaaatcagcttagcaaaatgcagctgtaaccccagagggcacaactgtgaccctttctgccaacattgttcaaatgcaaggacagagatggttttccagaaggcaatgactgcaagagctgtccaccccagacctgcgaagaaaagtaaagccatagggaaatggggactataagagataaggatataaggccttgtgatgctttggataaggaaagagatataataactttagatgtagacaaaatattttagttaggaatatatgctaaaaatgaaatggcaatgactgaatgaaaacacaataaagatagaaatagatcttttagcttctgaaagctaaaactataaaacttttctgtaaaactgtctttacaagtttatagcaagccaagatttcctagtcagaactcaaaaagcattaatatataaaaaattgataaattgggcttgatcaagtttaaacatttctgttcatcaaaagacacattaagaaaatgaaaaggcagggcaaacctgtgaaaaaacacttaagacacctctaacccaggactcatatccagaatacataaagaactcctgcaaataaacaatagaaagataacccaacaaataagggagggcaaacacatctactttaggacccagcagctcctcttctagttacttacacaagagaaattttgaatgtacataacaaaaaggtatacagcagccttattcataaaaaccaaaaactggaaaagcacccaaatgtccatcaaaaggtgaatagataaataaattgtggtatatttgtaccatggaatactgctcggccataaaaaatgaataaattactgatatacagcacataatgatgactcaatctcaaaaacactatattaagtgaatgaaggcagagccaaagagtaaatactgtatttttccatatatataaagttcaagaacaggaaaaactgatgcacaatgatataagtccaaaagcagtcatctcagggatagagggttgactgaaaaggagcactgtctataataacggaaatagtctatgttttgtgtggcagttacacagatgtaaagaattatcaaaccgatcaaatgaacacttaatatctatgcattttgttgtatgtaaattatacctcaacttattttaagtccacaaaagaaatctaactgtgttcctttagtaacaattagaaaatatagtagaaaaagggaaaaaaatcctcacaatagcaataactgtaaggtacccaagagtacatacaataaggacaagactttcacaagaaaacgtaaaacttattgagagaaggcctaagtaaacgaggagataaattacgttcatcaatgtgaattttcaatactacaaatgtatcaattcattcccaaatgaatgtataaattcaatacaattcaatgaaattccaaactttacttcatgggtagggatttatagaactttagagatcaatttggctatagtaaaaatgcgcttatcggctgggcacggtggcggctcatgcctgtaatcccagcactttgggaggccaaggtgggcagatcaaaaggtcaagaggtcaagaccatcctggccaacatggtgaaaccccatctctactaaaaatacaaaaattacctgggtgtggtggtgtgtgcctgtaatcccagctactcgggaggctgaggcagaagaattgcttgaacccaagaggtggaggttgcaaggttgcagtgagccgagatcgcaccactgcactctggccaaatatgccccaaggaagacttagaatattcacttctgggaatatgccccaaggaagacttagtcttatgcacaagaagacacatatgagaatgaccattgcaccattctttaagaaatgccaataaatatataagttgcttttaattatttctgattgttgaactgtttccttatagttgaaaaacgggtctgaggctgactttttggattcaatgataaatcttttgtgggataatttcatggttaatttttaaaaataaatctttgtgtactcaaaataatgtgcattctgtgtttgttcattatttattcacctttcctcctggagtcattgcatccttttggatttaattggatttaattgcttcatccaaaattcacttaattcacttaactccaggagttctttcaaaatgatagtaattatgtgtatttcaatttcacattatagtaataatttggcccatcatgaaattttagttttactgtcttcttttcttcttcaacactttgaagatattaactcattgctttcccacatctaatgtagctgctgaaaactatgattgtaatctaattttcatgttccttttgggtaatatgctttttatcttgaagccttttagaatgttctatttttaatattctttaatgttactgtagaacatttctatgtgaggaggtcacctctcctgttcagcactctgtgtcctttccatttgaggtctatttttcttcctacacgatgctcttggaaggatacttacacttcaacttcagtcctccatatttgttgacttgcattctttctatctctttatccttttccaatgtcttctgaggaagttcccggcctcaatatttcagtctactgatatattattttgctgtatgcattctgatatgtggcccatctattgagcaatctcagcaattatgtttagaccctcaatatctccaatttgttcttcatattttcttctccctgtttgtttcaagagtctcctttatgtttctaaggataattactacaccttcttttttttaaattattgtccattctgtttcctctggtttagcttatttattttgttaaattactttcacggaactcttactattcacatcttaccatttttcctcgtaagctcatcttttatttctttagactattgactgcttttgcaaatgatgtctatgtgggagaggggtaaacacttaggccttgcccttttctctatgtgagttggaggaggatggtcttcaaggcagaaagtctcaaaggttgcaacatgaattcagccatcctccaaaccccaccaccactccaccaaacactctctggcctctcatcaccaggcgtgttcttaagaacaaaaagcctgtgtaatttcctactccacttggtggaaggagaaggcaagaatgctcaggggacatccaggtgttgtcactactagcttcacattttgactccagagctgccctgatgttaccctgccacttctgcctgattctgttgctttcctgcccatagatctaggcaaccggtcacccagagtactgtggggaaaagaaaggaaacactagaaagctttctgccacccggatgtctctggctttcctcctctccaggctgtcgtttctcccagcctggcagccaaacacattcatcttcctaagagttctcacattttcatgttagctaataaaaatggttgagatctgccagcgttttccctgctgctgttctccattgttgggttcagaaaagaaaaccaacaatttgcaaagacttgagccatgtgggactccaaaaatagtaaggctacataacaaaaactttgtcattaataccctatctcttacaatttattttaaaaagtttatcttggctaagtacagagctaagtatgttctagctgaactcagcctacacagctttcctgaccatcgtcaaaccaaagagagagtttcagaatcaattgagtttgatcaaagttcaccaggagtactttagagagaatatttgactacttttagccatttctcagggcaggcacagtggttcatgcctataatcccagcactttgggaggccgaggagagaggattgcttgaggccaggaattcaagaccagcctgggcaacataggaagaccctgtcttttttaaaaaaatgtttaattagctggttgttgtggtacatgtctgtattcccagctacttgggagactgaggcaggaggagtatcacctgagctcaggagttcaaggttacagtgggctatgatcatgccactgtagtctatttctagcccgagtaacaaagtgagaccctatctcaaaacaaacaaaacaacgaaaatttctcaaaggcagaaactcatgagaggagtgaatagacagtcacaaaaccatatcctctatagggtacagttcctgccataatttaattcatttttttctctcagcatatgctttcaaactcccgtctctctttagctgttcctttccttccaggaaagatcaaatcttcatctattttgattctattctattctaataagaagatatagaatggttaggataaagtctttcatggcttctcctatcagaaaggatacaatccagttccttcaagtaattctgggtaatcactaattactctgaaaccgagcaagacgctttctgtggctccattatggaatttctggattagagaggacagaatcaaattccttttctctgccaaaggctatttatcatttgaaaagcatcctgtgaaaaactgagaaaaacagttataacttgagcctccaagaaatttaccccactaaggacattattttctcctagtaaaatagtatcaatttataagccaaataatttatttctgcataactggctaagatgtccctcatacaaggccctttgattaagcatgaaataaaacccactgccattatttattatattgactctcagattgaaaataaggccttaacattgaataaagatgtatcataagccctccttatgtccctcaactgtaaaattggaacacaagaccatcatcatggctttttatgaggcttcagtgacaactaagggggttcaactaatcaataataataatggaattcccaacaatgaacatcttctacttcacctttctgtggctctagacacacatgcagacacacacacaccccacaatgcctttatagaacattttccctttcagttttttcctctattcctttctctactctcagtctgtagcaaagactctcactcccggttctcccagtgagagaaagatcttttactaagactccatccacgtgaccaaggaagaaagttaaaattagaaaaaaagtagaccaagaccaaccaagattcctcagtgccttctttcttctcctactgtagacacactacacctccacctctttttccccaccactaaaagaacaggaaaaggtcttggggaaaactggcacagccgctgacaaggtagatatcatcatctcccattttacaggtgaagtagctgaagcccttggaaggaaaatgacttcccaaatatgctacaagcagcaacaggtgaactagaatgcagattttgtgcttcctaagacagtattctccccatttcccccactgtaggtttctaaccaggtactcaagtgttctcagttcatcatagtctgtatagtcagaaggacactaacattccctaatttttattacttcaagtatcaaccatttcacaacaccaaaaaagcttctctatgtcaatgtaataggtttcaaccacctgcagtcgactgtatgccaccctttgttagtgggcagcttgccaggctaatacaagatcaccatctagtggtgaaatcaagtaactacaggctacacagtaaatcagattcttctctgcaccccccacatctaaccccaagcctatgggctaagccactgcttatgttattttcagcaaacttccagaaataatttacaaataaaattgataattttccattacataaaacatgacataattttaaaattcttttgagatttaggcatctaccaggtcaatataaatatacttagactcacatacacataattttctacctgcccagctgattgctcttagcagcctgcagcttgacatccagtgaggctccaagtgaaaactagagatgaaccacattgcagatggttgtagataatcacaacttcaggtaagtgctggactctactttcattaaagttgttccagaggcagtatcagaaagtactctccaaacaaaaatagctgcttctaaaaagaatgtgaatgttgatttcactcccaaacaagtatttcttgaacatctattataagctacaaaaaataatatgaagtatcttagataagcattgaacggtcctttagcaatctagattctgcccactactcattattttatggaacctgctaccatcatagtaaacaaatatacatattttaaacacaaaactctataatcattttttaacacaatcaccatgagcttctctgccgcccttaacaccgttgacaaagtactcatcctaaaagcctctcccatttttaattcttagacctgcacacctctgataatgcttctagtttttagtctccccatgcctcccaacaatgtatgtatcctccaaggatataacctggggctccctgtctttttttgtctttattttcacaatctatcacatttatgattttgactatagtatccgtatatccattcctgacgtctactctaagctctagtttaacttttttttttttttttgagacggaatctcgctctgtcaccaggctggagtacaatggcgggatctaggctcactgcaacctccacctctcgggttcaagcgattctcctgcctcagtctcccaagtagctgagactacaggtgcaccactacgcccagctaatttttgtatttttagtagagacaaggtttcaccatgttggccaggatggtctctatctcttgaactcatgatctgcccgcctcggcctcccaaaatgctgggattacaggcgtgagccaccgcgccggacctagtttcacttttttaattgtcttgtggctatctcccaccggaacttcaaactcaacgtacccaaatcagagatcacagctttgctcccaacttcatttctctttgctcatcatttcaatccatcaggctccacacttcgctgttactttaactccttcctttcccagtgccctctatctaatcagttcccagggcagtcagcactacatctgcactgattgctcatcatcccagttttccatttctctccagggtcactactgtgattcatgttcttattctctcctactctgaccacatctgtcagcacatatttgttctaagcatatttttgaagaaatgaccatataccagacactgactaggtattgggaatatagcaggaaccaaacaagacaacagccttcctctgatgggccttatgtgttattgtagggaaagaaaaaacaaaggaggagcaaagaaaggcatacaggaaaacttcaacattctctccctcaactcttttattcaacagaacaagatgctctattaccatctcatgccgtattctgcactaaagtgaactgtaatgaaacccagaaaatttgagagacattttacatagctaatggtaaaaaagaggaaaagcaaatgcctatattgtttccctaaacctcaactcttgcttaactttataaagtcatttttatatgttaagaaacaactcctaaacatttgagggaagacggagttaattagccaaaaaaaaaaaaaaaagtgtacttatgccttgctgtagctaagactgtgaaacaacaagcttttgttactaggaggagaattagttgtgtgtgcctgtttcgatcatttcgttggaaacctaaaaatctaaattatgggtattatacttgaaaggattagctcatcaaattgatgcttattgagcctaaaaagcaatcaacaagacttgtgttttttcatagtcccaacattaattgctgattttaaggacttatatacttgagtgattgatttatccattctttcattcattcactgaacaaatgtttataaaatgtctactatgcgccagggatggggctgatttctggggtagagaaatatgatgttgtaattatccttaagaaatttgcattctagcatgacaagaaattgtgaaacaatgagaaagatgaaagctataattacaaatcagacaaggttctacacagaaggttctgtggaagacggtagggtggagtcccacaaatgttcaccaaaaagagacacctaggttgggccttgaaggatgaatgtttttcagtcaagaggaagaagaatgtcacagacagaaggaagaggatgtactcagagcatggaacagcagaacattttccactggggcaactgctaatagatgacatgataagagctcctacttcagacgacagaggaggaatggaccagctaccaaacttgagcagaaatatcaatatggtatcagacttgcacaaaattagcagatattggccagtttccggtgttagcttgtttgacacgtactcaaatgaccaacaaccatgcaatatgaatagacatatgcatgaatctattccagtagcatcagtcagtggtaaactttcagacttgtgagtctgtctttaaccacttcacaattcctacacaaccttaaattaacataccgtgaatgtgcttggtttgtctaaggcaaccatgaatttattaaaaggaatttttgttctccctgccagtttgtgttatctagtatttggctgtttgtgttgttaccacagcaacatttggacagataaatttggcacagaacatgtggtactgctaaaataccgctttatgaagtactttctggtactatttccaccaggatagtcaaagataatgtaagggagccactgtctgggcaggaatcaaaacagaaaaggggataaaaaataaggcactgggttagataagggcttcgtggaccatgtcctgtagcaagtgatcaatagttctttctggaacagtctctgaggcaaaccgtgggttaaatgatgctaataatgccaacgtgaacttggccctcccaaaggaggaaagggtagtcaggttttccaacctaattggccgtcaatcactttttcacctagaggctcagtgaccttccaatgaaacacacatttaagaaatgctgggttagataatcttatagcttcaaaaaattatatcaacagaagatacttaaatgcatattactaagcaaaagacgcttatcttaaaagactacatatcacatgattttaactatatgacattctggaaaaggcaaatctatggagacagtaaaaagatcaacagttgccaggggttagggatggagagatggagggaagagcacagaggattctagggacggcgaaactactccacatgataccataatggtggacacgtccatttgtccagacccatagaatgtacgtcaagagggaaccctaatgtaaactatgggcttgggtgataatgacatgtcaatgtagctccactgactgtgacacatgtgccactctggtgggggaagctgtgggtgcagtggggaggctgtgggtgtgtggggcagagagtatatgatactgccctaagttttctgcttaattttgctgtgaatctaaaagggctctaaaaattaaagtttttcaaaaaaaattatattacattctacatggaataactacaaaattagaggaacatcttctcactgagctgtgatcctcaaggtcccttttctatatagtaaaaacagtatttggattttgttttgttttttcagttacagccttacctgcatttttaaacacaactttcaggtatttggggactacattattaccaaatcttggctttgggagtacat

SEQ ID NO: 1768 - DNA, 95593 bp, Homo sapiens
  FLJ46536 gene - 218725217 - 218780809 of chr2; NCBI Entrez Gene ID: 285180; Build 35; sequence includes 20,000 bases upstream of initiation codon and 20,000 bases downstream of termination codon of the gene
ctcccacagctggattatgggccagtaggaattgccattttcagggttttgctgtcactgtagtcaggaccatgaagtctttaggcacctccactccacacaccccctggtgagagctcccatctccctgttctgaaacagctccccaatatagtactgattccggttaaacttgaacccctgcccctgcccctgcccctgatttacatgaggacactgaggcccagaggggtaaagtgactgccaggggtcacacagctagaaagtggcggtgccagaactggaaggaggccctcattcctgagtcacggcttttccatagcacagccttatagccagaaaagcagagagaagggagaggagggagggggagggggaaagagaggggaagaaatgtttctcctttcatagatatcccaaggaggtgagtccctaagttctctttgtccccttcaccactactagcccaggtctctgatctctgacaggcaggaagttcctgttgatacctaacctccatcccccctttcaaattccagaccatttcctcttagtctgtcttgcctgaggaaggagaacagcttgatcactctcttctgcacaatgaatgccttcagaccctcgcagctcattattcaagcccccgtccccatcccacccccacccccctttattctcagggctgagaatcccaggtcctctgggcccctttccaaatgacttccatcaccacccagcagctgacatgataaacggggggtgggggcagggtgggataggcctggagtgatggtgggtatcgatccatggggatcccacaggccagagcatctggggatggggagtgggacaggggcctggggtcgtcttgattagccctctgccctggtgtgttccttgcagggcccagcatggagactgcagacctaggagctgggcgctgggtctgagcccaggctcccacaatgagattaaagcagggactgtctaattgattctgatggaactaggagagagagtgagatgaatggaaagtgcaggagaaggaggaaggagggccagggaaagggggagggcaggggagggcccagtctgggaagcccggtggcatcagcactagctaatacaattaccatccacccccacccccagccgctcccactgcagccccctccccttcctgggaaaccagcccactggccagtctgctcctgaactggacagagagggtggttgggttgagaggcacaaggggaggggagctgagttaaagctcccagtcctgggatccaagatgatgcagagaggctgcgacagtgacagtgactggcagggagctagagacaccaggagggagagataggaacacaggggagatacagatggattatcaggtccccgcccacttcaggtccatctatccagcagctcccctccatctggctcgctgccaccccacccacctctctccccttggatcatctcactgggctcctccccagggcccactcccagacaatggttactgcagtgtgagaaggagtctgggaaatagaaccccaggactctccagtgccccactcagcccggggccctcagtccatgccctgcagatagccagagaactgtgataagggctgatggccagggggacccaggtcacacagacagatcccaggtggacccaagactcagatgaggacaggaggaagggaatggacccccccagaaagacaatccaaaataggagaggcactggggctgagacctggcgtcaaagactggagatgtgagcaagcgccaagccagtgtgagtggtgagaagaaaacaagcaaagcagcagggcaggaggaacatgaaaggaaagggagacagggaggaaggtgggaggctcctgagcatccataaagagcagcgagtggcagtgaagggccagcatcctggagaggggagaagagtaaaggaatcaaagaacgaggagagaacgcagctggccagccagggaaactgaggcacaaaacaaggtagacacagcctcacattgaggctccagaagcaagcatgcctgggagctcccagtgactcctgcctccccaggctcagaccacggaagggacaaacccagtggggagtatggactgagaccctcaagaccccagctgcagcccctgtgatcaggagccaccctggccaaggatctcatggaacttgattccttcctctctttcccaccccaaggatcccagacccctctgtgatccacttgaacttggcttctggcacattctatgctcactctggctggtggctttagggcagagcagagcaggcccagccccaggcagaccacagatgaggaggtatttgatggaacatcccttgggcagcctagccccatccctgccagggccctgccagccctgtggatggataagcctggggcactgcccctctgggagcctcagtgtcctcatctgcaacttggctgcttctgtgtttggttttctttcctcccagagcagttgagagcatgcagaagaaaacatgtgagttgcttcatctccactgtccccaccctcacctcccaaagagaaggatccaggtgcaaagccagcaaagagaccaaggtcaactcctggccctggcacgtgtgggccatgtgaccttggggagttatttttctatgctgagcctgcttcttcttctgtaaaatggagactaggttcctaacctcatggagtaatcgtgaggattaaattaaatgtgaacatgtctagcaggagacctgattcatcgaggtaccctcgggagctactgaacaatatctcaaccacaacccctcctggctctgccagctgcacactgcccaccccacacccactagacagacgctccccgccagagccctcagccagagcacactgtctggaacacacagttcacaccactgtccagggaatgaacgcctgagggagaggagccaggagtcccagaaggttgaggccaaaacagctttgttaggagatccagttagcaggctagaggagaggtagaatggaggcatatgaagaggctggaacccaagaaaagagaggaattggagggtacaatgcctctcagtccaagaagagaaaggaggaagcacagcaacaatttcctgagcccccgcagcccaactcaagacaaacaccaggaaacaggctaggactaaagcaaaaaatactcaagtcagacatcaggcagaacttccaatgaggcaccacacggccagagaggcctctcttttcaccctattattcccatactgttccccatgctcttcttctaaactccaaatgaggtctgagtcttcactgtcccatgacacagcataaaatctcagtatcaaaagccctggctcaacttagcaagaaaacaggctggccctgctggccctgtccccaaatctccaatctcacttagcctggaactcaccgtatgaattctcttccagaaaccaaaacctatttccagggccatcttagaccccatggggaacgaggccgcttctcacgcagacatctgctcccatgcctcagagccctttccccaatcaggcctcacctgggccactcagattgtccccttccttaagttttctgtctctgaggggcagactgaggtgcacaggctgaggatgtgaggcgggagctgggaagcaactggggaacaggaaggagtctgggacttggatagaaaggggacagacacattttctttgtgaagccaaaggaagaaagcaaacattggcctggaaatcgatgaattaggctgggcgcggtggctcatgcctgtaatcccagcactttgggaggccaaggcaggcagatcaccaggtcaggaatttgagaccagccttgcccgcatggtgaaactccatctctactaaaaatacaaaaattagacaggtgtggtggcatgtgcctgtagtcccaactactcgggaagctgaggtaggagaattgcttgaccctgggaagtggaggttgcagtgagccgagatcacaccactgcactacagcctgggcaacagagcaagattccatcgcccaaaaaaaagaaaaaacaaaaaaaaaataaaggaattatatacaatgtacacagacacacataaagcacatgtctcccgagggacaaggagggtcccctggaagataagggtgaaggctgggaccctatagacggggagtgagggactgggagagagaagaatggaaaagggaagagctggatctcccagaaagagaaaagttcatgctaaaggaactttctgaccattcgtggacaccaaatgacggtgctgacatgcaaactggatgcaaaaggacatgcaaatgaggtagcttgccagataattcttagtctatgtcaccttgactataatgaggtgacactttgggggctgccctgcaggtaggaactacccctaatcctcctccatgaccaccccatctccctggaaaaaacccctctttccctccaggcttgggcaccaaggaggaggactcacggggcctctttccacccttgggtctctttctaggcccttaggcctcctcatgcctttgccctgcccaccctaaacttcctccttctgcaaggggcttgccctttcgcctcagagcagggaggccctggggagagatttctgttgatgaaaggaagaagggagtccataaaggggaaatcagttacaatcctgaggtcaggtcaggatctaactccagtgcctccccagtgtgtcctgttctctgacttcacaccctggctgattgagaagtgcctcctgatacctgccctcccaccctcctgctggcttcaaacctcactatcctgtcaatggccccaagatcacacctaagaccaggaagaagagagtccagagtagctatccccctgcccgctcccccactccccggctgcagcctccccactgccctactcttttttgcaggtaagagagccaagcccagaaatgtgaagtggatcctccgggtgcagtgggtcgattgaacacacatgttgactctcgctctgtcttaagcccccactaaaacaacaataaggggttccttttttctattattgaagcataaatcccagagggaaaaaaaggagcggaaagagcaatgagagcgagcagatgttcagcattgtgcaggacccagccatggcggctgtgggggtgctaaaatatttctgtgccagtgggtgaacagccacagcaccccacaggcccaatacgccagcccctcccctggatctgcaggcctctcttcaattcagcaaggaaagggccaactcctggctcagcaggggacctaaggacccctccagccttgcagtcccgtccctaggatcactggttaaataacttgattatcacctctgacaacagtgtcaaaattctgggagccggggagtgacaggcaaataggaatcataagcctgagaacgctgacccctgagctgcctggggaaccaccgagaagcagccaggttcgctgacagcagagagcccccaaaggctgaggattggtggctcagatgcttttggggatagggtaaacatgatcctaaaacaggaaggttggtagaatatggaagaagaacttctgtgtccagctgtcatccctgaccctgggggttctgagttaaaggcctgggggctagcaaaaagtgagtgtttgctacctgaccgtgacctgccccaggcagaaaagtggaggcccaagagcaggaacccaaagatacagacaggagttcccccagtgaagcactcagccagataccccagagcaaccaatccccccttgactatccctttactaagggagcttgcagggtaagggaggagagcaaaggcaattcggacgaagcaagtgcaatgcaggaagaagctgcaagataagcaaccatttacgtcctcagcgagatgagagaagacaatgcatccacgaaacaagaacaggaggctattagatagaaagaacattctgagaacaaaaaaggccttggaactgttaaagcccaagtccctggcagagcactgaataagcctgtgccaggcagccgctgaccccagccccttgcccccgactcctcaccacactggcaggaggccaggccctcctctgagagctctgcacagcccttggggctcaggacctcctgatggagaatgagtccaaaatctagagaccagaggggaaacggaggcccaggcttgggaagggcaggccacaggcctggaaggaagaaacagaggggctggggcagggaatgaaaagggatggggactgctgaactgaagagtctgcagaaagtccctctgaactctgtcacccatggacccagcagagattgcctaatagcacccccaagaggcagaaagcccccaccttccaggtaggaaagttgatgcccatagcctagagcgagtagagcaggctcatcactcaatctacaacgcaactgctgcctggcatctggagggtctgtgcatccagtctcgtggtctgcactggggttcgagttctgcccttatcacataccagctaggactccagggtggatcccggcaccccacgttcctctctctgcccacgtgttgcccaccagtgccagaagtttcctcccaggagtcgctggggccaggccctccatccaggcttccaattgcagcagggtagggggaaggcctcagggccccagcagacatgtcccccaaggagaccaggagggacctggaaggctagaccctgtctctgccccagactgccctgaaagcacaccaagcgtggtctatttttagccaggacccagcaggcagccagccacccagtgctattctagactgtggatcagcaggctggccagggtgaaggggcaccgtggctgaggctgaggagtacctccagaagacctcagagcgggggaagggcagagggggttgaggtgggagaaatctggggaaggctgaaataccgggagggcagagggtgaaggggcttccctggcactggcatcggggggcgaggaggaacagacctggcctcttctcaacacccaggaaggcaggtggcctggtgagaaagaggaataggcacagggagagtgagctggaggaggagagggggcaggagagggagaggagagaaagagacagaggagtaggcagggaggcagagtgacagggagactcagagagaggtggaggtaacgatggtgacagcccctactcctgggcaggagagtcaatgtcctggcccctaccccaccatgcccaggcctgacggcctcctctcaaaagccgcagcctcctttctcccactaaggccactcagccttggtctgggaggcccaagaccacgctgcatccctgaatcctttcaagacccctctctgccctacaagttacatataaaagatgtcaagctgggacgtggacacgcacacacgcacgtacacacatacacacacacaggcacacacggcctcctgggaagaggggacaatgaagaggggacaggggtgtccctttgtccccctgcctggccttgggagcacaaatccacacaaagagcttcacaaagggcctctggctcacagagggggagataaatggggggaggggcagaggggagcccccagagcgagaaatacccagtcagtggctctgggaagcaacatggaggccattctcacagcccagaggcagctaaagggcttagggggaaggggcagcaggcaagggtggggggttaggggtggcagagatgggggatgggactccatctgtcaggggtggggagaaagctgggccagaagtcacctcctggtgagggggcagtcagaagagccaacctgaaggatgctactgagggagagggagctgggcttcctcgcccaccctgagccagggggcaacaggcccaaccccaccccaacctcaaagaaggtgactgccacagacactcccctcacgtggcctcacgtctggctggaagaagggccaggtgccttcaggctcaaaggccaatctggggaggaggtcccaggacaggggcagtaaattagtcaagtaagtcaatgacctcttgctaccaagggaccattgagaacaagaggaagccctccccactaaagggtctaggctgaggggcctgtgcttctcagcagaaaaggcgaggagacactggagagaccaagtgcagagggctgggaaccccgagaccaggctgtcatccaactctgcaccaataatggagagactgtgggtaagccaccttcctgggcctcaacttccccctctgtgaaacagggtaattatgccggctcaggtcccccttcagggctgctgtgagcatcatgtaagactctttaatttaaaggcattcattatcatgattgctaactgccttctggcctgcctgccaagtcagagacccccaagcccagggctctcctccattcccggcccacctgtctcctggccaagtcagcaagtgaagaggtcaactagatgacctcaaaggccccttccagaaagagaaagaaactgatgtttcttgagcacctacttcatgctgggaactttacataccttacccaccttaatgatctcactaaccctgtgaggtaggtgttatcattcccattttccagatgaggaaacggaggctcacagtatcagtcggtggcagagcccagacttgctgccagaccagcctgccctggtcaggtccatgcttttcccccaccagccctccttgttttgttgccgtgaggctctgagctcatctgtccccacccttactcccaatgccagaatcccagagagaagcttctgaaacagccccctccccctacacccttccccagctgacctcagaagtcagcagacttcagagagtgacaaaagagggcaaggagatgcccatgaggacagagtgcaggcaggtaccaaccacactgcctgcccactgtgtcccagagcttggcatatgctctatactccgaagctgacactttgccacagcagctgaggtgggctctagtctgcccattctacaggtgatgaagctgaagatcggagtcactaagcagtttgcccagggcaccccactaagaggtggtaagaaaggactccgagtccccattccctctgctactgtttcccctctgagttgaagccttggggacatagtgtggagtcacttcaggatcaaaggggtcttgggaaggatgcaagagaaccacaaagaaaccacccacccccccatccccccacggaatactacctccaacacactcatgtccctgcttgctttgctgcaatcccagtaagaggcaagggaataaattagccctgcttaggatattgagtggctggggttgaagaggctgtctgggtgcctcacacatctcaatgcagtctgccggctgctgcagaggtggggagctgatgggggcagtggaggcaggggacagtctggactgctctgacctcccacagatggcctcagctcagtgcccagaaatagtctctcctgctccagcttcattcccctaatggtactgcagcttggcaatggctctgagcacccctgccccacacatcagccagcccaggccagccccagaggacacccaaggttattgtcagggggagggtgaagctgcccatcctcccgtagcatgagctttggtgtagaaggctgtgtccaggggaagaggtgaagggtacaatgcctattcctgaatgcccctatccagaaccctctgtacccatgcctcagtttccccttagcacagaggcatcctaagcagaaaggagaaacggggaggggaacagagagggtgtcagaggccagatgggatcagccccctagtccaagcagcaccatgtcaactaaaacaactgaggaaagggatattaactcaacagccaagagccagcctaatggcaggagggcaggcagccaggctgagcaggcctaggcctggagggagcatgatagcctggggcccagcttgctgcctccttctaggtgcttgggtcacccctacccacccctcccatgctacctctgactccctggaccaaaggccctggacctcttcatgcctcaaagccctgcagcagctacaagaatgcacctcgcagaccttctgctgcaggaagcagaaatgacgagggccccagctgcatactttatttattttattttattttttgagacagagtcttgctctgtcacccagggtggagtgcagtggcatgatctcatctcactgcaacctctgcctcccagtttcaagacagtctcctgcctcagcctcccgagttgttggtatgacaggcgtgcaccaccatgcccagctaactttttgtgtttttagtagagactgggttttaccatcctggccaggctggtctcgaactcctgccctcaggtgatctgcccacctcggcctcccaaagtgctggtattacaggtatgagcctgtaatctcctggcctggctacatactttaaaatccattgctgtgtttgctgaggccagacccccccacaggcttgtccctgccattggcagagtgcagtggtgatactaaggcagatccctgcctgggagacaggggatttctttctttttttttttaatttctgttatttagagatcccccagattggaatgcaatggtgcaatcatagctcactgcagcctcaaactcctgggctcaagtgagcctcctgtctcagcctgccgggtggctgggaatacaggtgtgatcaccccactggcactagggacggtctttctagatcaactccacctccatggttccctgttggctttgccgaactcctctcggagtgcaatgaggctaggacgcatcctccaggcctcttttcctctctccttcccttggggtcaggttacattgcggtgtgaggctctcccagcctcccctagccctttcatttcaaaatcaggcatttcccctagtaaaatcctccattcagtcccatcttgtttctcagaggagttaaactaaatcccttagataatgacaccaccaggaataacatcttgattaagagctgtcaatatgtcccacactatactaaatgcttttaggacagtggaggaaaccaaggcacagagaggttacataagatcttcatcaacacacagcctttaagtagccaagcccaagtggaactcagtgtaagctcgaaggccgcttgtacacctactcccttacactataacacagatgccagccatccctaccgcctgccttttgggggaagaaagagggtagaaaagtgacttgaggctcccgaggagtggacgagacagactcacaagaagacacagatggaacacgagagtgacagaaggagagaaaggaggcagacaggagaccagaggagaccaggagcctgctctgggcccgagaatcctgaccctgcaagtgaaagctcctctacctccccagggcaggccaggttggaatattgggcccaaggaagcagtagagaaaggaaaaggtggctgtagggcactttcccacccaaccacttctggccatccttgaccaaacactccgtatccctacctccctccagcccttttcccacccaccgcgtatgtcaggaggctgcgccacaggtgccctttgcagcacccagatcaggagactccagtcccactcttccctcctctccttcccctccaaaccctcaagggcagggcagacatgcctggcctgggtctaaggtcccaagaaagccaggcctgtcccttgcccatcccccatgggaatgacgtctgggttggcagcaggtgaaactgagccaagaggacatggcggagggccagccacacgaggtgagctcttggctcagatactggcctggtgggctcaagttcttggggctactggctggggtgttgagggcttggtggaggggaagtcagggaggaggaagggcagccggcttctgggggcccacgaagggaggagagactttacggcaaacacaatacctgtaccgcaccccaccccacaaacacacacacacacacgctcattcttgtttggcccagccatgtgaggacacccaccagctgctccagtcaccctacacccccctgtcgtcttccaccctgagccagggatagtttaaatcatcggtccctctctggggggcctttcagggactccacggcctacacgataagtgtaaagcccaaactcttcagcttggcattcaaggccctttgcatgtagactcacctcgttcccagcttctgatcctgcctctcccccgaccctactctgcacccacacttaaccactccactccctgaaggggccacatgcttctagcacctctgcacctgactgaaatggccttgcccctccctctgggaaggtgaactcctgctgaaacttttaagaacttgttcaaagtgtcgcctcctctgggagggctttccagactgtcccaagcagaacaggtcagtccctgctctagaaacaggtgacagccctcggcacattgtctcagggtgatgtgttggaccctctgcctcccgcactgacttcccagaagaggttggggtagagatgtcatgtgtatgcatggggcttggcagaggtgaggggacggtgggagtggagggtggatagggaaagagaaggtggcagatgagtggaggaagagatgagcagaaaggcagaggggctgaaaggtgagcagacaggtgaggattcagaggcttccccagtgcatagccagcatccacccagaggctccaggccagaggccctgcagactgcaggctgggccagaggactctaaggaatcaggatactctccaggccacactggacccctctcaatttcagccatggcaggaagaggtgggtaaagtaggatttggtggcaacgctcagaagttcctgggaaaggatgctggtaggaaggcccagacaagctggcctggaggacaccgctttccagcatcctggtgactgccacctctgccagccccagctggtcaccaggctctaaagtcttttctcatgctcttcaaacctcaaaaagtccttctgtcagttgacttcacctgaccctgcacacattcttatctgacttccagccatgcatgagctggcccccactggccttactccaccccccattcccacacctgcaccctcctgctgggtgcccagagaagctcaggcccagatgggcccaggggagacctctatttcccagacagaacagctccaccccgtacagcaggccacccgggcctatcaccaccatcctcttgcacttgccctatctgcattctctctcctgtctgtggggtctctacctgtccacctctcaccattcatccagccatcccttgggcaacctttattgagtatccagatgtcacaggttctttgctaagtgcctgggataccaggttcactaaagcttggcactggcctgaaaaccctggctcatgggcttactggggaggcacactttaaacagacagcagcagaagcacccagcactctcatatctcaggccagaaaaggaccctagagcttggggtcttccatcccctatccttggggtagatttgcagcttcctgctctgggctttacagctactcaggctgggaggcagaagggctggccaaaagcaccaggctggggtcttgggggtggaggtgaatttaaaaatcagagctgggacagtcagcaaggggacctggcccctaagcatagcctgggtcccctttcctccccactacttggcctctctgaagatggcagcctatacttcccactcacaggctgcggcccctctggggtctgccttagcttgcctgcccttggcaccaggctctgtcccagtgccaggagccctgggcaagttcatacatcaaacgaggaggcagtggctggcttctttcccttccggaaatagcaaacaaatagagggtgcagccctatcttcagcctcacgccctcctgcccctgctagggactcaggcctgcccccagagagtgagtaagacttagagaggtgatcggtggacccccacccaccccactccaatgcaggactccagagcttctttctcctttccctcctgaggcacaaggccggggggcaagtgaattgagaagaatcattacaaagggacataagaggatgctagagaatcttctcccatccccaaggcatccctcacccccatcaaggtgctgaagttctcccttcattgaatgattcctttgattccgagacacgtgggtcttccagagacatcatcaaaatggagggacacatataccaaacagaaatctggcttcatgatcttcaaaacacatgcatgaaagtgttcttagcagtgctactcacagtagcccaaaactagaaatgactcgaacgcctgtcaatagcagaatggataaatggacagcgtgtcttcacacagtgggacgctgtccagcaatgagaaggaacgctcaagaccacacccaggaatatagataaagttcacaaccatgatattgagcacaaaagaatacatatgatgtgctccactgattacaagtgccattcatttattagacattctagaacaagtaactccctgtggttagaagtcgggattgcgcactgccctccaagggggattagtgactggaaggggcaggaggcacattctgagagctgtcactgttctgtttctagactctgcatgccaagtatgtgagtacgtgcgtgtgttcagtcagtgggaagtttgtacacttttctgtgtttaggaaatatttcaacacactaatacagacaaatgccttcacagccaccctctctgtgagatgagaggggttattttcaacttcctcctgctcctcgtccacatccaagccatctccatgtccagtcctttctcccaagttagtcatggccccactcagccctctccctggctgaccgtctctaactctgaccaccgggcacctccctgcctgccctgcctcccaggcaccttgctttgactctctccctcccaatccatatacacacagcatgtgtgctagggctcccggggagccaggagcagccaggaaagcctttgtccacttctataacaggtcccggctcttctccatgctgggaccttcaagtcggctgctccaaccacctggaatgcttcttcctcccagctgctcttgcttcagctcctcattcagatgtcacttccttcaccttcccggtgcaatccctctggaatcctcacccatcacatcctgaacttagcctccatagcactgtctccagtcagctcaatgacttgtttgcagtctgttccatctctcccactggattgacaaccccctgagggcaaggacccgagctgtctgctttctgccctatccccagccccaagctccatgcctggcctatagcagatgctcaaaaatgcttgaatcagtgttgaataaatgaatggccaagcgcatctggcttacaggcagcctctggggaaagcaaaagttgcatctggggatgaaaccctcacttgtctggacccaggactcctgggatgtggtcccagcactgaaactcacttctagtgtgaccttgggcaagtcacactgaggacgccccctctggtcttcagtgtgctgttttgaaatacacggggtggataaatcagggctatagtggggcttgaagaaatatatgacattgtgtatgtttgcacagtggctgtgtgtctgtgtgtgtcagtgtgtgtgtgagactgtgtgtaagcgtgtgtgtatgcatgtatgcgtgagcatgggtatgagtgtgtgagcataagtatgagtgtgtatgtgtgtgagcatgtgtgtgaactgtgtgtatgagtgtatgtatgagtgtgagtgtgggagtgtatgtgtgtatgtgtgtgtatgtgagtgagcatgtgagcatatgtgtgagtgtatgtgtgtgtttgtgagtgtgtgagcgtgtctgtgtgtatgagtgtgtgtgagcatgtctgtgtgtgtgtgtgtatgtgttgtgtgagcatgtctatgagtgtcttgtgtgagtgtgaatgtgtctgtatgtgtgtgagtgtgtctgtgtgtatgagtgtgagtgtgtgagcatgtctgtgtgtgagtgtatgagtgtgttgtgtgtgagcgtgtatgagtgtgtgagtgtgtctttgtgtatgagtgtgggtgtgtgagcatgtctgtgtgtgagtgtatgagtgtgtgttgtgtgtgagcatgtctgtgtgtgtatgaatgtcttgtgtgagtgtgtgagtgcacctgtgtgtataagtgtgtgtgtgcatgtgtgtatgagcatgtctgtgtgtgtgagtgtatgagtgtgtgttgtgtgtgagcaagtctgtgtgtatgagtgtgtcttgtgtgagtgtgtgtgtgcctgtgtgtatgagtgtatgtgtgtgtctgtgtgtgtgtgcaccttctccctagcaagagcacccataggttacatcagattctcaaagggatctgtgtcctcaaaaggctcagaagcactaagatccttttcagctctggggtctctgattctacataacaagaaagagaggaagaggaggtcatccaacccatgggggagggagtcagaccagatcctagaacttccaaaagggttgcaggccccacaacaggaatgcaggggaggctgcaggaccaggccccaggagaacgtctaacctcagtagttctccgggctgaaagaagcagagcccagaagagctgactgcagaaacggaagaggcaacagcagccaggagtctcctccccactgctcccgccccatccacaagcacccacttgtcctgggatacagcagagagcaaggaggcacgactggcacccggagatgcccgccaggccccttggcacccagaaggcttggctggaggactcaggagggtgccaagccccaacctcttgctcctgaggctgacatgtgggaccataggagggctcagggtgtagggcagttgtgggacctagagaggccacctgggaggggcagggcccacagctgcaggcactgacaacccagagctggacttggaggcttaagagccaaggcatgcaccctctcaaagccaaggggaggagcaggagccaaatgctggccaggggagaaagaggagtgggcaatggggcctgggggacaaggcagtccaggagaaggaggaggacagcctgcttgtggaggaggaggcagcatgacaggggaagggggcgatgtggcctgggtaggagagggctgtgctgaggggacaggagaatagcgaggctgggtgtggacacaggcagcaggagctcaggctgtggtcaaagagagatgctgggcctacggcagggcctggggcaggaatggggggtgtgtctgcagcaggactggcagtgggtgcgccctggcaggcagcccagatgtctgggtagccactgactcttggcttttgaggggatcagcacccaggagatgtttatctgccccaagaacgagggtatcacccctcctctagtgaggccccaggtgatgggtgcaggctgctcttccctaaacccctgaaggggggagccccgagcagcagcaaccctcactggagccagagtcagggcacagcagctgggatggagcttgatccccacagacagaggagggagggagtcacaggcgagctccaggctctctccagaggccgcttagaaaccagctcatctgatgcagacactcgtccccatccctctccctgccactgtcacacaccggcacacacaccctcccctctttctccccttgatcatccacctccagagccccggctcctccctccatcacagccccactccctgtccctgtccctgcccacctttacctggcccaacaggcacctgccccatgtcaaagctggctgtgtgggaggtggggaggcagggacacagggtgaagaaagaagacccaccaacagcgagtcctgaggtcacagggacctagagaggagttacccatccctggtgaccccaaacacctcctcctactctcccaggaagaaaccagcaccacacctatcccaggcctgatggttccctggcagactcctccagagcagacacctgcctcccagctcagacctgtccccactgccaggtcagctccccacttgctagtctctgagacttacccagcacagagaaggcaggggtgagaggccagcctgtccccaccatcctggggaagtccttgctccagtggggcccccaccctcctaactccagagtcctcctaaatgaagggacactgccagagctgccccttggtccagctcgaggaagattaactctttccctaccttgccccagcactccaggcctgcccctcctgggtgactcctaaaccaacctcacccaacctatttgcccttctaggggtcaggtcctatatcaccctcctcccaagggcacaagagacccaggggagccctctacccaactggaggccccttcacccggtcgtggtccttcctcccccttggtccacctgccttgccgcacttcccaagcagactagcaccgtcctgggctggctacttaacctgtgtcaggtgccctgggctctgccaaccgccagctcccgactcggggcgtcgtccctcacccattcccgcagcccctacctgaagcggtagctgccttctctctgcacaggccaaacccccggactcccagcactcagcccgcgccgagacccagggactccccgggggctggggaccgcagagtggtccgggccgcagctcttcgcagcacaccaggctcacagtgcagcccatccggcctggcgccccggcgggcaggggcggagacgcgggagccccagaagccggcccgcccccagcccttgcgacagctcagcccagagcgcctgcgacattggcaggcgagcagcaacgaccccagcctggccccgacagagtccctgcctttatgtccagcagcgacaggagcccccactgtggggcctgataagggtctgcaatacaggtcccgaacacagccagtgaggaagcccacctcagggaggggagaagggagggcggcagtggtggagtccttgggacagggacttcagacagtctgacttggggggcaaggtgagaaacacaccaagaacgtgacagagggacagggagaagataaaggcagacaatgaggaagaggcagagatgagggacagagatgggggaagcagcctccgcatgggggatataggtgcaggacggagccgaggatagaaaccctcgggcatccgttgtgctggtttttagatgcggttcctggggtttgtgaaaacagccgtcctcccaggcccctgctccacttccctaatactagcccctggagcagccgagcctggagaaacgaggacccggcatggaaagaccccaggctcaaggaggcagagcacagccagggtgggggaccccagcccaccggggaaacccgcccggcccattgctgcgcacaggatctcactggtggtctcacatccatccttttgggaatgggatcaggcctggggggtcggcactgatgaccagcactcagggggaccgcctcagctgactgaggtggagacaggaaggaggagcgtggtggggccctcgacctcccctccccactctggagcgctgcctcacagcccaaccaagcgacacggaagagacaaccacaggaatagcagctgcggagctccatggcctccctgtgccccctggtggcgagaaggaagaaaagcaagagcaggtgctgaaaacgaaaaggaaactagcagcagtcccagctaccacaatggatcagcccccatttggccaacaggtgactctaccccaggtgggcctgagaggacccatcccccatctcaccattctgccccagcgccctggatcctgcctctaccacttcttccctgcgcagtcactagggacggactctggcagcagagccgcgctgtcgtgccccagccagccaggctctcctgggtgagtagcagggagacccctggaacttacggggatagaaggagtgtgatgccaggagccaggggaggaaaatgcctggcagagacgagggagaggaggagacacatggagccgttcatggatttcacacaggatctgggctggaaggggctgccgagaccatcagtccaatctttggtctacaggtggggaaactgaggctcaaggaaggtgagtgatttgcccgagatcacacagtgagtgtgtagccaggccaggatggagacccaggtctctgggctcctgaccccgtcctccctgaatcccatgccccagccacctccctcatttacctccgtttccctctccccttccctccactgtgtcccactgctgtaccactgccacgccaccccaaactccagcagccacagcccgggaggcaggacacctgggttttccgctccatgcctggtcttgactctaggatctcagaataaggccacctgctctcagggccacagtgtccccgtctgggccccaggatccattgggaggagaagaggatgagatcccccaggagagaggcagtattaaaaccaggcaccctgctccccccacacacgcagcatctgctcagctccagccttggggccgcgctttacttctgcaacctctcctcaaagaacacacatttccattcagctggggcccaggaaaagatgagtgggtgtctcgaggaggatgagtacccgggtgaggctgggggccctccatggggaacatggggacactcccagcctagtgtccacatggcatgaaccctcacggggctgctcacaccaagtcagggcccagaacacaggccctgtgggcacacacacctgagttcaaatcctgggaacctctgtgatgctggataaaagacttaccctctctgtgccccaggttcccctctagcctcccagggttatgtggggattgaatgggacaaagatattaaacaattagcacagtgtcgtcgcccagggactgctcaatcggtggaggccacaccatcatcttcacaccctggcctacaaaatagagctgggattttcccttgctgtgtggccagatataagtctttccctctctggactttacacaaaggaggctctgcatcctcctttgtgtaaggagagagttgggcagtgagactcagggttcttcctgggctcacagtccaagtcacaaggaatcacattatctagcatcctacgactgggttaaattaaaacagggggtgagaacgagtgagtctagaagtctaactctataaaagggaccacagttccaatttgaaccaacagttgagttaaggatgctgctaaagtcagccactgggtggcctaacggatctcttagatgacgtaaaactttgggtttgatgtgacagaaccaacactccctcaagttacccacagaagctactggctgtgaaatcctaattacagcataatgctgccaagtgaaaggggtagacataagcaaggagaaattaagagaggtaagagattcaccacgatgaggagtcttcttcagtgttttggggaaagctgtccacagcgtgaagtcatcaacttctcactctggtttgcagtttaaatatctctggttatggcatcaggtattttggtgaaactctgtgtggcacgcacatcaggcatgaaggttttcccttgaaatgtacactaagttgcccagctccagcttataaggcttcaggaacagagcagttcttgttctttgtaattccatgggagaaaattggattggaggaatctagaaggaatcaagatccagtccagtctacaggtagataataaactgaggctgggtgcagtggctcaagcctgtaatcccagcactttgggaggctgaggcgggcggatcacttgaggtcaggagttcgagaccagcctgaccaacatagtgaaaccccatctctactaaaaatacaaaaaattagccgggcgtggtggcaggcgcctgtaacctcagctacttgggaggctgaggcagaagaatcccttgaacccaggaggcggaggttgcagtgagtggagatagcaccactgcactccagcctgggcaatagtgcaaaactcagtctcaaaaaaaaaaaagataataaactgaaaaacaatgagcagggctacaatctaataacaggcacactataatttttcttccgaaacataatttttctctctacattcactctcatttctaccaaagataatcaaagtaagactaatttgtttgcaaaataagtttagcctcatcaaacacagcctgactaattaaataaatgcagcaaacatagcaattgaccacagaggttttcttttaaagcttgctttgttggaacttttgataggaaatctcaaattggattttttaaaacctcttgaggctagaaagccaaaccaaggcagacttcagacttcaccagcaatacctatagattccttctctggacattttcaaatatgacatcccagtcaatgccctagtaatatacccaatactgtcaatatatcctgttataaagagaaccgattcctatagaacagaagcaaatcactatattaccataccaacaagaatactcacaaatagtttctgaattctggaaggatcctatgtggagaaaaagtaagtgtttccacttttgttcacaaaagtacatttggccaaatttctgtaatctatagatagtttaaaagaaaaaaacagtttcctaaactatggcaaacaaaatatttaaagaaccagcaaagtttcaaataaaaattcataaaaaacattatcctcctcagttcatttaacctcatgtaattactttgttcttcttgatcttggttaagtttcatgatagcgtcagtctcttccttagagttatggaaattcttacccagtccaatggtatgatcttaaagttatcaaaaacctttccatgaaagttatcagagtcctttccatgaatctccttgaacacataacaccttagaattacagctgcttgaataaaaaaaaaagttttcagaaaaacaccagaaaaaaaagcaattatttgtggacaatatgtcttgaaatggccatagttaaacatcttatttgtgtttattatgatgatgcaactaagaaggaaatttgggcatcagagacatagacagagctgagtttgcttttgcaaagtgctccatcagtaaaaatgcacagttttgggtgattcatggtgaatctgttttcattttaatcattacatattcattttaaattaaattaacaaaagtgaattgatttaaagaatattacacttcagcagacatggccaaaatgtgaaaggtggtttagagatgatggaagtttggaagaccccaaattagatgatcatgttatcagtgaagagtgccctcagcggctagtaacaaaaatctgactcccagtggcttaaaaacatagcgggtgaggggtttttggtggtattattttacacataacatttgctaatgttggttgggggctcagtaacttccaaggctgactaccctctttccgattcatttgcccttttcctcatggccccatgatggttgctgcagctctagcagtcacaagcaaaaggaaagaaaagggagagagggtgccaagcagtgtctttctttctctttggtaggaaaagcgagggctttcccagagcttgcagcagtcttctccttgaccttcattagcaaaaatcatatccttggccaccactaggtgtaaagaagtctgggagagtgggcaatcggttgcataactggtttagaccatcctcatccaatggaggttctatcggtgagtaaggaaggggcatcacagcaagataaaccaacatcggtaaaagcaaactgagagtggctactgtctctttaaacttcctgtcactatttatacatgaaaagagaacccagcaggagagtatgatctacctttaaaaataggcttgccagtggcagaattgtaggcatctgtggcatgataaatttgacatttgtggtagggcaagatttacactaccattagaggatggttgggaaggaacaatggcaggcagaccaggtgggctgtgtgttcgggcatacctgtggtatgagtgtgtgaccaaaagcaatagacaatgaattgtggtggtgacacatggtccatgaatcacagtagaaatgtctcccattatttatttccacaaccgttgattgagcacttactatagtccctgaaagagaacacaaagatgaatggaagaggattcttgctcacaggctgggggagggtggacttgtaaacacatcactgcagtatagtagggttcatgttataatggagaattgatgaaggtgccagaagactcaagccagggaacagacattagctgctgggggaagctaaggcaggttcccagagaagccgttctccattactgagatggggggagcagtgaccttgaccccagctcttccattcatggactgccccagctctatggtctctctgctaaccatccagactctgggagtggcctatgcccccagcctcagagccatttaaatcaactggtcattggcactggttgtgcaaaagagtagctagcagcaaaggagcgttcattttcccatcaaatccccaccagactacctcaaagcagcctgaaaagtaagtaaagattgtgtgcctgttgtccaaacgcagctcaagtgcagtcttccacctccttcccactggattgcccccaatttgctcctagagaggactccttctgaagtctctgctgtaaagtcaaatccttccccctttattcttatcagacagttgcaagctttcacaggtgatctaccagggaatttaggaataaacaaatggaaataaattcaagaaaaggaaaagaataaaagtgatcatccatagagtggaaaattcagataatggatcctcaaccccagcttcacacctgggacccccgcttggtcatatggaccctggcagtctctaatcacaagtctgtgatcccttgacttaactgttcttctccagatgtagacatggttgggactcagaagggaggtgtcgtctgacttggtttccctatttcaccttactcatcaagtgccctctaactgttaagtcactctgatctctgagctgtggctcctacggttggacacacctggctggggcctcaggaaggaagccacctttgcttgctaggattttctttggggtaggacagcttggcttgactttattttagaaaacgtgttcatttctgtgggacctgaggatttctgataaactggttgccctcctcctgccttatgaccatgtactaaactctgacttcatacctggaggcaggtgaagaggaggccacagcctcttcctcccctctttttataccttgcccttttgtgggaagaggctgacagttttccaatttgatgtttattgctttgccctaagattttgtctttggtgaaaatgcaaatactggtagggacggaacatactaaaatgtgtgtatctgagtggacttatcatagatcctcaggtctggcagcaaataaaaggtggacgactctgtccctcgatttgcagatgagaagactgaaatctataggggtacgagaccccactcaaggtcacgagacttattaatggtagaatcaggatagaatgagaactagatgctggatgtccttactagatgctggatgtccttacaaccaatctgaatagctttccaaagtctttcagatggttctctagagatggttctctagagaaccatctgaaaggacgtttacacttcctttctttgtacaagttttgttttccctggaattgatgataggatgttccatgtacttatcatgacatcagtcccaatgtctccctcaatacattcacattcattggataatctattaatttttctttctcaaagacctctttcttggagctcctcattgtcttcttccaacctggacagtgactctccatgcctactcttccccaaattgctttggctatatttctagataaattttagacactgcttatcaatttctgtataatgtctaactaggatttggatttggattgtatagaatctgtagatcaagttggagaaaattgacatcttaacagtattgcgtctcccagtccatgagcatagtatctttctccatatatttaggtctgagacataataaaattttaaagagtttatttgagcaaacaacagctcatgaactgggcagttccaaaccagaagcagttcaggagctccactgagggaatgcaagagagaggcttttataggttggacacagaagtacagccaaaaaaaaaaaaaatgattggttacaattatacagctgctttatttggtctatcctgttgggaagtccctattatataagtttgttggctacttctgaatgattgaggtaagttttgtttttctttaatataggcatttacaagaaatagcttaagtttcacttatgttttcaaatcaagcaagcttgaggtaatttgtaagtcctgcctggttttgtcttctcagggattcctgaggcctgatctcaattttaatttactttaacaattttccctttttggtcatcctttcagcaagctaagagtatgagcaagcagtatagcgttattctcagttactgctactgatgtagtcactggaacaaagagtcctgtagatgccatcatcattaacagctaccctgggatgtaaaatcacatagtcagcactatccaaaattgcatagtctttgtaggcttgagtagttgggctgttgacttatccaaattgtctaatccttgatggcaatcatttgatgagtgagtggctggtgggaaccaccacatgagagactacaacacacttgggatataaaggcaacgacaatcaggagaataatatccaagggctgaaaaattccctggagcaaagtttccagaatttcatcaactaaataaatcaataaaggaggtagtgcctgattaaaaagaaaacttgtattagtttcttaagatctttaattttggggcaactatttctgatttgttaacatagaaacaccatttcttaccaatatgagcctaagtttttcttgttaagttacaagcttgaagagaactcagggtatgtatctatgaaaacaaaagaaaaacagaagttaatatttcgagcaaagtatggtcttagttttttagtccagaggctagttagttgagatttctagatttgagtttaaagcatcttcagaagatgaaatgaggatggcagctgcagtctgatggatttacctcatttgtagcttgaatgtctctggttatgttgttgggtgttctggtaaactctccaagtgatccccatagcagcaagcatgaaagttgttcatacatgatctgttgtagtgatttttctgaagttaaatcatccagcttcagcttgaagggctcgggaaaggggcagttttaatttttagtgaaaccaggaaaaatcaagactcaatccagtttatagggagataaaacttcaaaaaaaaatgaacaggaccagaatttgataatgagtgtgttacagttttctactgaaatacaatctttattatagtcactcctatttttaccaaaaataatcacaattattttgtttctacaaaataaatctagttttgtgattggagtgttgcttttctggctggaaacctctgtggccagtggtgcctttgcccaagttttggtcttgcacccagggagaatgaggtaggcagacaagtggagggtgagcaagatgaagagaaggtttattgcatgttagaacagctcggaggagacctgcagtagggtagctcctctctgtaggcaggttgtctcattgagtcttcagctctcagcagagaggaggccctggaatgggtggctcctctctgtaggcaagtcatcccagtgagtgttcagctctcaggagagagggtaggtcttctctgcagctggtcatttggtcatcttccactctcagcagtcaggaggccctgaagaggatagctcctctctgcagctggtcatccagtagtctgcagctctcaacagaaaggaggccctggagaaggtagctcctttctgcagctgttcatcccaacatctgttctgctctcagcagagagggtagctcttctctgtagctggtcatcccaacatctgttcagctctcagcagagagagtaggtcctctctgcagctggtcaacccaacttctgcagttctcagcacagatgaggccccagagagggtagctcctttctgcaactggtcatccccacatctgctcttctctggctgagtctggggtatgcattgtcttcagatgggggaagtgcatgctgattggtccatcagcagccacaggtgggcacaagaaaaagcaccacaagctccacctctggtccacaggactggcagcccagcccccagactttgaaggtggggcttcgccagggacccaccaccttcctcccaggagcctgtctgcctcctgccaccaatcatggcatccaggctgctcagacgaaggggcacctgcaggccagtgctgatctgccctcagccccatctcggcttccctcccatgcttgtcagtgcccaaagtccagaagggggctgaggaggcagggggctggtgtcccagtactgctctgagtgtgcacccacccagcagggctatgacagtgcccaggttcacatgcaaccttactccatgatcggagtgggcaccgggagtggggagagaccaggcagcaggagcaggcccttctgagcctgcaagggtcagggaggccttctggggcctccaaagcacagagatgccaggatctacagctaggcttgggcagctgctgtggcacccaggggtggggctcctgcctgctccatggagcagaaggcccaggctgcacctcctcactgcagccagtgttttggcagtggccagatgagccactgctgccatcagtttcatgaaacttgacctgaatatgtatgtaaatgcaagaataataaatctatatatgctataaaatatgatactatccaaggtgctttattgtctttgtatcagtcaatcttagttagctgtaatgagaaatctcagatcacattttttttatgttaacttttattttaagttcagggtacatgtgcaggtttgttatataggtaaacttgtgtcatgggggtttgttgtacagattattttgtcacccagatattaagcctagtacccattagttatttttcctgatcctttttctttctcctcccaccctccatcctctgataaaccccccagtgtgtgttgttcctctctgtgtgtccatgtgttctcatcttttagctcccacttataagtgagaacaccaatatttaggtttctgttcctgcattagtttgctaaggataatagcctccagatatccattttcctgcagaggacatgatctcattcttttttatggctgcatagtattccatggtgtatatgtaccacattttcttcatccagtctaccattgatgggaatttaggttgattctatgtctttgctattgtgaatagtgctgcaatgaacatatgtgtagctgtgtctttataatggaaggatttctattcctttgtgtgtatacccagtaatggaattgctgggtagaattgtatttgtgtttttcggtctttgaggaattaccacactgtctgtcttccacattggttgaactaatttacactcccactaacagtgtataagtgttcctttttctccccaacctggccagcatctgttgttttttgactttttaatagtagccattctgactggtgccaagtggtatcttattttttgtggttttggtttgcatttctctaatgatcattgatgttgagcttttttcatatgatatttgactgcatgagaaatctcagattagactttttaaaacttctctagacaagaagtcaagcaaagaacttgcccatttatgtcctattacaagcagagtatatttttattgaaccagtgcaaatacccatattgcatataagaatatttaagaagagtttccaaatcctggaaccatcaggtaggaagaaaaagataaatgttccctttctatttacaaagtacattttatcaaattaatgtaagttattgacagctcataaaaaagaaaaaaaatttccctaaatctagaaaacaatacattaaaaaaaccaacgttttaacaaaaagtaataaaatgaataatcattctcatcagttaatttagcctcatctaattaactcttttgttttgtttgatattttgttaatagtttcatgaaactatcagttttctcttagagttttggaacttcttacccagtccaatagcataatcttagttatcagacacctgtacttaccagtcttttttctccttcttttttaaaaattggcaaatatgtacataataatgatacatatttatggggtacatagtgattttttttttttttgaggcggagtctcgctctgttgcccaggctggagtgcagtggcgcaatctcggctcactgcaagctccgcctccggggttcgcgccattctcctgcctcagcctcccgagtagctgggactacaggctcccgccatggcgcccggctaattttttttgtatttttagtagagacagggtttcatcgtgttagccagatgttctagatctcctgacctcgtgatccgcccgcctcggcctcccaaagtgctgggattacaggcgtgagccaccgagcccagcccatagtgatgttttgatgtatataatgtatagtgatcagatcagggtaattagcacatccatcatctcaagtatttgtcatttgcttgtgttgggaatattcaatatcctctcttctagctatttgtaaatatatactattgttaactatagtcattggacagtgctagagacactagaatttattcctcctgtctaattgtgtatcctgtaattgtatagggagagtgtagtctctcactactccccctgccacctgcccttcccagcctctagtaacctctcttctacttttcacttctatgagttcaactttttttagcttccacatacgcgtgagacagtgcagtgcttaactttcggttcctgtcttatttcacttaatgtaacgttctccagttccatccatgttgctgaagcaatcattttctatgaatatcttgcaatgctgtgtcatagctgctttcaaaatctttcaggaagaaaatttggttagtcttaaaaatacagcattataagacaatcattagttttataactgataacattataccaggaaatatgagacgtctaggaattttatacaatttctagaacactcatcaatgacaaatataacttagagaaagttcagcatcacttattatttggcagtgcctctcatgcaatttaacacatcaaataagtctaattagtttaacttccctcttgttacaaggagataaaattaattcttttgacatatttcagggacccttctggaaactctcaatgttaatttgaggtccaaaagacttgatttagaatgtgattttggggagctgtcaaaaatgtcaaaaggtttaaaacacttgattaaataggtacacaggtcactgtgaaacaataccaaagtgacaatgatttcaaaggcaaacacaaaaagtttcattgtggttaaaaaaaaaaaaaaaaaaagtttagctcttttagtattgaaaagattacacttttcttcaataataaaaggcttttaaaaagacaacatgaagtacaaaaagttaccttgattaaacacaaaatctgtgtttctaggccaattatttaacagataaggaaaaaaaacctttcacattcacagggagaccaatactccaagaaaatgtgtccttttaacagagagaaaacctaattctaactttgcaccagtacatcaccgagtttttttaacttacaagtaaaatctatctaatgtttgtactatgaccacaaataaagttcttctttcatagaccttctgcaactttctgtatctattcatttttttttgtcttagtctttttctccttttttattccggatcaataagtcatcttgctttaagacaaaattactctctttttctcttaaggaaaacacgtacattttatacttttccttattaaaaatacatctcacttttaaaatacatttttcacatacatatttgtgtacagttgttttcattcatcctttgtttttagtagttttaattacatgtattaattaaaattctttacccttagtagccttaatatctagcgaaaattaggatgtacgtggtttcattggcctaaatcctatttccccatagcacaggatatgcttaccagtgcacccaattatctctagttcctctttaataacgagcctaaagtacataagcttaaacttacgtttatttagtgattaataattttagtagtttatctcatacggaaatgatctagatacttaatttatatgtatattttcatatttaattttaatctataagtctatcctattggaaagttcccagttataaattttaagtcttctggctacttctgatgggttgaacttataagttctgtttttctatagtatgagcatttatatttatttctgctttcaggtcttcaagggattgccacactgtcttccacactggttgaactaatttacactcccagtaacagcgtataagcgttcctttttctctgcaaccttgccagcatcttttattttttgtcttttttggtctaaagtggtatttcactgtggttttgatttgaatttctctaatgatcagtgatattgagctttttttacacgattgctgaccacatgtatgtctccttttgaaaagtgttcatgtcctttgcccactttttagtggggttgctttttcttgtaaatttgtttaagttttttatagatgctggatattagaccttcgtcagatgcatagtttgcaaaaatcttctcccatcctgcaggttgtctgttcaccctgttgatagtttcatttgctgtgcagaaactctttagtttaattagatcccatttgtcaatttttgcttttgttgccgttgctttttgtgttttcatcatgaaatctttgctcattcctatacccagaatggtatttcctaggttgttttccagggtttttatagtgtttcttatgtttctgaagatattatggtttttgtaaagatttatttgattccctttattgtctctctttatttttggtctaataaactcagttaccacttatccatctacttctgatttctatttttttaatcggttatcttttcttcactttctcttaatccttgtaccttgtaggattatgccttttaaaaaaaatccctttagtgtcatttttagtggatttttgagaggaaacagaggtaaacatgttcattaaattctccattcttaatataaaacgcctctggatttttaaaacatgcttattttaaaaatcacattcagattgctctgttatctctagtcctcagttgttaaatctcccatgggttaagttggctgattgttgattctggtggttgttagttctttgtaatatttaatcatgaatttatctttcgaagagcatattttcatgtaatcttgcatttgcccttgattacaaagaaatctacatgggggaagtttcatggctgtactggctggggcactactgggtcatatggttcacagcattttttgttgttgctaaatttcttggccctgagtttccacaccattccaaatggcaggtttgggacctcatcatctgatactcaggcttgggattctagaatgttcctcaaatgaccttctttttcccatggcctggggcaggcagctcacttgtggatcatgtccagagttggcaggtgtttttgcctgggaaagtctctatgtctccttcatctttgaaggataattttgctgaatatgatatttgaggttgaaagtttttccttcagcactttgaatatatcatctcactctcctggccagtagagtttccactaagaagtctgctgccagatgtattggagccccttcatatttaattgacttctttttttcttgctgttttaggtctttttttttttttagatggagtttcactcttgttgcccaggctggagtgcaatggcatgaactcagctcaccgcagcctctgcctcccaggttcaggcaattctcctgcctcagcctcccaagtagctgggattacaggcatgcgccaccacagctggctaattttttgtatttttagtagtgacggggtttctccctgttggtcaggctggtcttgaactcctgacctcaggtgatccacccgcctcagcctcccaaagtgctgagattacaggcgtgagccaccgtgcccagctaggtcctttctttatctttgaccttctttatctttgagtttgatgaatagatgccttgagataatcttatttgaattgaatctgcttgtgatagtgacaggagacagacaaattcctagtcagacagggatgggtccctggtgaaacctgaccttcaaatcaaggacagtttaaagcctgaaaacccagctgctagttctagatagagtccatgactggagtgagaacttctatcctcatctcacccactctctcttgattggctacttctggatgatgtcttttaaccaatcaaaggtgttttttccaaagccacccatggaccagtcagcaagtattcctccatttttagcccataaaaatcccagactcagcctcacagatggctaccccactttcagtgtccgctcctgcagctgagagcttttcttctgtcactcaataaaattcttctccgccttactcactctccagtgtccacatatcttattcctcttgatcacaggacaagaacccggaactcaccaagctacagtaggcaggagtgaaggagctgtgatgctcctggctggcttgatgagctacagattacaggggtgaaagagctgtaaccctcccttccacttgccgaactgcaggagcaaaagagctgtgacactcctggctagctcaccaaactgtgggaggtgggaataagagctataaccctccctccagctcacagaactgcaagagtgaaagaagccactgagtgccactccctcctactcgccaaactacaaaatccacagcatttcatgttctatgaccttcttatagctggatattcacatctttctctgtattaccacacattttttttggcctgggtttggtagccagacagtgttatatttgtctctgctagatgttttaagatcataaaagtatgagtttgacctaagaacaaatgtacagatgagagtacatgcaatgaccattgttttctgtatatcaaacacaatttaacctttagtgattttctttgacaggaaaaagacttaaaataatgacctgctctaatatctcagttttcaagagtaatctaggtaaaattattgtaaataaaaaacaaggtatatataaatggaataaacatttatacataaagttttcatgtaatttaaaatcttgaagttatgttaaagtaagtgatagatatttttaaaatatctaggtaagttcttttcattttttaaattaatttttgtggagatgaagtcttatgatattgcccagtctggtctcagactgctaggcccaagcaatcttcccacctcagcctcccaaagtgcaggatcacagtcctgagccatttctaaataagataaaatgctgaaacattaattgttaaacatagctttaagcttatttatttttgacttcttaaatattataaaaacacaaaagatatttgggtctattaagaaaacgtcctataccacattagaaattgttctgtaaaaatatgtttttaagtactataaaacatatattcaggggatgtttatatataacagttcagaaaagtacttattcctgggtttttactaaaaattaaggtttctaaaattaaagttctaatcaatatatttaattctgtatacaaaatatacaaaagctaatttttgcaagagaaaaaatattaagtggtttccataataatgggaaaaagagaacgttcttgtcctaagataaaatgactggctgttccaatattttaaaaaaaaaaaaaaaaaaaacacagaaaagtgtagggcagtaatgagactttaagaaaataatggaagacctaagcaagttggggagggtttatgaaggatggttttgtaaagggagttttgtgtgtgattaggttgcctggatttaaaaacatgtttctaagttttctaaaaattaaacactgacatcaggggtaccatggcacagggctggagactggtcttctatgtttgaaacagaaaggttttcttaaaatattgatctgcttttagtaaacaacaacaacaacaaaaactacaggaggtttggggtttaattctgaattctgttgaattttcaatcatcttctaaactacaccttttttctattttaaattttctacataatttcaacttagaagtgctgtcttcctcatttaaattgataatttcctttctcaaggtagagttttcctcttaaagcttttcagattcatgtctcaggggtttggcattttcacatctcactacatgtgacttacaggtcatacgtcactgcctcctgctcttcttccttgaaaagatacatctttttgctttactaaagtggtgactgtccccttcaacatttgtcagttcctgtagctttttctttttttatttcagactctactcttgtggcctgacccagaatgtttgtcttaaaggcctaggaggacaacgtgtcctccagtgtaagtcgactctgtactcagctcttcctgatgtgtctaaattgttctatgtaaccagacaatttcacgtgctattactttttctaaaaaccatgcattccgttgcccaaggtattggttttcttgtttacctttttctcctataatatggtgtacactcctaaccttggacatactcttaccgtgtctaattacctttgtatgaggtttgccttccaggttatccaaataggcttcccataaagacaagcagttatactgcaggaggcttttctttatcttttaagtaatttgcctaagaaacagagatttcaagttttaggatagtttcttgccagacacagtattgagcacctgtagttccagctactcaggaggctaagacaggagagttgcttgagtctgggagttcaagaccagcctgggcatcatagcaagacctctatctcactttttttttttttaaaaaaaaaagataacgtcttgtgttttgtgctgttaatattaataaactaatattgggttttttgaaagtcatccctaaggcaggtctaaggttttttttttctctcagctatgtaacattttatatttactcttaaagtatttttattatccttctgattcaataaatgactgttatttcaaaatgacatttgattccacttattattattatagttattattatttcataaacataaggctcaccctgtcacccaggctcaagtgcaatcgcatgatcacagctcagtgcagccttaaactcctgggctcaaggaatcctcctacctcagcctcctaggtagctgggataacaggtgcaagacacagtgcctggctcgtgattctattttaattaaatgttttaagccttttaacatctttgacaaacttccctaaaatagaattctaacttaagtctttttaacctaacatcgactttgggattttccagttgggcccctggaaagtctcaaaggatgaggcttatttaatatgaggcttatttaatatgtttaattgtatgaaaagcactgtcaaataacgaaatgatattaaacctttttttttttttttttgaaacagggtctcactttgtcactcaggctggagttctgtgccatgaacatggctcactgaagcctcaacctcccaggctaaagcaatcctcctacctcagcttcccaggtagctcagactacaggcatgcgccaccacacctggctaattttttttttattttgaaacggagtcttgctctgtcgcccaggctggagtgcagtggcgagatctcggctcactgcaagctccgcctcccggattcatcccattctcctgcctcagcctcccgggtaactgggactacaggcgtctgccaccgcgcccggctaatttttttgtattttttgtagagatggggtttcaccgtggtcttgatctcctgacttcgtgatccgcccgcctcggcctcccaaagtgctgggattacaggcgtgagccaccgcgcccagccgcacccggctaatttttgtaatttttttgtgcagactgggttttgccacattgtccaggctggtctccaactcctgagctcaagaaatccacctgccttggcctcccaaagtgctggaatgacaagcctgagacaccgcacctggcctaaacatcttttaagttatattcatgtggatgttactgacagaaatcttcatcgtctaaagattatatgaaatttataaaagtctgatggtcctggtgtgatgctgtcagtcatgattctcatttttgtcttaaaatgctgtttgcaatacaaatgacagaattccttttcaaaagttgaactttcatcagatttcaagcatggctattctaagtttttatcatctactgtgttgattcttctctaaaggcatctgcaatcagattcataagactcttacaagtactcttaaatacaggcttttaattactttaagatcatggactagggtcgggcatgatggctcatgtctgtagttccaacactttgggaggtcgaggcgggaagatcacttgaggtcaggtgctcgagaccagcctggccaacatagcaaaaccccaactctactgaaaatacaaaaattagccagttgtggtggcgtgcacctttaatcccagctactcaggaggctgaagcacaagaattgtttgaacccaggaagtggaggttgcagtgagccaagatcacacaactgccctccagcctgggcgacagagtgagactctgtctcaaaaaaaaaaaaaaaaaagatcagtggactaaataaataacatttctaaaactctaacgagaagaactgataggtttataaaactgctaatcaaaatcaagcagaataaaaattgattacatgaaattgaataactgatacaaattatgatttttatatcatttgaaatattgttagttctttacttaaatgtcttgttttccagatttaagaaaagtttctctcttaagctatctgtagtttaacaacaatttggtgaggcaaattttcatgaacaaaggtgaaaacatttgcttattcttcctacttgatccttctaaaatttggaaattatctgtgagtactttttattttatgacaatatagttattcacataagttcaataaaattctgtttctttataggaagatgcaatttaaaatgttaattatattatcagggttagatgaagttatcatattttaacctatttccgggtactgcagttaaaatcagaagcctgccttaatttggcttcctagtctcaaaattaaaaaaataataagaagaagatacaaggcgaagcacattggctcatgcctgtaatcccatcactttgggaggctgaggcaggcagatcacctgaactcaggagttcgagatcagcctgagaaacatgatgaaaccccatctctactaaaaatacaagaattagccaggcgtcatggcaggcacctgtagtcccagctacacgggaggctgagacaggagaattgcttgagcccaggaagtggaggttgcagtgagccaagatcgtgccactgcactccagcctgggcaacagggtgagaccctgtctcaaaaaaaaaaaaaaaatacaatctaagatgcaatcactgtttttactacacttacataaataatcaggccaaacctgataaaactaaatttggtgttactctgattatcttcagtaaaaattgggatgtctagaatacactcgttattgcttttgtattgtagtccagtgcattgtttttgattttttattatctgtctgtagaatggactgtatcttaaattcttctggtttcctctgatccaattttcccccatggaattactaagcaggaaattactctttcctaaagccctaaactaaaactaaacaacttaatatacatttcaaggagcaagactcatgcctgatgtatgggtccacccagaatgttcaccaaccatccccgccacagtgccatcatcagagatatttgaactacaaaactggcaacttcatgcttaggcagcttttcccaagaccgtcaaaatacaactccatatggtaatacgactcctacccctctcattgactacctttccacttcacaggataatgctatcattaaaatttcacaaattagatactgctataggtaacttgacagaatctgacctaaaaaaatccttcagtccacctggagagcatcttcggcaatatcccagcacgaatttttgttcaaattgtcccttttctagaggtgacactctctgctttaattcagctcactcacggaatgctacacaatggctgcaacaggtctcaatttgatttgcctagttggttgccttgaggcttgggcttttggttcaaaaccattgtacaaattggatttattatattgttgctggttgttgttttttttttttttttgtattctgctctgtaagctctgcttttattgcctgtctaatctttgcaaagccagttctcccaacaggataatgttagccccacacttcaagatgattgctgatgcctgccagaataatcagatagaacttgatgctaaactccaggcaactctgccctgagagagcttttttcccccacttctggtctctcttgcccaaatgtggcccgggtccctgacactgactcttgtactttcccctcaatgtaagaccacagggatgggctcatcctggcatgaaggacaataaagcctaacttcaagatggttacccagtgatgctttcagacaatgatcttgatcaacaggtggaaatatgaaaattgattacataaattacagttatcttgtcacatacaactaaattagagttgagtgtccagaggagaaagaagcattcagtgcacaaagggcctgaccagggattacatcacagttcagctgccaaaatgacctgctgtaaccttaagaccagttttaccaagtagctgctgtgatttcaagactagttttatccaggccaggtgcggtggatcacacctgtaatcccagcattttgggaggccgaggcaggtggatcacttgaggtcgggagtttgagacaaacctggtcaacatggtgaaaccccgtctctactaaaaattagccaggcatggtggcttgcgcctgtagtccccagctacttgggaggctgaggcaggcgaatctcttgaacccgggaggccgaggttgcagtgagccaagattgtgccactgcactccagcctgggcaacagagtgagactctatctcaaaaaaaaaaaaaaaagagagagagaagactagttttacccagcgctgtcctatctatcagagcttgtcaactcccaaaaacctttgcttaatgccagtgagttttctttcaaaacaatacttaacatttctctttctaataaaacctgcaactttctctttgttgcaaagaccaccccagtctgtgtacacaccctgaattgtaattctgtcttgccacataaaaggttttgtttagaaattcatctctagattttatgtgactttgatacttcctagacatttatctgaacctttataaatctacatatattataattttttatacaaatgggtaagccatttattacacatgctgttctaccttcctccttcattccacattatttcttgaagaactttctgtgtccgctcatatacctacctcattaattttttaaggttcttctttaaaaacagttttattcaggtgtaatttaccaactataagacctgcctgttttaaggatacaatccattgtttttagtaaactaacagagctgtaaaaccatcgccacaggttacttctatcaccccaaaaagaaccgttgtgactatttataatcaatctgtgttcccaaccccaggcccaggcaaccagtcatctgttttcagtctctgcagatttgccttttcaggaaacattttaggcaaatggaatcatataatatgtggttctgttctggcttcttccacttagcagaatgtttttagctttgactttaaactactgcattcacagtattccatggtgtggctgcaacttcagagtgtaactaatgaattccctattgataaacatttgggttgcttctaatctctgatttttgtaaataaggctgcaatgaatgttctgtacacatttgtccaactaagcagctatttctgtaggataggtttgtagtagtataattcctgaatcagagattgtgtgcattaaaagagagatcatcaaattgctttctctaaagcttgtacctatttatctactaccagcaatgcatgaaagtatcttcttctaatctggtgaattctcactccaaaattacaagatgcaaaagcctgcactccactctgtgcactgggtcctcaaaatgacccgagttgtccttgtgttcttctgatcactttctccttagcttttcctttattttaacgttttaaaacattttcattgtgaatagcatacatactacaagttaagaaaaacttacgtttatagcctaaggaataataatacactaaatcccaagcatctatcatgtgggtaaggaaagaaggcattatcagtgccttcaaaagccccaatgtgtttctcccttccccgaccctttaataaacatcacctgaacctttgtgggaaccgttctttttccttagagtttgcacataagtttgtgtggagggatttgtactgagtcagcatgataagatagaattgtgtttccccaaattctcttcctttcacatttccaggtcagtggggggccagaagggacctcatgtgtgagatctggaagcgggaattggagcagcagtttcattctgcttcagctcaggaaggtcagtgcaaggtgccagacaccaccatatgatgggtgtgtgcttgtgggggagagagagagagggagggacactcaaagtgggtgctgctggctgacctggaagagctctctgcctttctgctacctgatcagggggatttggtgaacttactcaaccctttgcaccttctaagtcccacccctgacactcctgactactgcttcacccaaggatatgagatgccctagagcatcccagaacacatttctttccatgatgcgtggtctgcagcaggaagcttgggttggggatgaggggatgcaaggctgggctccatctctattctatccttctctttacgacacaacaaataacaaagagatttacttcttgtaaagactctcacccaagacctctgctcactcttgccccacttctctgtagcagtttggaagcttttggttggaagaaacaaaataaacacacaaaagtggtttaagcaatgaaagacatttaattatctcatttagcaagaaatttcagccttggttctttggcaaaagtacctttgggggccaaggtgttttctttttaattgaggtaaaatatacataaaattttaccattttagacatttaagtgtacagtttagtggcattaagtactcagacattattgtacaactatcactactgtttatctttacaactttttcaacatcccaaacataaactctgtgcccattaaaccatcactccccatactcccctcccctcagtccctggtaatcactgttctgctttctgtctctgtgaatttgttcactctcagtacctcatgtaagtggaatcataaactatttatctgtttatgtctggcttatttcacttagcatgaagttttcaaggttcgtccgtgttgtaacaagtatgagtacttcattcctctttcaggctgaaggatacttcgttatgtacatatcacattttgcttagccatgcattcattgatgaacattgtacacatcacatcttgtttagccattcattcattcattcattgatgaacatttgggttgtttctgccttttgggtcttatgaataagcagctatgaatattggtgtacaaatatgtgttcaagtccctgctttcacttcttgtgggtcaattactacaagtggaattgcaggatcatgtggtaattctatgtctgatgttttgaggaaagatgccatactgtcttccgcagtggccacaacattttacattcccgctcacgatgcccgagaattccactttctctgcacctttgtggacaccttctattttatgattttctttcttctgacattaaccatcctaatgagtatgcagagctgtctcactggagtgtagattttcacttcttagaacatagagtgccatgagctcaagggcaggagggacagagctccagcaagtgatgtagtaattatggcaaggggtgaggtaccagggcaggctttctaaatcatgcaagggaaactagtaagaacgtggcctcctctgcttcctgcgaccacagtgggggctgcactgacactgagaccaagaagagctagtggacatgaggcttggaatgtgactgtgaagagaagggaggaaccccacgggactgcacttaggcaagaggtcttagagagtagtggaagtgtgccctgaagaagagccaacaaaggaaggcctgctgtctttgggcagggagtccttgctgatcaagccgtgtatggctataatcttgagaagtccatggcaaaacttctggccaatgaaggcgtagatgaggggattgaggtagctgtgaaggatgcccagaatctcagtggcatccagggcctggttgatgtcgttgcggcgctcacaggtctcattggtcatctgggttcccatgagggtgtctgccagcaggaccaggttgtagggcagccagcagagcaggaaaatgaggacaacagcaaagatgacccacatggtccagtgcttctgccccatatgggccttaaacagcgtatgcagggtgaatctgtagcagaacagcatgatcgcagcggcacgatgaagccaaaggactggggcaggatccgtaacagcatccaccagtttgctgtattgttgcccatgtcctcatagcagactgggctaacattggatgggtagaaggtccttcggaaaagcaagatgcgtagggacagtaacaggaacaggttccacaaacccagacatatgaacttgaccaagtggcgctgctgggtcagtgtgcgtgtggcatggacaatggccaggtaacagtccatgctgcggcaggccagtagtagaataccaccgtagaagttgacttccttcaggagctagaccacctggcacagattgtgccaaaaatccagccattcatcttggaggcagccaagatgggcaatgtcagggaaaagaacaggtcggccaaggccagggtcagcaggtagacatcggtgacagtggctgactcagctgaataagatgaccagcatcggcagggagtttcacatcacgttcagtagaaacatcagggcatagatgatgatcaaaacataattgatttctagggattctggccaacatggggcagaatctagtagaaaaggggtagggtcatagctgaaactgtaattactaaaatctccactgaagatgtcttcccacatgtaattttcccagccaaaattttccatttttgaggtaaacttaaatcctggcctatagaagagagaagaggattattgcacaataaaccttacccagattcttgcctatccatccaagaaactgggataggattctttgtgttggcttgtatattacatggaagtaattttcacctctaatttgtatatggcaggtagtctaaagttttgaggcaatgttagtgataaatgccacaatttatcaaaagacttccatactgattcccttccatgctggacacatattcttgcatttcccatgacatcacagtctcccaaaactttgtagaatgttccctgtggataataactacaggacactcaatcctacttggatccctcagtggtgagcaccttcagctgtcaaggctgggtttaatgttcagaaacatgagatgccactcagttcttaatcaggggactaagcagccactccaatggggttgtaccctcaaaacagatcaaggtttgactataaaagtgagggatgaatctctttgtgcacccttctgaaagttattttgaaagaaatgttctggaaaacagtttgaacagtagcatggagttttggaaggctcgagatagaagaatcttcagttaattagtaaggcccagcatttctcttttgggtagaaggaggcctgctctgggaatgtgtgtgtactttggaaaagtatattaaaaatgataagtgggccaggctcagtggctcacgcctgtaatcccagcacttcgggaggccgaggtgggcggatcacaaggtcaggagatcaaaaccatcctggctaacatggtgaaaccccgtctctactaaaaatattttaaaaaaaaaattagccgggcatggtggcgggcacctgtagtcccagctactcaggaggttgagacaggagaatggcgtgaacccaggaggcggagcttgtagtgagccgagattgcaccactgcactccagcttgggagacagagcgagactccgtctcaaaaaaaaaaaaaaaaatgataagtggccgggcatggtggctcatgcctgtaatcccagcactctgggagacagaggcaggcggattgcctgagcaggagttcgtgaccagcctgggcaacacggtgaaaccccatctctactaaactacaaaaaattagctgggcccagtggcatgcacctgtagtcctagctacctgggaggctgaggcaggagaattgcttgaacccgggaggcaggggttgcagtgagccgagatggcactgctgtgctccagcctgggcgacagagcaagactctgtctcaaaaaaataaaataacataacataaaataaaaataaataaataataataagcaagtgggctccctgattctccccatgggtagaaacgtaacaggttatttggggagctctgagcagccatgtgctgccatgcaggatgagcagacacagccagcctgcaccccaataagagggaacggcggcaggaagcagagaaaacaggggctgcactacccttgcttggtggctctccagccttgctggggaccctccctgtcctgcatgtgtgtgcctccatccagccctgactcccctgttcttctcattcagtccatctctgctggctctgcccttgctacagggacaggagagatcccgctctggggaagcctgggtgtagagggtgggctgaagccattcaaaaatgttatcccagtttctcaaagaagaagtcaactaaagcaatccagctccctaattagcttttttccgaaccacaaaatagatcaccctctggccattgccttagagtctaagggatgaccatcctaccatcaaccaggtccaagtccataacctacccccaaaatggaacccagtgacagagaaaaaccagaaagttaaaggtcccagaacccacttcacactcaccaggctgggcacagtcagaaaaagatgcccaagaacaatgtgggtgaggaagtggaaaagtcagaactctcccacatcgcaggtgggaatgtaagatggggcagctgctttgaaaaacagtttagcagttgctcaaaaaagttaaacacagagttaccacatgaaccagcaacccccatcctagggatatacccaagagaattgaaagctatgcccacacaaaaactaatgttcatagtggcatgctccagccctcaggaattaaccagcaggcaaggggcagagtgggccaagaggaataggaagaacctcagaacctctgcaggaagcagctaggagcgaacatggtaggtgttgagtcatgggtgtgagcgaggggcacagtgtgagggcagagcatcaggctctcggttccccaaaactagcagggaggcggggcccctgcaagtgctgtattagacaaaataatctcaccaccttacacgtcagcccataaggcaaggttcctaagaagctcttccttcacctgagctgagcttccacctctgagtctcctcttctttcaaccaaacaaaagtcctttctgacccctcttgatacctgctcctatctgggtaaaaacaggagcccgagggtccccaaactctaaggcttcagccacagcccatcagaggccagaagttggtcacaaaacaatagtattttccatgaacccataagcaccccaccccagccccgctccacctggccaccagattcgctgtacttacactttctggacactgccatctccctgggaaattctgcactggagttttgcggaaagtgaagcgtgaagaagtatgggatgagggatggggaagcagagccagaagggctcaaggccaggcgcctggaagcagagggccccagggtgcctcctccaccaccaagaaccttcagctcctggttacagtgctggctcccagctctggtggtcagccagactggccaagaccctccccagcctggaccagcccactcctctccaactccctgccctccatgggcagcagagtccaagccaaccccaagttgggtctccagtgctgatcccattcggggctctcccacccacctctccatctcaatccacatcctccctcgctccatcccacaaccctgggccagaggtttcaggcaggggttgccccagctgtagcaagtactgaggtccggggagagctggagttggggatacaggagtggccaccagctggcaggggaaggtgcaacttgaggccaagtctgagccaccatgatctttacccaccccaggcagctttaggaggggaagagagggtgctccccctacaccttccccactggtgccatgctgaaggggcaattggggcttccagaagagaagtccctgtgcccaaagaccctggcaccctagtttccaggtccccctcctattcccatcccacaaccgcctgcctgcctgccctccccctccagttcctccccacccagcacccatcctatcccctaaccccatcccctcccctgcagggagcccagccttgaagcacagcaggcttctccgggtcccccttcatcaccccgatcccgtttccttgtctagaacagaggccagcctaaaacatctgggcaggcagtcctagcgcaagttctggattgggggttgggggacagacactgaggtcagctccatatggattctccagcctgggaacgggtggagaatcatctcatctttgtgagatgagaggggccattttcaacgtcctcccactccttcccacccacacccaagccatctccacatcgagtcctttatccaaaattagtcgtggccccactcagccctctccctggcccactgcaggcagggcatcagagtcagagtaggagaggaggggtggggggagagggaggggcagaggggaggcagcttcagtctgctcattaaccaccttgattggccatttctgcccagaggggcgaggaaggaggaagggcttgtgctggggaaggtgcagggcgtgctcctgccaggctttgcccaagggcaagggagcagggcccatgctttagagtggagatggagacagtgctttgaaccctaaccttgccgggcctgccagccccactcactcactcacctttcctgtagaggagccactgaatgaggtgggtgtctgggacaagggattcccaggacaggagtggtggctggtggtgggagtagcagctgtggctggcaagaagctggtttcccagaagaaggcagcgagtgagcctgtgtccaagcagggagcgggatgcaaggagcagagctggccccagggccactgctgggagcaactgagcagagggctctactagtggggttccctcccagaccagcccaggaggcgggtcagcagtgcaccgcctccttccaggagtcagacagcagtgggccccctctgccagccatggcctcctttaacccctgcaatgccctgctggctgcactctagccggctctggccaggccgtgtcagggcacagacacttggggcaggagatcaccagggagtgtggctgcccctccttcagccactggcctagcagcctccctggggacaggaggggtggggccagaagacttgggggacaaggggggtggggaagggaacagggaggcatcagggccttgagagggccaggaccccatagaagagacacaggtgcagagaaatgtccaaagtgctgctaggtggggaaggatggttgctgagatgatgatgatgatgataacaatatagcaactgtcatcttttcttttctttttttttttttttttttttttgagaaggaattttgctcttgtcgcccaggctggagcgcagtggcacaatctcagctcactgcaacctccacctcccaggttcaagggattctcctgcctcagcctccccagaagctgggattacaggcgcctgcaaccacactcagctaatttttgtatttttagtagggacggggttttgccatgttggtctcgaattcctgacctcaggtgatcctcctgcctcagcctcccaaagtgctgggattacaggcgtgagccaccacgcccagccaactgtcaacgtttctacagcactctgctttatgctatttccaattcattttgtgattgcaggccaggaatctcacttcttttttattttaactttttattttaaaataattatgtgttaacagaagagattcaatgacggtacagacagtacaggtctcatataccctccaccagcttttcctaaagataacgtcttacattacgtgccacatgtgtccaaactaactaatttgcattgctgcaatgctattcagaggactgtgagccttatgaaaatgtcaccatattctgaaatgtctgttttctgttccagaacccaatccaggatctcacattacattggattgtcgcgtcttcataatgtctttcaaaatgtgacagattttccgtttccttgttctttcacaaacaccacactgtcttgattactgttgctttaatggtaatttctagactctgagagctgaggataccgatacacctgtgtgtttagtcagtgggaattttgtacacttttctgtatttacgaaatatttcaacacgctaatacagacaaatgtctgaagctgccttgtcagtcaccgtctctgtgagatgagagaggtcattttcaacttcctcccgctctttatcacccatgtacaagccatctccgcatccggtcctttctcccaagttagtcgtggccccacttagccccctccctggctcataatgtctctaaccccagccactggcaccaccccgcagatggctgccccacctcccgggccccttgctctgccttctgccctcccaatccatatacacacagcacacatgggagggctccaggagagccaggagaggaataggggcatggaagtagcaggactggcagtaggagtgccctggcaggcagcccagatgtccgggtagccactgagccttggctcctgaggggatcagcacccagtagatgtttatccaccccaagaacgagggtatcacacctcctctagtgagggcccaggtgatgggtgcaggctgctcttccctaagcccctgaagaggggagccccaagcagcagcaacccccactggagccagagtcagggcacaccagctgggatggagcttgttccccacagttagaggagggagggagtcacaggcaagctccaggctctcccaagaggccgcttagaaaccagctcatctgatgcagatagacactcatccccatccctgtccctgccactgttgcacaccagcacacacaccttcccctccttctcgccttgatcatccacctccactgcccctggcacctcgctccatcccagccccactgactgtccctgctcctgcccaccctagcctggcccaacaggcaccccctcatccgtgtcaaagctggctgtgtgggaggtggggaggcagggacatggggtgaagcaaggagacccaccaacagggagtcctgaggtcacagggacctagagaggagttacccatccctggtgatgccaaacacctcctcttactctcccagggagaaaccagcgccacacctgtaccaggcagagtggttccctggcagacacctgcctcccagctcagacctggaggagggcagggggctggaggacagcaggggactggaggagggcaggggactggaggagggcaggggactggaggatggcagggggttagaggagggcaggggactggaggagggcagggggctggaggatggcagggggttagaggagggcaggggactggagggaggcagggggctggagaagggcagggtgctggaggagcgcaggggcagggatcctggacagggcctcagacagactgaattgggagggcaagaaagagaccaagggtgcaaagtgagacacagggaacagagaaagggaaggaatgagggaaagacagggatgggagacagggacatgacacgggagacagagatgggggtttcagcctctgcatgggggatatagggacggaggagagggcagacgggctggggcatcccttgtgctggtttttagatgcggttcctggggtttgtgaaaacagccgtcctcccaggcccctgctcctctgcccccatactagcccctgcagcagcccagcctggagaaacgaggacccagcatggaaagaccccagcctcaaggaggcagagcacagccaggaagggaagccccagcccacctgggaaacccacctggcccattgctgggcacaggatctcactggtggtctcacatccatccttttgggaatgagatcaggactagggattcggcactggtgaccagcactcaggtggaccgctcagctgactgaggtggagaaggaaggaggagcgtggtgggaccctcgccctgccctccccactctggagcgctgcctctcagcccaaccaagtgacagagacgagacaaccacaggaatagcagctgcggagctccatggcctccctctgccccctggtggtgagaaggagaaaagcaagagcaggtgctgaaaacgaaaaggaaactagcagcagtcccagctaccacaatggatcagcccccatttggccaacaggtgactctaccccaggtgggcctgagaggacccatcccccatctcaccattctgccccagcgccctggatcctgcctctaccacttcttccctgcagcgtctgcggttcccccaccgctgtgagccaggttccccctccaggctgctgggctgggactgagttacttcttcccaggctgtaaatcctgggactgctgtgcaaggcagagtcactagggacggactctggcagcagagctgcgctctcgtgccccagccagccaggctctcctgggtgagtagcagggagacccctggaacttacggggatagaaggagtgtgatgccaggagccaggggaggaaaatgcctggcagagacgagggagaggaggagacacatggagccgttcatggatttcacacaggatctgggctggaaggggctgccgagaccatcagtccaatctttggtctacaggttgggaaactgaggctcaaggaaggtgagtgatttgccggagatcacacagtgagttcatagccaggccaggatggagacccaggtctctggactcctgaccccgtcctccctgaatcccatgctccacccacctccctcatttacctccgtttccctctccccttccctccactgtgtcccactgctgtaccactgccaccccaccccaaactccaacagccacagcccgggaggcaggacacctgggttttccgctccatgcctggtcttgactctaggatctcagaataaggccaccagctgtcagggccacagtgtccctctctgggccccaggacccatggggaggagaagaggatgagatccccctggagagaaaggcagtattacaaccaggcgccctgctccccacacacacgcagcatgtgctcagccccagccctggggccgtgctttacttctgcaccctctcctcaaagaacacatattttccattcagctggggcacaggaaaggatgagtaggtgtctcgaggagactgagtacccaggcaaggctaggggcactccatggggaaggagtggacacccccagcctagtgtccacatatcatgagccctcacggggtcactcacaccaagtcaggacccagaacacaggccctgtgggcacagacacctgagttcaagtcctgggtacctctgtgatgctggataaaagacttaccctctccaatcccctgtttctcctggtctaaaatggagttaataacctccaggattatgtgaggattgaatgggacaaggacatcaagtgttagcacagtgtcgtcacccagggactgctcaatcggtggaggccacaccatcatcttcacacactggcctacaagatagagctgggattctccccctactaggtaacttgctatgtcacccaagattagtcactttccctctgtaggctctgcgtcctgctttgtgtaaggagagagctgggcagtgaggccgaaagtccttcctgagctcacagtccaagttgcaaggaatcacatcatttccaagtacccatggcagaagagggagccatcctcaaggtcaccaaagacctaagaggtgagtgtgtcctgagagatgctctgggactgagtcatgggagaagtcagggtctgggagcccctccctcagcgacctgacatctgccatcctcccagcagctgccgtctctgccatcctccagggctatggggatgggcaggggccagtgacggacaccagtgccgagctgcacagactctgtggctgcctggagctgctgctgcaggtgggaccttctcctccccttccccatccctctccccagacccagataactggtgggacattcctggaaaatcagggaggagccacagcccccttccttaccatgcactgtgtcatctccctctccctcctgacacctaacctcactcttggagtttgtcactgcagcctaagaagtgaagtggggcaaagcggggctggaagggacccaggcctggtggtgggacccagacctgggggcaacccccactgcttaaactttcagaggcattgatgtcctaggactggcccttcctgctgctactcagagccccaactatgaccagcaccgcttttattgaatacttgctatgtgtcagacttcagcctctatatgcctggctttatgcaatcctcactctcgccctctgagacgcttgatgtccaccccccaacaccccgacacacatcttcctgcttctctgacttcatcttttgccaccctgccactcatctactgcacttcagctcccctggcctcttggatcttcctggagcacaccagtcatgctcctgcctcggggcctttgctcgggctctcccctctacttagaatgctcttccactggaatgcacagcatactttctcagctccttcaagcaggaaggcttttctgggcaccctagattttcaacacacgtgccacacacaccacacaccacagctaccacaatggatcagcccccatttggccaacaggtgactctaccccaggtcggcccgaggggacccatcccccatctcagcattttccattctctttcctgctttatttttttctccgtagcagtcatcactatctaacatactcgatgctttacttatctcatctgtttgttgtcttaactcctttatcagggccacagtgtccctctccgggccccgggacccatcgggaggagaagaggatgagatccccctggagagaaaggcagtattacaaccaggcaccctgctccccacacacaggcagcatctgctcagccccatccctggggctgtgctttacttctgcaccctctcctcaaagaacacacattttccattcagctggggcacaggaaaggatgagtaggtgtcttgaggagaatgagtacccaggcaaggctaggggcactccatggggaaggagtggacaccaccagcctagtgtggatcaagatgtaagtatcaagatgtaagttccatgaagtcagtttgttcatagttgtatccccagacacacagaggagggcctggaatatagcaagagctcaataagggcctctgaatgaatgaataagaacactgaggctcagggaggtcaagccccttgctcgtggtcacacagccagtaaggacagggctgggtctggatgccgggtgtgtctgcaggagccctctcctccagtacatgtcccctcagcaagctagaatgcagggcgtgttctgggaggaagcatttctacactttctttgcctcattttggttctagtttgaccagaaagagcagaagagcttcctggggcctcggaaggattactgggactttctctgcactgccctacgacggcagcggggaaacatggagccaatccactttgtccgttcccaggacaaggtatccagggccaggcagcaagaaggctgacggggtgggggtagacataggcctcctccttttcccccaccctgctctaccgaccatagacccctcacctgctctgcatgtctcctaagccctgcccacagcacccctccagacacccttttcctcccatggcctcaggtccccctgcacccttcccattgccaagcacttccagtcccctctctctgtgttacctgggcgccctttgtcctaatactgctccccattctgcccctgtgcactctgcagttgaagacccctctggggaaaggccgtgccttcatccgcttctgcctggcccgtgggcagctggctgaggccctgcagctttgcctcctgaactcagagctcaccaggtggggctgttgggacatcctcctgccgatgccatctgagccactttccctcctttgtaaaagagccctcctttaacccccacagatggctttctatcaaggacagttacaatgagagtcatgaaggaaaaatcaagggagaaagggcagagggaggttagaacccaggagtcctgggagcatcagggttcttgggcctcctgctcctgaagggccacaactctgcctggggaacagcctcatgacggtgtgtagtggaggctgctttgttgaggttgagctggggtgggggtggttggggcagggggaaacagcaccagggtcaaaggccaagggttctgatcactgttaacacagggaatggtatggaccccggagccctctgctctgcccagaacgccaagaagacatcctggactctctctatgctctcaatggggtggccttcgagttggacctccagcagccagacctggatggagcctggcccatgttctcagagtgagtgggtgcagccaggagagaagtctcttttgacacctggtcccatggccaccaagggtcccaggcaagccccaagccctcagcctccagccccatctgtctctgcctccttttgctccatgcctttggattcttctagccctcgatgctcccagtgcaaattcatggcataatgctgcctagaatatgcactcactaacgacttcctgggtggttgaggtggagggctggaggatgaatggatagctggatgctaggagggaaagtacggatgaatggaggatgggatgcatgagggtgggtgggcaggaaggaggaagtgtcatgggatgaatgcgctagtggaaagatgggataccctccatctgaggaccaagcccaacactgaagagaggcccagggtccccctgcctctttcactttcaggtcacgctgctccagttccacccaaacccagggaaggagacccagaaaaaacaaagatgccccaaagaaggtgcctctgccctgccttcactctgagttgcctcttccccatctccttggcatcctcaagttgagtagaaactgagcttccccctccgagtgtacagagagccctgaccctacaggacagacagagcaagaggccagtgtgtggagcaggggactggggagctgcagaggaggagagggctcctattcctggggtggcggggacactgggagagaaagggaactctagcaccctctgccggagccactgggcccagacaaggagaaagtgctatgaggggcgggccactgaaagcttcaggaaacagatgagagggacaccctctgctgagtcccctgcactggacaattgacacatgactcagttcagttcaagaagtgactaaagacccaggttgcccggttgaattccagccccaccccttacaaactgtggttcttgaacaagttacttgtcctgccccatagggatattgtgaggatgaacggacacaactcacatccagcactgcacagggctcctggctacacgctccccgcatgacagtgtgtggtcaccgtcgttgttatcatcatcccccaagcacattttgcacccccaccagcttccaggcactgggtacagatactattagttctctggtccgaaaagttcagggtctcttcatggagatataccataaaaaaaagcattgcaatatacaatttcagtgtaagtgacacagaaatgaacagaggaacatgggagcacagaggcttcttgagaggttgctcttagctgagtgtcggtctagtcgagatttcatcacaaccctaaaaccgggtattatcattcccattttgcagatgaaaaaactgaaacatgacatgtagttcgggaggaaaaattaaaggaaaggagtgagaggaacttagggggaaccagatcaatacccaagacccaggtgcaggagggagaaggatgtgggctgcgggaagggacagaaggacatcaggatgtccctcaccagaccaaagcatggcgctcagatcacctgggtgttgctaaaagtcagatttggggtttgataaatcaaagcttccagtgagaggacctggtacctatctatttagcaagctgattagattagcactgtggcctaatctaatggcaccaggtcagtgaattggtgctgagagggatgactggttttgggtcctctccacagatcccagccgcatatggagggcctgaaaatgtccagattgaggactcacacaccagtcaagccatctgtctgcaagatgcacccagtggacagcagctggcagggcttcccaggtcccagcaacaaaggcatcttcctttctttttggaaaagaagggggaaagttccaggaaacataggtacccccagagcatgtgggagccagaagggaaggagcttcagctagaccaggaggaaagagccccatggattgagatcttcctggggaactcaacacccagcacccagggacaggggaagggggctatgggcactcagaaggaggtgatagggatggaggctgaggtcacaggggttctgctggttgcagagggtcagagaacaacagaggggactcacaaaaaggaagcagagtggagtcacgtccagaggctgctgatgcccagccccagaggggctgtagagggagcagtatcagggagcaggcaggggtcggggggctctagcatcctgggggagccctgggtccttcagggacacgcaacaaaggaagactctaccgtggagaatccacaagtgcaaacagaagtgacccttgtggccagaagggaggagcaagccgaggtgtccctgcaggacgagatcaaggtgagaacagttgagctccatacctggttatttgcccctgtctgacctggcccacagatgagggtctgcaatggtagcctgggaccattccctcccacgggtcaatttttattggcccactcaggattattatttggggatgcctttgaaagccatacattcttcaggtccccacagtccccgcctctccctattgccccacgctagacccactttattcggcaatacttcttgcccagccccagtaggctttggagtttgagatcccttcccagcagttcttccaggcagtcacttcctctctccagttccatatcctcatgatggtaagtctcttcccgaaatctaagttctactgttgcagagcccacctagttgctcctgtggtggatgcttctcctggaggtcactcaagattgtcaccaagcctcccttcggcctccacccaggaacttgcaagtttctgagtttacaacttccacccttcagtgaaggaagaaaccgtggcccaggcacacccagaagcagggcctaggacagagccaggcatcacagctcccagcactgtccccagccctgccagggcatggcctggggtctctcgggaatgttgttcaggtcagccccagcactggggtctctgcccttctccttcagcctccttctcccctccttccaccccacagagcctcagacttgggctccggaaggctgaggagcaggcccagcgccaggagcagctgctgagggagcaggagggggagctgcaggcacttcgggagcagctcagcaggtaaccttggcaacccacagcacagggcacctggaagtgctccctaggtcctgctgtcaatcacggtcaagccagtgaggtcttgtgagaacctcccatgcaccaggccctggactgggcacacctttgggatctgaggcctgcagggcattgctcctgatcccagggctccaccctccctcctctgtgcatccctttctcgtaggtctcccagagcaggagcagccccaggaaaggccccgcctcctggcctgcttccttcccaccctcacccctgcctccctctgctgcctcccctgggcagctcctctctctttttcaccctctctgcctccctactccactggacttctttcccccatctctttctgtctcccttttttactcagtttctttgtgtctcatttgcttcttcctgttatgccacctctcaccctctcataatcacagctatcatttactaagcatttactacgtcccaggcactgctgtcggtgcttctgcgtaacacccttatgagatgagttctatagaacccccattttatagaggaggaagctgaggctcaaagatgctgcacaattcacccaccattggctagttagcgggggagctgagattcaaggcctgcagctgactccagaaccagtgggctcagacgccccattcaggcagcatgtcgagtgcctgcacttcagtctctccgtttctcctgctcagtgtctctcaccatccagtgtcttcatcttccgtcatcacattgacctcaggggcccacagcacgctgtctgtctctaccatcccccctcagtcctcagtctctcaggtctcagtttctctctctctctctctctttctttttgtagagacgaggtctcactacatggtgcagactggtctcaaattcctaggctcaagcttcagccttccaaagtgctagggttgcaggcatgagccaccacacccagcccataatttattttttaaagtctcttctcactgcagagatcttccgtggcctgactcagcctctctgtgtctctctcctgtggtctccgggtacgtcagtctgcccacctgcccctgtctctctctcccacatggctaacacctgccccaggtccaacagacaccagtcggaccccagcagagcctgagtagctgtgattcagcctgaatcactaggaagccttctggctgtctgcttcgcaggtgagagaggcccaggagcccagaaaccaacccaaaaggacccccaggctcctcccactccacactcagctgagcacacagtgtggtcgcaaaggtttccacgattcagggcaaaatgaacatgggggttctggccacacaagagtcttcaagggttcaagacagtctgggaggagcagctgggaggttatagagagatggcctggccctggctgctccttttactggggaccctgtctcacagaccacagtgctccggccacctgtcactcatcattcagtcattccacaaacaccctgtgcacccactctgagccaggcctgtcctaggtatgggaaatcctctcacagacaaaacaggccaaacgcctgccctcatggagcttgcattctagtggaggaggcaataaaagtgattagcaagtaaagtacctaggatatcagattggaataagttctaagaagaagacataaagcagacaagaggaatgggacatgttggtgtggtattttacattttaataaggtaatatggccagggaagacctccctgtaaatgtgacattgacctaaagacctgaaggaagtgaagatcaagccctttgactattcggtagaatgttccaggctgcgagaacagcaaaaacaaaggccctgatggaggacgggcagggcaggttctaggaacatccaaggaggccttccgggccccagtagagtgagggagggagaggatgtgggaaaaggtcaggtgagccaaggaggcaggttagggagagcctgcgaggtcatcggaagtgcctcgactttgactcagaggaagatgggagccactgagagctcagagtaggagagagacttgactttttttaatgtcaaaaagatgtttacatgctttttcaaatgcttaacaattaaatggtttttagtatatttaagagttatacatccaccacctcaatcaatttcagaacatttccatctccccaaagagaaaccctgtacccattagcagccactcctcattcctttcccagctctaggtaacaccagtccactttctctatagatcagcctgttagaggctggcatgttttttgttgttgttggtttttttgttttgttttgtttttgtttttgagacagagtttcgctcttgctgcccaggctggagtgcagtggcgacatctcggctcaccgcaacctccgcctcctgggttcaagtgattctcctgcctcagcctcccgagtagctgggattacagacacctgccaccacgcccagctaattttttgtatttttagtagagatggggtttcatcatgttggccaggctggtctcaaactcctgacctcaggtgatccacccaccttagcctcccaaagtgtagagattacaggcatgagccacggtgcccggcttgatgtgcgttttaaaggccccttggagctggcctgttagcaggcaagctgaacacagggagtccagcgaggaccctgccatgcaggggagagttggggtgctcagactgggctggcagcatggagcaaggagaagctgccgggctttggatgaagtgtgaagtagaacttcctgaggaattggatatgctgtatgaaagaaagacagaagttgagaatgactctaagctttttgacctgatcagctggaaagctagagtcaccattaactgaagtgtgtgggctgtggcagggcagatttgtagggaaagttcagagcttggttttgaacacgttacgtttgagatacctgttagacatgtcagacgggagccgctgggcaagcagttaagtgtggaactcaggagggaagtgtgcgctgggagatcgatcctggagtcctcagagtaaggatggtgagtaacagctgaccctgaggctcagaagaggatgtgctaccctgatgcctgggagccagggagctaaggacaaagctcactcccgggaaaggagcccgtgggcatcaagctggtgatgagttcctcaacacagagaatagaagtgccgagggacccattcattccatggacatttagtatgcttctacaatggccatgagcaggtgtggtgaacaaacttggcccagcctgctctagaagacctgggacagataaacagatagcaatccaatggccattggatggatgctagggaaaaaaacaaaggcagggaagggcgcggagaaagacaggatagtcattcagactggggtccagaaagtcctctctgaggtgacatttgagcagaagccccaaccacatgaaagactggaccatgcaaatatctagtgagaagtgctgtggccaggggaatgtccggaagacatgcgtttgttgacaggcaggccagatgcatacggggtgtggctgagcagaggagagagcggcagagccggagccaggggcctcaaaggcagagtgaggcaccggaattctctgtgctaccagaggctggggcagggtttagagcaggggcgtttctccgtctgacttctgtgtttaaaggctcactcaggctgtggtgtggaggacagtggaagtgtggtagaagtcccgtgcagagcacaggctgggggcagaggtgagccacagctgacctgaaggcggcaggcttcaggcaggcccatggggctgtgaaaacggactttgggctaagacatggggcttccaacatccacctcacagctttctagctgtgggcccctggggacagtggtctgccctctctgggcctcaggtccctgatttgcaaaaggagacggtgggatagctaaggttcctcctcccagctcagatgctcatggggccatctttccaagcaggtgggtgtcctctgcgctgggaataagacctcaagccaaagaaattaggacaagcatcagccaaagaggtcctcaggatggggaactaggcagatgtcacatgacccccagcccctgcacagcagcactgagctccttggagtcctgccaggctccatcagcatccttccctccctccctcccacctgctgcccacttggcaccagtgccaggaatcactggtgatcagggccttacctgggtgaaggtgtagggaggcaaaaagagttttgatctgggctggcctgtgtccagatttctgccccctccactcatcaagctatgtgaccctgggcaagtgtcaccccctctctgaggttctatttttctctcttgtaaaatgaggattatattatctgtctcctaacattgtgaaaactaaatgaatggggctataaaacaccaagctcaggcctggcatatagtaagtgctcagtaaactaattccttccatgcttccatgtcccctcgtgtgctaggagtatccatcaccccctgattaaaatacttcaggggctccccatttcactgagattaacatctacttttcctgggccactgacagacagctcaggtcctgcccacctccccactcttctcctaccttccctgccccccactgccctttgtggcagcccagattcactcatcttctttcagttcctcaaacaagctcagctccttccaacttgcagacctttacatgtgcccatgcctggctctatattgctgacttttcatcttctgggtcagcttccatttcaccttgtctgagaagcctctccaagaaccctccctggtctctgtcttagcctctcgtttgtctctgtcatagcacttagtttagttattttatgagtctatcatttattttacccctgccccaaacactgtaagatccataggctctgctttattcctggcacctaaacatcccttggcacacagtaggtgctaagtaagtgttctctcccaccccagagacacatgtacacaccacggtgatcacattaagggcccaggatcacagggcaagtaaactggctcaggaaaattaaagtcagcagctaagaaatgaggtgccaaaagactagaatgttcattaaaattaaaaacatggccctgcttcgtgcctgagcaccagaacgctcttggggttgcagtgactgaactctttggaatgtcagtggctgagctgctgacagtttgatgtcatggcccacccaactttcttccctgcaacatgctaaaagggggtgttttaaaattacatgttcaattcattgtcaagcctcttgcaagcctcttccgctcaaacacactcaagccccaggacacacactggcacagacacgtacatgcatcctgagcgctgggactctcacgcatgccacctgccattgcaacgccctcccagctgagccaggggcctcccaactgagccagaggctgggccctggggccaggtcttttttatttccagtccagtggtcttcttggaacctttcagaaaaccactacacacaaaaagaaaaaccaagagtggagctgagacgccaccaagcccaaaactaaaacaaatttaggaaagccatatttttactattacttttttaattgaaaagacaaggtaacataactttttaaaatattttaaagcaaaacaccacctaaatccttcactgctccccttccacacacaattatttccagctgggcaccgaccatccagcctgggttcccaggcgtctgccttccctccagagagctgccatgatggtgaacacacctttcaagaaagttacatcttaaatggaaatgtttaaaaacaaagccgggaggaggaaatgttggctcatcccctccctctaaaggaaaactcaaggcagggccctgttttcatttctctgaatggttggtgaggagtcagttcgtaggtgtcaggccacacacactgtgcagttcagtgtgtggtgtgtatattgtatgtgtgtgtgtaaacgcacatacattgtgtgcatgttgtgttgtgtgtctgcattatggatgtctgttgtgtgtgttgtgcaagtgtgtgtttatatgttgtgttgtttgtgttctgtttatgtgtgtggtgtgtgcattatatatgtgttgtgtgtattgtgttgtgtgtgcgttaagtctgttgagatgtgtcgtgtgttgtggtgtgtgtacgtattgcattatatgtataaattatatgcatgtagcattgtaagtgtgtcttctgtgttgtgcgtatgtgttctgttatactatgtgtgtattagggtgtgtgttgtgttgtaggcatgtgtgtgctgtgtgtgtgtgtgtttgtgtgtgtgtggacttcagctgccgggggcatcaccagcgtctcccatgggctccctctctggaagaggctcagcctagctcaggcacaaaggctgagctttgccccctgagaacctagtcttccttctgtacccaggtgtcaggaagagagagccgagctgcaggcacagctggagcagaagcaacaggaggctgagaggagggatgccatgtaccaggaggagcttggagggcagcgggacttggtccaggccatgaagaggcgggtgttggaactgatccagtaaggacggggacagtgggaaaggggaaacagatgggggaacggtaagggatgtggagcccggagcgtgaaaattctactccactcacaactcccaagcagggttctagaccttttatataagctaacccttctgtttcttttagccactccctgctgttatccccattttacagaaaaggaaactgagggtcagaaataaggcagacttggccaggcgcagtggttcacacctgtaatctcagtactttagaaggccaaggtgggcggataatgaggtcaggagttcaagactagcctggccaatgtagtgaaaccccatctatactaaaaatacaaaaattagccagacatggtgacgtgtgcctgtagtcccagctactcagggggctgaggcaacagaatcacttgaacctgggaggcagaggttgcagtgagccaagatcacaccactgcactccagcctgggcgacagagtgagaatccattaaaaaaaaaaaaggcagacttagtcatctaggacacatagcatataaattgtatagagtcccctgaaaataatgcacacccccacccagacccacccccacatacacacacctactaaggttagggaggagaaaggaaccatgggttgagaaggaattgggagaaggaggaaaaagacaccagggagaacccagaggtgatcacgtgtcctacacctgcctgcccacgggacttcctcagaccctgggcctgtggacctgccctaggtcagctgtcctaggttccagacattgggctcaccagggtcagctccaaaccactaagctcactgagagatggggaagatgcggaaagcatagttcctgccctttagttgagtagaaagagagttcacatacatatgttatcctctcatacagttcaggaaacaggagaccagtggactcaggttccattaaaatttgaaggttgctaagggttttttgtttgcttgtttttttttttttaacggagtctcgctctgtcccccaggctggagtgcagtggcgccatctcagctcactgcaacctctgcgtcccggattcaagcggttctcctgcctcagccttccaagtagctgggactacaggtgtatgccaccatgccaggctaatttttgtatttttagtagagatgggatttcaccatgttggtcaggctggtcttgaactcctgaccacaagcaatccacccagctcggcctcccaaagtgctagtatttcaggtgaggggtcatttagaactaaatcctcttacacaatatccaaatggtattaagggtgagaaaaaggagacatcaacttggaaatgacaaacaaataatttaaggaatagttcctccaaagaatttactgtcaattgggaggaagagagatataaaaagtgaagtattgacctcatgaaagaatttaaggtagccaacaataaaagacatatatatatgattgttaaagaaaactagaaaattaaatggaacatggccgggtgcagtggctcacaggcctgtaatcccagcactttaggaaggtgaggtggatgaatcacctgaggtcaggagttcaagaccagcctgaacaacatggtgaagctctgcatctactaaaaatacaaaaattagctgggcgtgttagcgggcacctgtaatctcagctattcaagaggctgaggcaggagaatcacttgaacccaggaggcggaggttgcagtgagccaagatcgtgccactgcactccagcctgagtgacaagagtgaaactccatctcaaaaaagaaagaaagaaagaaaattacgtggaacatataatagaaaacaaaacgtatatatccccaaagtgttaggattagggttagcattagaactcagcactgagcatattggtagcaggatcaaaaagggaaagacagagtaactaaatctcacttcccatccaaagaaaatatactagttcatcagcactagtttcccagtgcaaaggtgattaatcacaggttctcaggcaggagacattaaactatgtaatacaatgtccctggcagaagcttatggaaaatacgaccctaagcaaaaaacaaaaagaaaaaggaaaaaaaaatagccaccaaggttgacttctgcgtcgggatggtggactgcccacatcttatctattctccatcctgaaatttctctaaaatgactataaaagactaaaacttaaaacggagagaaaagtggaggagctaaccacagaggagagatttcagctaatttccagaagttggaaaatggttggagaagtggatactgtgtgaagcccaagttttttgtaggatccagagatcccagagccacacatggcagaagtgagatgaggaataaagtcattagaaagagcaatccatacctgctgccttctgcctgcctccccacatgcagaatatccagcactcaggggcctatctcccaagcaaatgatcaaaagatccttcactaaaggaattcaagtgccccaaataaaagaccagtttgtcctggcatttgggtgtctggttgtagcaggtagctccctgcccagtccccactaaagggaagccactagtcaaccattcctgtccactattcggagttctaaacagattttattgcctctttcttacacataaaatgacaaccaaggatccccagatatttgaggagagtctagaatataaagggaagagatgaagataaacaaaggaaaaagatccatcttccatgaaacaggatgctataaaaagcagctgtcaaaagatgaaaaacattcttggaaattaaaaattaaattaaaattatgatcactgaatttttttcaattcactaaaatgattagaagagaaagatgaggcagtctcttagaaggtagaataaaaagcacagagagatgggagtcaggagagaaataattagacatacagataatcagtctctgagttccaatgtcctttctaactgtgaggagagaaacaaatgaaacatagcaaaaattaagatgtgagagaattccccagctctgatggacacagatcttcagatttgaagatttcactgagcaaaggaatgaaaaacaaaacaaacaaagcccacagttagatacatcattatgaaatttcactaagacagataaggagaatgtcctaagattgtccagaaaaaaagacagatcacctataaaagaagtagaatccaaccatgtaaacagtctatggtgcaattcttttcaagttctgagaaaaactgacttttgccctagaatcttgtttccagacaaaccatgaattaagtgggggaggtggtggagtaaagacattttcacatagacagatttcagaaaatttgcctcccacatagcctttcataggaagttagttgaggatgtgctccagaaaaacaaggaagtaagccaagaaaggagaagatgtggaattcaggggaaaaaaaatagctctagcctaggagagaagaaaagggaattcccaagatgacaagtgggcagcaatcccagggagcagtcagtctagactgtagcagaaggaccaaggacccaggaggaaggtttctggagagaaagggaatcaagagagcacctgaaatgatgaaaaattgggaggaaaataatatgttaaaggcaagtaatgcaaggaaaaaagaaaggcaattaaaaactcccagaaaaccaaaagccttccaagaaggaaaatgttgtagaagacatcttagctctttgggaagaaatatatatatgtattatctaataatgtaaatattattcattaatttttttcagtgttagaatcaacttaaaagcaaagcacagaaagcaattatgtaattatagaaacagaacataaatgctaccaccttaacaatattatgtatagaatagaatccaatagaatgttctataaaggttgtatatttatgctgtccagtatggtagctgatagtcacatgtagagatggagcacttgaaatattgacctggtgcaactaaggaactaaagtttttattttatttattaatattttaattaaattaaatgtaaatagccacatgtggggtagtggctaccattttggatgctgtgagaaaagacggcaagttagaaggtggaggaaagaggtgagatgaaaggaagagatgctgcatcatcatattacagaacaggagtcataaggatactacctatagttagtagatgaagaaatgaatacatgagtatattctgtaaaaattacaatggtaggctaggcatggtggctcatgcctgtcatcccagcactttggaagtccaagtcaggtggatctcctgagttcaggagtttgagactagcctggccaacatgctgaaaccccatctctactaaaaatacaaaaattagccaggcatggtggcacatgcctgtaatcccagctacttgggaggccaaggcaggagaatcacttgaacccaggaggcagaggttgcagttagccaagatcatgccacagcactccagcctgggtgacagaggaagactctgtctcaaaaagaaaaaaaaaattacaatggtagccaatagaggaaccaaaaataggaatataactatgttaggagggtgagttagtgaggatggtaataaataagctaaatcctctgatatcaaaaggaggagctctatagagaatgttctctattggtaaacaaagaaggaaatataggagcatattacttaaatttggaagtaatttcaaggagagaaagcaaaaagacgtcagaaatggtttgccactgagaacaagaaagagaggggaggccttttgatatgagcacttttgtacgattttatttttaaatcatatgcatgtattattttgataaaaatttaaaacaacccgtcttcctaaatatccttacaagagggagtgaaggtggggaatggtggttcatgcctgtaatccctgcactttgggaggttgaggcagggttcaagaccagtctgggcaacatgtcgaaaccccatccctacaaaagattagccaggcacgtgcctatagtcccagctactcaggaggctaaagtgtgaggatcacctgagcccaggaagtaaaggctgcagtgagctgtgatcatgctactgcactacagcctgggcaacagagtgagatgctgtcaaaaaaaaaaaaaaagaaaagaaaaaagaaaaaagcagtgaaattagttttgcaagggcatacatgtaaataaatacaagacagtttgtactaagtgccagataagagacagtaggcaagatgtgctgtaagtgtctggagcaagaaaccccaggggcctctgtgatcagggaacactcctttgtgcttaaataatgggtccttaaatcatgggtcaaggttattttgggcaaagaggaggccaggtgtcagttgcattctgatctcttgcatgtgtctctcactgtctcttcatttctctccgtctttctctggcccctatgtctctttctctatctctccatctgtctccatatctgtgtcttctcctctgtctccattttctctgtctctgtgtctctttctctgtgtgtgtctctctccctctatatatctctcaacttctctatgtcactctctgtctctctccaatcctctctctctctctctccctctttccccttctctccacccctctctctctctctgagtaaccatctttctctgtccatctttgtatccctccccattgctgtgtctctatctgcgtctctgctcttgtttctgtccctgtctctgaatctctttttatttccgtatgtgtccatgtgattccctccatcaccctctctgtctctctcttcctctctgtgtgattccgtctgttcctctctgtctctctgtctgggtcttttcccatttctatcttttgatctctgtctctgtctgtgtctctccaccttcatccccccatcagagagaaggaccgcctgtggcagaggctccagcatctctcttccatggctcccgagtgctgtgtggcctgtagcaagatctttggccgattttctcggcggtatccatgcaggtaaagggaagggcacagaatcctccctctgggacagcccagtttccaccagctgacagcccccacccaccccagggaagggagggacacaggaactgggtgtttataaaaggccacttacagctgactactcattctaccacatctggcttccaacactaagcagagccataaaggagaagagcagaaggatcagataaggaatggggtccggggagtgggattgggtccccctccaagagccgattgagaaatgggcctctcatctggaagggagcatctgtacagcgtaagctgctccccctccttcctctgtgagcacagtgctaggaccagccttgggagagaggaaagtgagccaccaggagaagctgccatgtggaggtggaggctctggaggggtcgggcatcaggacacccttcaggagaggggagacctcctgagacaaaccaagggcattccactgggagatgagaaacagatgtctcaggtggacctgaagatgctggaactccatgacctcagcgcccacttggggaagtgccagctgcagaggccgccccaggctttcctgcctctgccttccaggctctgtggaggcctgctctgccatgcttgctccatggattacaagaagagagaccgctgctgcccaccctgcgcccagggaagagaagcccaggtcacctgaccaagaccaagaccagcccatgactggcctcccacctgcctgcccatcccactcaatccactccctgcccgtagctcttcccagccctcttgtttgtccagtcctcattctagacactgaagatctaaggcaccagcacttctgtgggcagagtagggtgtggggagtggttccagccctgcaactaccacaacgagccaggtgactttggcgaagctctcagtgctcagggcttcttctctaatgttaagagttgggccccatcctctctaaagtccctctgggctcagcaaatccatgactgtggataagaccccagcagccctgacatttctcctccacactccccactcacccagcagcggtgcccacctttcctgattcacgagaagtgaagcctgcactatcttggactctccagcagcttcctgtctggagtcagcttcagggatctgtgtttgtgttgctgtgtttctttttatgtttattgaagtactactgacatatgataaacatcacagagtgtacaatttgatgagttttgattttaacaaacaccaatgaaaccgtcttcataaacatatctatccaccccaaagtttccttgtgcccctttgtggtctccctcccttcccttccctccatacctaggcaaacactgatctgctttcagtcaccacaggctaatgtgcattttctagaattttatgtaagtgaaatcatacagtatgccctctttattgcctgccttcttctgctgaacttaatgatgttgagattcgtgtctgttgctacatatatcaagaacatattttattgtcgagtggtattccaccgcatggatatgccacagtttgtctctacattcacctgtggatggacatctgagttgtttccaacctggggctattacaaataagattcacatgagtatctgctgacatacacttgtttctcttaggtttctcttgtgtagacatatacttgtttctcttaggtaaattcctaggaatgacatgggtgagtcattatgtttaacttttttttttgagacggagtctcgctctgtcacccaggctggagtgcagtggtgtgatttcatctcactgcaagctccgcctcctgggttctcgccattctcctgcctcagcctcccaagtagctgggactacaggcggccgccaccacgcccggctaattttttgtatttttagtagagacggggtttccccatgttagccagcatggtctcgatctcctgacctcgtaatcagcccgcctcagcctcccaaagtgctgggattataggcatgagccaccgcgcctggccatgtttaacttttaaggaactgccaaactattgcccaaagaggttgtacacttgcccttcccaccagcagcatgtgagagtttctgttgcccccaccccactcccaccaggactcctgcatttggagggcaggaaagaggcacagacacagaacttggacctctctgtcctttcctaccaaccgctatagttctttattgatctcaagttgagagtacctggagggaaaggctgagtctaggtcactctctgtgcagtgttcatttggccagactttgataaggaccattgatgtggactatgtagtactgtggcataagatcacatccctgtattgtccaagaaggcttatgaaaggggtaggtcattcactaggcgcctgattgtggtgcttctgagaataactgttttggaagaagtgcagaccacactctatgataaggtgattagctgccctacacaggttctaagacacattttgtggcccccaacaggcagtcacactgtccttatctgctctgtcttgcaggcactgccagagcctccacagcagttgggcaatactgtggctctgaccagagctctggacggcttcttggggttaggccgcccagattgcatcccattaccttcacatggaacaagagttttgcaacagtagtttctgccctagagagttggtgagaacttctgcttaggaaacacaataacagggtgaggggagaaagtggggggctcctggagcaatcagagcaatagaattgccactaccctaaagggcagcagtccctttctggaaatgaggcttactcacatgtctttactagggcaggattcttactatagcagaagaagtcatattctagcaggaactccagcacaaaattcagaccttcctgatgaattgattggatgttcgcggggtggtgatgggggactggctgaagcccatttcacagagcaaggaggctgctcctggaagagaactcatcagatgggaatcaggggccaggattgggggagctggaccttctcccactgtttggggaaaagaagagcaatgctgaagaccaacatctagctcaacactgcccctgaagagtctgcaccaagtccaatggagagcaaaagagttccaaaaagaaattagaaaagtctgttagactttggggactctcaagcagagagacccacaaagatcaccatagacctcccagagcctggcactgcacgtgcacccgtccttcttcagtggtgactctagggtgcatgtccagcaactgcaaagcccagagaagcatgtgggagacacccctaatagacttccccagtccctgaggagcacattacagggctgaagcccagcatgaatgcatggccaccacaatccaggttgttgctattgacgtgacttcatctgtattcataggctggggatgccctgggtaattggtgcaacataattatttctttaaattagatgtcactgagatgctccaatgtacatcagtttcccctacctgtcaattcatttagtgctcaacaaaaatgtattaagcatctatgatatgccaaacaatgattgatttggagatacgaagataaaaatatgaaagcactgctttcaagaaccttaccatgggggaaggagcagccaaatggatgaggaattataaacccttggctacatttgcaaggtaaagggagagttgtccaaaccaaaagagtgggaaagagcatcccagggaaaagggaaacacatgccaagaccccagaggaaactagaacagccccttgggggttgaggggactgtaggtggttccctgtggctggagttaagggttccgtactgggggtggggggagactgaagtgacagggttggagaagtaacaggagttagatggagggtaccaggtgaccggctcgggagtctgactttacctgagtgtaaccagggtccttgatgaattttaagaggaaaagaaagtgatcaaattcatatattaggaagctcgttctggcagtagattggagggtgggttaaagggggaactatttgaggtagagaacatttaggagaggagggggacggggagaggaggaagaggaggatgaggagcaactaacagagcgaagcatcattccaagtgtttatcagtatagactcatttaatccacataacaaccccatgtaggagctgctctcattatatccacttcacagataatgaaactgagacccagtgagattaaatcacttgaccaaagtccaggactaggtagatggattctaactcacacagcccagtctggaacccacaactttgcatgaccattgccttaggtgaagtgagagagaataaagtattgcctaacactctcagtgaagatggtgaggaggagatagtcaggagtgttcttaaggagaggaagagtaaggagcaggtacatttctggtttggcagatgattgaacaaggaaccactcaggagaaagacgtgtcaggaaatacaatgagattagttttctacatgctgaatttgcaaaatctgtaggccctcagggagatttaaggagataattgcatgtcagagtttggagcttaggggagacacttgttgggagcagtagctatgggagactctggcacatgtcggatggcagctgaagccatgaaaaccagtggactcaccaagagggggcagtagagtgaaaagagaagaaaaccaaagtagaatcctcaggaacctcaatatttgaggaataagttaagaaatagagcaataaacaagacaagagaggtcaaggggaatagaggagaatgggttagtgggattcagtgatatagagatcaagtaagacctgaacggtaactttccaccataaataaagatgaaaagcatacagcaggcaggaagaaaatatcttaacataattgacaaatattcaaaacataattatataaagagctcctacaaatcagtaacaaaatcaatcaataacaaaataacaatccaaggctgggcatggtggttcacgcctgtcccagcactttgggaggccgaggtgggtggccagggattcgagaccagcctggccgacatggcgtgaaaccctgtctctactaaaattacaaaaatgacccaggagtggtggtgaacacttgtagtcccatctactcgggaggctgaggcatgagaatggcttgaatttggaaggcagaggttgcagtgagccaagattgcactccaggctgagcaacagagtgagactctgtctccaaaaaaaaaaaaattttatttcttgccatgcgcagtggctcatgcctgtaatcccaacactttgagaggcagaggcaagagaatcacttgaggccaaaaaaaaataacaaaataacaatccaaagcaaaagggaaacagataagaataactaattcagctgggcccagtggctcacacctgtaatcccagatatacaggaggctaagatggcaggatcacttgaggtgagatatatacatatatatgatatagtagatatatcttttttattaagaaaagaaggaaggaaaacatgtttgtatttgcatagagagaattccaggaaaatgtacacaccaagttgtagacagtagttatctgaggaaaagatatgggtgaacagaggaacggaagagagactttccagctgtgctttatatgcttttgtgcttttttattgcttgtattctttacaatatgcatgctttgttttgtcatattaaaagttttgtgtgtttgtgtgtttcttttttgtttcaatagttttggggtacaggtggttttctgttacatggataagttctttagaggtgatttctgagagatttttatgcacctgtcacccaagcagtgtacactgtacccaatatgtaatcttttatccctcacctccctcccaaccttcttccctgcatcaccaaaatctgctatatcactcttaggcctttgcatcctcatagcttagcccccacttataaatgagaacatatgatatttggttttccattcctgagttactttacttagaataacggcttccagctctatccaagttgctgcaaaagacattattttgttcatttttatggctgagtagtattgtatggtgtatgtagggaaaagaaagagagatcagactgttactgtgtctatgtagaaaaggaagacataagaaactccattttgacctgtaccctgaacaactgttttgtcctgagatgctgttaatctgtaactttgccccaaccttgagcttataaaaacatgtgttgtatggaatcaaggtttaagggatctaaggctgtgtaggatgtgccttgttaacaaaatgtttacaggcagtatgcttggtaaaagtcatcgccattctccggtttcgataaaccaggggcacaatgcactgcagaaagccgcaggaacctctgccctggaaagccgggtatcatccaagatttctccccatgtgatagtctgaaatatggccttatgggatgggaaaaaccacactgtcccccggcccgacacccgcgaaaggtctgtgctgaggaggattagtaaaagaggaaggcctcttgcagttgagataagaagaaggcctctgtctcctgcctgcccctggaaacggaatgtctcagtataaaacccgattgtacatttgttcaattctgagataagagaaaaactgccctgtggcaggaggcgagacatgttggcagcaatgctgctctgttattctgagatgtttgggtggagagaagcataaatctggcctatgtgcacatctaggcatagtatcttcccttaaccttatttgtgacacagattcatttgctcacatgttttcttgctgaccttctccccactatcaccctgctctcctaccgcattcctcttgctgagatcgtgaaaatagtaattaataaatactgagggaactcagagaccagtgctggtgtgggtcctccgtatgctgagcgccggtcccctgggcccactgttctttctctataatttgtgtctgtgtcttatttcttttctcagtctctcatcccacctgaagagatatacccacaggtgtggaggggcaggccaccccttcaggtgtatataaaccacattttctgtatccactcattggttgatgggcatttaggtcggttccatatctttgcaattgtgaattgtgctgctataaacatgtgtgtgcaagtgtgcttttcacataatgacttcttttcccttggatagatacccagtagtgggattgctggatcaaatggtagtttcacttttagttctttaagaaatccccacactgttttccatagtggttgtactttgcattctcaccagcagtgtaaaagtggtctcttttcaccacatccatgccaacatctattgtttttttgacttttgaattatggccattcttgcaggagtaaggtggcatctcattccagttttcatttgcatttccctgatgattagtgatgttgagcattttttcatgtttgttggctgtttgtatatcttattttgagaaatgtgtaatcatgtcctttgcccactttttgacaggattatttggtttcttcttgctgatttgtttgagttccttgtagattctagatactagattctagtcctttgtcagatgcttattttgctgatttgagttccttgattctggatactagtcctttgtctgaatacacagtttgctaatattttctcccactctgggctgtctgtttactctgctggttatttcttttgctatgcaggagccttttagtttaattaggtcccatttatttatttttgttttcattgcatttgcttttgggatcttagtcataaattctttgcctaagccaatatccagaagagtttttccaaagttatcttctagaatgtttatggtttcaggtcctagatttaaagtctttgatccatcttgagttgatttttgtatatggtgggagatggggatccggttccattcttctacatgtggtttcccagcaccttttattgaaatgtcctttactcaatttatgtttttgtttgttttatcaaaggtcagatagctgcatttggctttattgctgggttctctattctgttcccttagtctacatgcctatttgtatactagtaccatgctgtttggtaattgtagccttgtagtataatttgtagtcaggtgatgtcttcagatttattctttttgcttagttttgctttggctttgtggcctcttttttggttccatacaaatttcaggattttttttctatttctatgatgactgatgatggtattttgatgggaatggcattgaatctgtagattgctttgggcagtatggtcattttcacaatattaatttttccatccatgagcatggggagtgtttccaattgtttgtgtaatctatgatttttcagcagtgttttgtagttttctttgtagagatgttacacctccctggttaagcgtattcctaggtattttattttattttttgcagctgtcataaaagagattgagttcttgatttgattctcagcatggtcgttgttggtagatagcagtgctactgatttgtgtacattgatttcataacctgagactttactgaattcatttatcagatctaggagctttctggatgagtctttagggttttttaggtatacgatcatatcagcagtgaacagtgacagtttgacttcctcttttccaatttggatgccatttatttctttctcttgtctgattgctgtggctgggacttccagtactatgttgaataggagtggtgaacgtgggcatccttgtcttattccagttctcagggggaatgttttcaacttctccccattcagtatgatgttggctgtgggtttgtcatataatggctttattactttgagctaagtcccttctatgcctattttgttgagggtgctggattttattaaatgctttgtgtctattgagatgatcatatggttttcctttttaattctatctatgtgatgtatcacatttattgacttgtgtatgttaaatcatccctgcatccctgggatgaaacccatttgatcatgatgtattatatttttgatgtgctgttggatttggttagctagtattttattgaggatttttgtatctatagtcatcaggggtattggtctatagttttcattttttgttatgtcctttcctggttttggtattagggtgacactggcttcatacagtgattggggtgtgggggggaattccttctttctttatcttttggaatagtttcagtaagactggtaccaattcttctttgaatgcctggtagaaatcagctgtgaatccatctgttcctggacttttttgggttggcaattttttattactgattcaatctcactgcttattattggtctgctcagagtttctatttttccctgatttaacctaggaggattgtatgtttccaggaatttatccatttcctctagattttctagtttgtgcacataaaggtgttcatagtagccttgattgattttttgtatttctgtgtgatcggttgtaatatctccagtttcatttctaattgatcttattggatcttctctcttcttttcttggttaatcttgctaatggtctagcaatttggtttatcttttcaaagaaccagctttttgtttcatttatcttttatattgtttttgttttttcaatttcatttagttcttctctgatcttcattatttcttttcttctgctggacgtgggtttagtttgttcttgtttctccagttccttgaggtgtgacgttaggtcgtcaatttgtgctcttgcaaactttttgatataagcatttaacgctatgaaatttcctcttagggctgcttttgctgtatcccagaggttttgataagttgtgtcaatattatcattcatactaaagaattttttaatttccatcttgatttcattgctaacccaaaaatctttcaagagcagattatttaattcccatgtatttgtatagtttgagagttccttttggagctaatttccagttttattccactgtgctgtggtctgagaagatacttgctattttgattttcttaaatttattgagacttgttttgtggcctatcatatgttttgtcttggagaatgttccacgtgctgttgagaagaatgtacattctgcagttgttggaaagaatgttctgtcaatatctgttaaatccacttgggtatagtttaagcccattgtttctttgttggttttctgtcttgatgatctgtctagtgctgagagtggagtatcagagtcccccactattattgtgttgctgtctatctcatttcttaggtcaggtactaaatgttttataaatctgggagctccagtgttaggtggatgtaaatttagaattgtaatatcttcttgttggactaattcttttatcattatataatgtccttctttgtctttttttactgttgttgatcaaaagtctgttttgccagaaataagaatagctacacctgcttggttttggtttccatttgcgtggaatatctttttttcctttaccttgaatttatgagtccttatgcagcaggtcagattttcattagcagccaaggtcagtttccactaaccctttactataattttgatgaatacataagttaaatattaaagaactggagaaaccagtgtctgggtgtattagtccattcttacactcctataaagaactacctgagactgggtaatttatgaataaaagaggtttcattgactcacagttctgcaggctatacaggaagcatggctgggaggcctcaggaaacttacaatcacggcagaaggtgaagggcaagcaagcgtgtcctaccatggcaaagcaggagagagagagtgaaggcggaagggctacacactttcaaacaaccagatctcatgagaactcactcactatcatgagagcagcaagggggttatccacccccaagatccaatcacctcccaccagctccctcctccaacactgggaattacaattcgacatgacatttgggtagggacatggagccaaaccatgtcatcgagtatgaggactagaatgcaaaaacaaacccattaagaccttgtctgggttttctcagaccctaaagtctgatcaaataataaaagcattctaacacatatacctcataccagggcccacttaagattaagaaactttccaaggctctagagaaagttttccagaccccaaactctagttaaagattagatatagattgaatgaaacactctggcttgtagctgcactcccacatgtagtcatagagtgtaaaatatatataagcactggggaaaaatttgtaactttgagttggtctggtgagttgctccaaccttctccctgtaaccatttacagaaataaactcccttctttcccagtctgtctgcatcttgttattggaccctaagtgcaagcagccggacctcattcatctgggaacacttatgtgttatttgtgtctcttgaagacagcagatatttgatgggtggtttttaaatcaatcctgccactctgtatcttttaagtggagcatttaggccacttacattcaatgttaaaactgggatgttctgtctggaattggttccttccggtgggttcttggtcttgctgacttcaagaatgaagccacggacactcgcagtgagtgttacagttcttaaagatggtgtgtccggagtttgttccttcagatgttcagatgtgtccagagtttctcccttccggtgggttcgtgatcttgctgacttcaggagtgaagccgcagaccttcgcagtgagtgttacagctcttaaaggtggcgcgtccggagttttttgttcctcctggtgggttcgtggtctcaccgacttcaggagtgaagccacagaccttcgcagtgagtgttacagctcttttttttttttaattttacattttgttttattttatcaaagttatgcttggttccagatctgtgagacaatatttttaatatggaaaacagaacatcaacaaaacaaacaagaaaatgacttgcagccttgaagtacactcagggcaaggtagtgtgggtgaccatctgattaaagaagctaagtcagagccagaaatcactttatgttttaagtataataatcaacaagtcagaatcacagccgataattaaacttcttaggcagttgcttcatcataacattcatttctgcatacatactttcaggttggaagtagaaattctcaaatgtctgaataaccaatatacaaaaacaattctgaagacgttaattaaagaagcaccttcaaacagtgttctctgattcaaaaagttttaaaaggggcttggatttggaggaatgcaggaggcagccagatggatggggagaaaggaggatggtcaaagaggcagagccctttgctatgagaatcaacttcaaccagaaaagatccacttttactaattttacaaagtaggatttcacatgagttatctttaaaaatatcttcaaagaaagtgtttacttactttaaaaagagagtccaaaaatcactgtcctaaagaatggatatgttttgttacaaaagtagaggcaataagaaatttgtagtatagtgatgttaaggaagaaaactaacttctgagctattgtctacatttctgttcatttaattccattctctctgagccatcccggtgcctccttgttatgagaatacccccttatcttataccatccaacaaacagaatcctgtaattcctttggtagatttgggattctggtttacataactattgactatggcagaaacacctaggatactatctcagtgtgtttacatggttctttttgattctacatttagatggtgcctttttgcttattatgcttgttacttatagggaatgtggttttacaagctaagatcttcttggctgtggtattattccatgtagaaattagctcagctccttctagtcactaagagaccaaaggctgtagtaactctgtctccctatcacctctctggatttctatgtggtccatgactcctgtaagactaatttcttttttttttaattatactttaagttctagggtacatgtgcacaatgtgcaggtttgttgcatatgtatacatgtaccatgttggtgtgctgcacccattaactcatcatttacattaggtgtatctcctaatgctatccctcttccctccccccaccccatgacaggccccagtgtgtgatgttccccaccctgtgtccaagtgttctcattgttcaattcccacctataagtgagaaccttgaaatagtttgctcagaatgatggtttccagcttcatccatgtccctacaaaggacgtgatctcatcctttttatggctgcataatattccatggcgtatatgtgccacattttcttcatccagtctatcattgacagacatttggtttggttccaagtctttactattgtgaatagtgctgcaataaacatatgtgtgcatgtgtctttatagcagcatgatttataatcctttgagtatatacccagtaatgggatggctgggtcaaatggtatttctagttctagatccttgaggaattgccacactgttttccacaatcgttgaacaaatttacagtacgaccaacagtgtaaaagtgttcctatttctccacatcctctccagcacctgttgtttcctgactttttaatgatcgccattctaactggtgtgaaatagtatctcgctgtggtttagattttcatttctctgatggccagtgataatgagcattttttcatgggtctgttggctgcataaatgtcttcttttgagaagtgtctgttcatatcctttgcccacttttgatggggttatttgatttttcttctacatttgtttaagttctttgtagattctggatattagccctttgtcagatgggtagaaagcaaaaattttctcccactctgtaggttgcctgttcactctgatggtagtttcttttgctgtgcagaagctctttggtttaattagatcccatttgtcaattttggcttttgttgccattgcttttggtgttttagacatgaagtccttgcccatgcctatgtcctgaacggtattacctaggttttcttctagggtttttatgattttaggtgtaatatttaagtctttaatccatcttgaattaatttttgtataagatgtaaggaagggatccagttccagctttctacatatggctagccagttttcccagcaccatttattaaatagggaatcctttccccatttcttgtttttgtcaggtttgtcaaagatcagatagttgtagatgtgtggtattatttccgggggctctattctgttccattggtctatatctctgttttggtaccagtaccatgctgatttggttactatagccttgtagtatagcttgaagtcaggtagcgtgatgcctccagctttgttcttttggcttaggattatcttggcaatgcgggctcttttttggttccatatgaactttaaagtagttttttccagttctgtgaagaaagtcattggtagcttgatggggatggcattgaatctataaattaccttgggcagcatggccattttcacaatattgattcttcctatccataaacatggaatgttcttccatttgtttgtgtcctcttttatctcattgagcagtgggttatagttctccttaaagaggtccttcacatcccttgtaagttggattcctaggtattttattctctttgtagcaattgtgaaggagttcactcatgatttggctctctgtttgtctgttaatggtatataggaatgcttgtgatttttgcacattgattttgtatcctgagactttgctgaagttgcttatcagcttaaggagattttgggctgagatgatggggttttctaaatatacaatcatgtcatctgcaaacagggacaatttgacttcctctttctcttgcctgattgacctggccagaacttccaacactatgttgaataggagtggtgagagagggcatccctgtcttgtgccagttttcaaagggaatgcttccagtttttgcctattcagtatgatattggctgtgggtttgtcctaactagctcttattattttgagatacatcccatcaatacctagtttattgagagtttttagcatgaaggctattgaattttgttgaaggccttttctgcatctattgagataatcatgtggtttttatctttggttctgtttatatgatggattacatttattggtttgcatatgttgaaccagccttgcatctcagggatgaagccaacttgattgtggtggataagctttttgatgtgctgctggattcggtttgcctgtattttgttgaggatttttgcatcaatattcatcatggatattgatctaaaattctctttttttgttgtgtctctgccaggctttggtatcaggatgatactggcctcataaaatgaattaggggggattccctctttttctattgattggaatagtttcagaaggaatggtaccagctcctctttgtacctctggtagaatttggcagtgaatctgtctggtcctgaactttttttggttggtaggctattaattattgcctcaatttcagaacctgttattgatctattcagagattcaacttcttcctggtttagtcttgggaggatgtatgtgttgaggaatttatccatttcttctagattttctagtttgtttgtgtagaggtgtttgcagtattctctgatggtagtttgtatttctgtgggatcagtggtgatattccctttatcattttttattgcatctatttgattcttctctcttttcttctttattagtcttgctagcagtctatcaattttgttgatcttttcaaaaaaccagctcctggattcattgatttttttgaagggtttttttgtgtctctgtctccttcaattctgctctgatcttagttatttcttgccttctgctagctttcgaatgtgtttgctcttgcttctctagttcttttagttgtaatgttagggtgtcaattttagttctttcctgctttctcttgtgggcatttagtgctataaatttccctctgcacacggctttaaatgtgtcacagagattctggtatgttgtgtctttttctcattggtttcaaaaaacatctttatttctaccttcatttcattatgtacccagtagtcattcaggagcaagttgctcagtttccatgtagttgagcagttttgagtgcgtttcttaatcctgagttctagtttgattgcactgtggtctgagagacactttgttataatttctgttcttttacatttgctgaggagtgctttacttccaaatatgtggtcaattttggaataagtgcgatgtggtgctaagaagaatatatattctgttgatttggggtggagagttctgtagatgtctattaggtctgcttggtgcagagctgagttcaattcctggatatacttgttaactttctgtctcattgatctgtctaatgttgacattggggtgttaaagtctcccattattattgtgtgggagtctaagtctctttgtaggtctctaaggacttgctttatgaatctgggtgctcttgtactgggtgcatatatatctaggatagttagctcttcttgttgaattgatccctttaccaatatgttatggccttctttgtctctttcaatctttgttggtataaagtctgtttatcagagactaggattgcaacccctgcttttttcttgttttccatttgcttggtagatcttcctccatccctttattttgagcctatgtgtgtctctgcacgtgagatgggtctcctgaatacagcacactgatgggtcttaattctttatccaattttccagtctgtgtcttttaattggaggatttagcccatttacatttaaggttaatattgttatgtgtgaatttgatcctgtcattatgatgttagctggttattttgctcattagttgatgcagtttcttcctagcctcgatggtctttacaatttggcatgcttttgcagtggctggtaccggttgttcctttccatgtttagtgcttccttcaggagctcttgtaaggcaggcctggtggtgacaaaatctctcagcatttgtttgtctgtaaaggattttatttctgcttcacttatgaagcttagtttggctggatatgaaattctggattgaaaattcttttctttaagaatgttgaatattagcccccactcccttctggcttgtagagtttctgctgagagatccactgttagtctgaagggcttccctttgtgggtaacctgacctttctctctggctgcccttaacattttttccttcatttcaactttggcgaatctgacaattatgtgtcttggagttgctcttcttgaggagtatctttgtggcgttctctgtatttcctgaatttgaatgttggcctgcctttctagttggggaagttctcctgggtaatatcatgaagagtgttttccaacttggtttgattctcctcgtcactttaaggtacaccaatcagatgtagatttggtcttttcacatagtcccatattttttggaggctttgttcatttctttttactcttttttctctaaacttctcttctcacttcatttcattcatttgatcttcaatcactgataccctttcttccacttgatcaaattggctactgaagtttgtgcatgcatcacgtagttcttgtgccatggttttcagctccatcaggtcatttaaggacttctctacactgtttattctagttagtcattcgtctcatcttttttcaaggtttttagcttctttgtgatgggttccaacatcttcctttagctcagagaaatttgttattaccgattgtctgaagccttcttctctcaactcgtcaaagtcattctccatccaactttgttccattcctggcaaggagctgcattcctctggaggagaagaggcactctcatttttataattttcagtttttctgctctggtttctccccatctttgtggtttttatctacctttggtctttgatgatggtgatgtacagatggggttttggtgtggatgtcctttccgtttgttagttttccttctaacagtcaggaccctcagcttcaggtctgttggagtttgctggaggtccactccagaccctgtttgcctgggtatcaccagtggagggtgcaaaacagcaaatattgcagaacggcaaatgttgctgtctgctgatccttcttctggaagcttcatctcagaggggcacccggctgtatgaggtgtcaatcggcccctactgggaggtgtctcccagttaggctactcgggggtcagggacccacttgaggaagcagtctgtacattctcagatctcaaactccatgctgggagaagcactactctcttcaaagctgtcacacagggacgtttaagtctgcagaagtttctgctgtcttttgttcagctgtgccctgcccccagaggtggagtctacagaggcaggcaggcctccttgagctgcagtgggctccacccagtttgagcttcccagctgctttgtttacctactcaagcctcagcaatggcagacatccctaccccagcctcgctgctgccttgcagttcgatctcagactgctgtgctagcagtgagtgaggctccatgggtttggggccctccaagccaggcacgggatacaatctcctggtgtgccgtttgctaaggccactggaaaacctcagtattagggtggaagtgtcccaattttccaggtaccatctgtcatggcttccctttgctaggaaagggaattccctgaccccttgcgcttcccgggtgaggtgatgtcctgccctgttccatgggctgcacccactgtctgacaagccccagtgagatgaagctggtacctcagttggacatgcagaaatcacccatcttctgtgtcgctcacgctgggagctgcagactggagctattcctattcagccatcttggaacctccccccgagtgttacagctcttaaaggtggcatgtctggagttgtttgttcctcccagtgggttcatggtcttgctgacttcaggagtgaagccgcagacctttgcagtgaatgttacagctcataaagctagtggggacccaaaaagtgagcagcagcaagatttactgtgaagagcaaaagaacaaagcttccacagggtggaaagggaccagagtgggttatcgctgctggctcaagtggccagcttttatttccttgtttggcctcgcccatgtcctgctgattggtccattttacagagcgctgattggtccattttacagagtgctgattggtccgttttacagagtgctgattggtgcatttttacagattgctgattggtgcgtttacaaacctttagctagacaaggagcgattataggtgcatttttacagagtgctgattggtgcgtttacagacctttagctagacacagagtgctgtttggtgtgtttgtaatcctttagctagacagaaaagttctccaagtccccacccaacccaaaagcccagctagcttcacctctcaatcccccctctaaacaggacactgcaactgctgtgggaattgggcaatgaccactctagctacttcctgctggataggggagaagaaggggccctgcagttgtagtgtcctccagaggggaactctttaggccagtgaaagagccagcaggttggtccagaggtcctcggtagaagttgttagttgagctcatttggggttccacttataagaccatctgtagcttgatggcttcgattctagaggaaacaaatttgacaaggaggttaaaaatacagggcccaaagacgagtaatagcaagatggttgccaccagacctagaaaggggagaagccatgttgcccaactttagaggttggtataagagtttgaaaggcatcctctgatttcagaagccttttcctgtaaatcctgagcagcatctcatactatccttgactggttagtgtaaaaacaacactcttcccctaagaaggtgcagagtcctcctttctcagcagtgaggaggtctaggcctcggtggttttggagagtcactgttgccaaagagtctatttgggattgtagagtaaggatagattttgttatttcttgtaaactgtctgagaaattctttgagagtgtgtggtagtaggataatgaagtagataaactggctattccagttcctgtagcagtaaccattcctaaccctataagtagggttaagttgtattggttgtatggctttgcactgatggacttgagctttgaggggtactgatagggtctgatttcatggggcaatgttaatgttgggacttagaaagactaaggtgcagatgcctgtccagttagtggggaggcagatataggtcaacattccacataagaagaatataccttggctgggtagacagaactggttgtgtatgttaaaaaggtgtgtgagtttgttgttttcattttttcatatttctagagtacttgccagggttgctccagtgagtggctggaaaggggtgttgggagcaaactgagtggctccctgtgttctattttattttcattccggaaggagctacagtatacagtcctatcacaaagagtatggttagtatgctgcttaataatatgatgaaatagtaaaaggattccattaaaggggcaaggagaggtgttaaagattatgtaggttttcatttatcttttttaaggaggaaggggtttttcttcaggatcagtggtaggagccttttttgtctcagatgtttccttccaaaatagaagatgcaagtcctccaattgtttgcaggtgtatcaaggctggtctggccgat

SEQ ID NO: 1769 - DNA, 190265 bp, Homo sapiens
  LOC442077 gene - 25190893 - 25341157 of chr3; NCBI Entrez Gene ID: 442077; Build 35; sequence includes 20,000 bases upstream of initiation codon and 20,000 bases downstream of termination codon of the gene
gtcttattctatctgtgctaccctcattaatgttctttggattcatcatggcggagaccaaagtcttgggccctctcagtgggacccttgcaatagtctcctggctggttgtccagcctcaaagctttgctaccaatccattttccacacagctgccaaagtggcctttgcatatctcacaatgtcatgtccctacttcagaccttccaatgactcaccagtgggtacatgcaggagaaaagtccagttgcccaaactacatgtgtagggtcttccatccagatccttcctttccattccaatctcttactactccccagctcagagtttacattttctatattttgtgcagaaggcccttgcccagttcagttgtcacctttccccaaccagtcctttgttggctaggtgtgcatcctgtgtgctttcataatactcgcacctacctacatctgagcatggcgccaaccctaaaggcttgtcttttccccagtaggctgtgagctacttgggaggaagcaggggtggcatgagcatggcttttacttttgtattccaacatccaatgtaggacctaacacatagcaagtattcatgaaacttgcccaattcattcaatcacttgttaacattttatcattctcacatccaattctgttatttcttctcattgccattctctgatttagattttatcactattctctttccgtatgcattatattccatctaaaatgaaatattgcttccccaatatatctgtcttgtctgctcaattcttttttttgtattttttagcatttttcttccatgctctctgttctgtcatgtcttttctgctttcctgccatgaaagtgatcaccctcccttttagaactaattctcttccccctgaccccagcacacgtaaactttatttgcattgcattgctattattttgtagcagtcactattcccttgttagattgtgggcagggattgttcctcccttactgtcttccctcacgggtctatctcagtgctttggtcatagaaggggctcagaattgaattggaactgaacagaattgaataaactatccgtttatgaaataatttgctttagagttgctagaattaaatgactgctccagtggcaatattactctaactcactaatatcatttgatccactgaggagctagttaattaagtaggtggattaaaaatataatctggaggaagaatgttttggctgggacccacacactttttttcaaaaagctttatgatctctcagctacaattcctcttgattttcacccaaaacagcaataggactctttccacatgactgttgatggctggcttaggaacacaaggccatacacctgtgtgccagatgtgctctgcagcctgtctgctaccccagcccatctgcaaagcataccccatgctggctcctttctataggaaagggggcattggttcccagcctttttacatgatagcttccctggtgtttgcctgttttccttaacttaaaaccccctccattgaatttcaatgtattgggtgacctttgccaacacaggaggccttagttcatttgtttattggtgagtctgctttttctctgtgtgcttgattttttgcctggcaatttttcgacttgtatcaccatttgtgagagtgctgtttggtcttctgtagccaaaccagccacatcagcatcaatagtagttaatagataatcagatcctcagaatttccatgtggtgccgaagaatgtcgtctgatactgaatgtaactttagcaggaatgaatgggatttgataacgaatgggtctgtgttgatggacactggggacaaggtagctttgtgatcttctttgtttctgtaagaatgcctctgcaactgaattcagcccatttctatgccaatgtgctaatagttgtggaatctcattcatctcaacagaggccagttagccctggaatcccatctgtttgagtggatgcagtaaaatgtcatggaaatgtggccattcattgacatcactagtgaatgctttcttgctattaatttcccttcattttaactgactctaatcacacaaattctagccccaactgcaaaaaaaaaaaaaaaaaaaaaaaaaaaaaaaggcagttagacttttcacttaatttttaatcctaatttttaaagtgcttgtccacagagaacaaaacagttattttaaaaatgtgcacagagtctaaatggagatgctctcgttcctacaacacattaaaaaaatgcttcagccagtatttttgagtccttcttggcataagatgtccaaggctgtattttggcccagaggaatttttaggctgattatttttttccctcctgaaagagtttaagaaagagaaacaggctgagtcttagctagaacaaggctaaaagaggtgctgtctctagcagattgctccagtgacacaatagttaggaatgtggcaggcctttcagttaaacttctggctaactggacagctgaaatattggagctaggtcaggctagagatcgtagcaggcacttgtaaaacctcagtcagcggaaataatgaccacgttcatacgtttgtcattttcttaataaatctcctaaattgatttttaagtcaagaaatttgacttctaaaaaaggatgtatgtatgtgtatgcatgtaaacatacatctgatataaataaatgaatggataagtaatacaggaaacaataaggtatctgttcaaaacaaatatgggaaaaagtgttttgttctgtttccagctatgtgtgaatgtgaactggcttaaacatgcttaaacttatcaggtattttcatggagtcaacaatattaacaaaattaacaatgttaacaatattaacaataattagtgcttccttagtgcgaggcacagttctgagtgtgtgtgtttgtgtgtgtgtgtgtgtgtgtgtgtgtgtgtatatatatggttttttttgttgttgtttttgtttttttttgagacagtgtctcatcctgtcacccaggctggaatgcagtagtgcaatctcagctcactgcaacctcagcctcccaggtgattctccagcctcagcctccagagtaacaggactacaggcgtgagccaccaacacccagctaattttttatttttagtagagatgaggtttcaccatgttgaccaggctcgtctcaaactcctggcctcaagcgatctgcctgcctccgcctcccaaagtgctgggattacaggtggaagccaccatgcccagccctaagtatctatattaactcatttgatcttcttcacaaatttgtgtgctaagtcctgttattttctcattttttaaatcagaaagctgagactcgagattttactctttgcctctaacagaagcttgattgctatggtttgtttccttgaataagactcacctctttatttgcacggtgtgaattcacaaagcaatgtgctgaccaactttaaatcaactgatgcagcagactattgtttatccagaatgtctgtaatttaacacagtttgaattaataacttttccaaagtgtggttatcttgacttcaaaagaatgcacgtgtataaatagcaattttctccataatgtgatatttgcaccaatgaagttaaactactttaaacataatttccgacccaaacacataagcagcaaagaaacattactgctcacgtattaccagccagcctatcaagataatactgctctgtttccttacaaactttccttcccatatctttatcctggggactggctaccataattttacctgagagatcacaccatcaccttatatcatatagaaaaccaaatcacccttcaattattagaatgctataattattgaaatattaatcacttagaaatattatttttcaatagttccatggcttgcattctttgttacaattgcttataatctctcccataaattcaagtgagtgctgttggctttcaagctgatccttgaagaagctgtagacctatttcagtgatgctactaattatcagattgtcatttgaattcttcttgttttttaattgcctttgtagcaagtattggttttaggggggaggtggtaactcttcttccttaagatatatttgctttaaaagaataatttcagaagaaagtctagtcaataggggcagagaagatttgggaatcaaaaattgaagtacaaatataaagtcatgaaattattatctttatgtaattaatgactttatttgtccagttataacatagatctgcacatttcagcaactaaatacaataaagatttatttctcactaatgtcatcatccagtgcaggcacgtaggaaggctgtgctccatacaactattcagagacccaaactgcttcccagtagaggttctgaggttttctaggtcctcagagttctgtattgaaccctctgcattcagtcagcaatagagagaagagagagcctgaaaaattctgtaggcgatttgggggactaggcctggaagtggcagacatcacatcacccacgttctacaggccagagctcggtcttatgcccccagctagatgcagaagaagttgggaaatactgtttggctgtgtaagtgaaaaaaaaagaaaatgatatttgatgagaatatagtaatgtctctgccacatttcctctagtgatgatttctcccaagaaaactgttccaaattgtcttttttttttttttttttttttttttgagatggagttttgcttttgttgcccaggctagagtgcaatggcgcgatctcggctcaccacaacctccacctccccctccccggttcaagcaattctcctgcctcagcctcgtgagtagctgggattacaagtatgcaccaccacacctggctaattttgtgtttttagtagagaccgggtttctccatgttggtcaggctggtctcgaactcctgacctcagatgatccaccccccccgctccccctcagcctcccaaagtgctgggattacaggcgtgagccaccgtgcccaacccaaaagtgtcttgagtaatagcgtcatctgaataagttgtgagccacatactatgactgtctggaaggaaaagtgccacttggaaatatattctggttgatttcttatatgatcgtacattttatccatattgcacacatggcttcattcagatgaatgaagcaaaacagctgtatcctctttgatctcttagtcatcttttagaggtttttctgacaacaaaaaggggggcaggtctcagaatgggagtggaggccacacagccaagctgccagagttagggagaagaaggcattgggataacttaaaatgtcatttcctaatgtgaggaggccaaacttcagtattcaaatgaggttaaacttttatttttcttctaggtactaacaccccaaacacccacaaagagaataagggagataattcagacacatctttattttgggggaagagaaaactacccattctttctcctcccaactctcttgaaaaccacaggctaattaagacagcaaaggaaattcttaagtacaaaacgtttaaaaaacaaaacactgagatttgatatttttgtttcagcttctctctataaactcacacactggtgcaagaaccctgtcattctttcctgtaactgtttaactgtctccatcatatctatttgaaatagatgaaatagctctatcatatattatctctaggctctggtaattttcaggacagctctaaggctgcagataaataaatgaccttacataatttccacatggcaaagtggagaaagcgaaatagccaaatgaacattttaacattttaaagacttttctaggaaatgttgcactttcccaataaaattactgcactcttgccttacctcttgacattactttgacccctggcttcttctagaacccacgtcttttatagaactgacatcatgtggctttgtccctgctgcagcattgcagggagttttcatagccagcagtgagcatcttcaagtttctctcactacccaacaccacacattggattttccactatgtgtgaaaaacaacaacaacaaaaaacctggctactgaatccaggagaaataattggtcagtatttgtggctcatgctcttgattaggtcctctaaggaggctcagcatgggttgatgtattaggtttttattgttgtgataacaaattactacaagcttaaaatagaaatgtattatcttatagctctggaggtcagaagtccaaaatcagcttccctgagctaaagtcaaggtgccgccatggttcgttctttcagaaggatctgcaaggagaacttgtttccttgcccttttcagcttctagtggcttccccataggccttggtctttggctccttcctcaccttcaaagcacatcaccccaaattctgcttccatcacatcaccttctcctcttctataatcaaatctccctttgcctccctcttgtaagaatccctgtaattacactgggctaccagataatccagtatcatctcctttttgttgttgttgttgttgttgttggagatggagtcttgctccgtcgcccaggctagagtgcagtggcccaatctcggctcactacaacctctgtttcctgggttcaagcgattctcctgcctcagcctcctgagtagctgggattacaggcacccaccaccatgcccagctaattattattattattattattattattattattattattttgtatttttagtagagacagggtttcgctatgtttgccaggttgctctgaaactcctgacctcaagtgatctcctgcctcagcctcccaaagtgctgggattacaggtgtgagctaccacgcctggctgatgtcaagattcttaactttaattacattgcaaagtccttttgccatatgaggtaatgttctcaggttctgggaattagaacatggaacctgtgggggccattctgctgtctaccattgctggctctgtttcacagagacctaactccatgtccttttaatgttaatgtagaattgtaaattaacgatacttctgcttctccatactttcatcgtggtctccactggctcacaaatgtaaaacactcaagattctcttccactggctcacaaatgtaaaacactcatcattctcttccaccattttgccttcccacttttcttagtacatattcttgtgcatatctctttgcagagctagttttgtgtgtgtatcttactcacttcttttttccaaaatgttgaatatattttaaataacagatgcaagtttacaacaaaatgtcttctagatattccctgaagatgaataggggaaggggcccatggaatgtatgcatggtgaggaccacgacctaaccctggcagagccccctggattatgagagccttccagggaaagaggctgcatggtacccatagaaaggctagaccctgtgcccagggtacagagaccaagacagacagacacacaagacaatctggcctcacaccttgggcatgtatcagcagaacctgtgtggactgaggcctgagatcccaaccccaggaatgggtgtgtgggttggtttgtgtatgtatatatgtgcctatttcttttttaagtttattttttagagacagactctccctctgtcactcaggctgaagtgcagtggtgtgatcatagctcatgcagcctcaacctcctggggtcaatcaatcttcccccatcaacctctcaagtagctaagactataggcaagcaccaccatgcctggctaaattttttatttttatttttgtagaaacagagtcttgctatgttgcccaagctggtttcaaactcctggtctcaagtaatcctcctcgcttggcctctcaaaatgctaggattataggcacaaaccacacgcccagccattctttttaaattatcaagatataattcaaacaacaacattcaccattttaagatgcacaattcagtagttcttcgtatattcacaaatttgtgcaccatcatcacaatctaattgcagaatattttcatcactctaaaaaggaactccacactcattagcagtcaccctctattctttcctccctctagcacctgacaactactaatctactttctgtctcaagatttgcctattttagacatttcatataaatggaatcgtataatatgtggccttttatgtctgggttctttcctgtagcataatgttttcaaggttcatccatgtaatagaacaatccctacttcattccctttttatggtcaatcaatataattttgtatagatggaccacttttgtttattcatcaattaatggacacttggattgttttcactttatggatgttgtgaataatgctgctataaacatttgtgtacgaggttttatgtggacatgttttcaattcccttgactgtatacagccagaattgaaattactgggttatatggtagttccatgtttaactttttgaggacctgccaaactgttctttaaagtggctgaaacatttgatattctcaccagcaacgttaaagcatttcaatgtctgcatatccttccattgcaaaaccttgagagagggagaaaaccctaatagtgggctgaatgtcctattatgtgtcaggataaggatttagagtccagtcaaatctggattaaataaaatacagaaactagacatttcttccacacctgaaaaataattatttgtggtgtggtggctcacgcctatgatcccggcacttcaggaggctgaggtgagcagattgcttgagtctaggagtttgagaccagcctgggcaacatagggaaaccctgtctctacaaaaaaaataaaaaattagttgggcatggtggtgatttcctgtagttccagctactcaggaggctgaggcaggaggattgcttgagcctgggagggcaaggctacagtgagccaagatcatgccactgcacaccagcctgagcagaataagaccctatctcaaaatatatatatatatatatatatatatatatatatttgtttatttggtcttgccttccttatgtaatatcataattctaatgtagtgctttctaacatttttccacatcaaggaacacacagaaattaataatatttgcatggcccttggtggtcaataaagagtctgctaagggatggactcattgagtcaaggaccccgttccctcactctcaggccccaccaagccactagacgctggggagaccaaagtcacaggcatacttctaatccatattctggaacaccaattagaaaactctattccactaaattcagttgtgatgtttcttttgaccttaggaggtaaaggtagtggggaatgaaaagagcatggaataggagaagacctgagtatggtaactttcctggccataggtcttgttctcaaaggaactaactgcgtctcacacagtatgcaaaatgggtactgattcctctccaaagagcttggtatggtggacaaagaacagactacaaggagtgcagacagaggtgtaggtcagggttgtgtggtgacattcccagactggctgcctggcttgataaaaaaaatgcagctcccagaagcatgaggatacagtctggccactggggagaaggtagctggaaagaactagttattatatctttgacctcagccagaaggtagtaggggtgggtgttggaggatggtcaagtgatctcacccgagaaactgatgagaatgggtccaaatatcacccatagcccactggatattgagcagcaagactattagagatcctgattgccattataggaaggtcctaaggtgtccttaacctgcttcatataggtgggaaggccagcgttaatgctgagcaagcatgggcaacccatgtgtgcagtgacctgacattctgtggcaactctgacagtcctgacctactatggaaccatgtgaccatctcatttatttgaccacaaataactcaaatgtaccttgaaaattcttgcttttttgttgtcttgacttttaaattcaagtgaatgaacttgttaaaaatacatttatggctagacttgattttctagaatagatataccccttcaaattataggtatgttgtaatatttaaatattaaatacttatttaaatctgctactttggggaccctattatggtttcaattatgtgaatttttcttttataaaatgaataaatgttccataaacttattttcaaatagaaatgggtacgcatacatgctgagtttgactatagcaagtatgctgtgtctgtttttaactctctatcttaaattataaactacaagagttcaggaatctcagctgtgtctctgtcttgctcttttcagcactgtgtcattcatgaatgaacacttcctaatcccactcagtaacatatcaggcttaatctcaacgtgcaggtcgaccttcagccatggtctgtgatcacagtcaactcaagattgggcaccttactcttctaaaaggggcagttaagtactgagttagtatggtccttctgggatctaaggcctagagagataatttgggagttttttttaagaaagaagaaagaaaaaaaatacaaaccagtttcaatggttaaagacaccggcctcacaatgtctagaatgccgttcttgacactaaagccaaactcagaagcacagttgtagctactgtgactctttttgtctctgtttctatcagtacattgcttctctgctctctctcatgtctcttgtttacacgtggtttctgtagtctcatggcttctgccaccttgcttttctgtatacatttccatttctatgccagtcttctctctctgtctttctaggtgtcttaggcattcaaaaccaatcagcagtaagactctgataggatagatgggtcaacatccaatgtggagactcccactgggcacactactgcttccaagctctctctcaggcatctgccagcctgtagatcctgtagatagctgaatttcccttgagaaccaaatcctaggccagtcattcgcttggcttgggaggattccataatatgtagcatggaaactgttgtacaaggagttgcctaccaccgcttttctcaaaaacaagcaatggtccaagcagacctttagtccaatacatttataccttacgtttgggaatatacatgaaaagaccttaggtgaagcctgacttcagcatgtgtgtgcattgctagcagatgtaacaactttgggttgagcattgactccctaaaaacccctatttacattactactctcatagtttatagaagtaaaatctcagtgttttatacattgtaatatatgtgcatttctgcctattattttttctgaaagtcatatttgaactctgtttctttagcagatggaatcttacatatttctttttaaaatggcctaaaaagaaatacagggacattctttctaagcttcttaaaaaaaattttactgtattaaatgacccctcctgatgcagaggaagctatttagatttcatcctccctcactcggtggtctaagactcctttgactgcattatttcctctaaattactctcttccatctcctttattcccaaattaaaaggaggtaagaaatgcctctttttggccaaattcaagtttttccattacggcttctctttaagttgagagtaattttatcagcaatatttatgataaggatgctgaatatacgagaggttgcaaaaccaccaggcatgcaaaactgacttctttacatccatgtttcttttctatcaagaacagcagcaaaagcaactgacaggatttgtgctgagcctggtatttttgctgaaaacaggtacttggctggatgcatctgagaaatttgaagtggcattacctggaaccaatctcttaaatagggaggcttgagctaaaatacattgggaaaaaaatggcaatatatatgtagtgtctgtcaaagcaaagatttccccacaccaagttctaaatcagccaaagaagtacaaaagaatttgttgtactctatcacaagacattgaaaaaatctctctttttcacttatttctgttttttatgttagccacatcagccacattgtgagtaaattgcagccagaggaaatggatacgttttctccaaaaatcttgtctgttttgttgcttggatcactcttgaaggaagcacagtgtaaaactaacacttctcaccatttcaaagtgtttaactcctgtgtctcaaggccaactctaataagggtcctgtctccaagctagggtcttcaagaaatcacatatcaagtcatcaatgcattaagtggcatttcacattatccactacatttgcagatgtgtgtctaaggcaagccaaatcccatctatattttatttattatttgtagaagacatttgacacatccccatggcatgtccataatggcaggtcaaatctcagttttttattgttcaatttcagattggtgctgttactgcctttctcttgccacaagggaatgccaatttagatattgatttaatcttgtctcatctgtggtcttgagtgaaccgtttcctcatagttaaaatattatttaactccctcttcagagaagacatgtagagctgaaaaggttaaggaatcatccagtgtaggtttcccaaacttatttgaccacagagctctagtttttaaacttaatgaacatccagtgaaatataatggattaaaagacgtgcactttttcctgttctcaaatcttcactaaaatgacaggagatgtaaaaagtataaatcatcaaagataacaagaatatgagtgatgctaatcactgacaagaaatggcaccaacttttttggaagatggacagcaaatgtgcagtgtcaaataaatgaacaaagtactgaaagcagattgctaggtgtctaaagaagaagatgaaaaggggatgcaaggagatactagcagtggaatcttggccagtcccagagagcagaggcaccagctatcctgaaacaaggaagtgatgatggaaaggaaaattggttgttgttgtaagtaagcagaagataaattcactcctctaccaattttatcttgattattgtaacccatccctggtaagaaaggtaaatctactctttgaagaaactaaatcagaggggttactgagttctagacaccaagcatcaatataccatagggtggtagtggtggactgaaaactggaggaagatgtgaaaggccacatatttcatagtaagtccaccagcagccccagccttattcctccattcgaatactagagtctttcataaggtttttttctttccaccctaccctgggcagatgcttacaggattgctcaatggagttatccaagagtcccaaataaaaagcccattaatctgacatttggggagtcccacaatgaaataaatgtaacagttatataactttttatgaaattcactcatttgacaaggttcagccatggaaacaatttgcaataaacttcctctttataatatgaatggacagactagagaatttggcagacaatacaaatgagaaatacatctaatgttaatggaaataaaacagaaaaagtaaagagaaagagtctataatatagtaagcagaataaaacactgaaaaggacatttctcttttttttgtctttttctttttcttttttgagatggagtgttgctctgttgcgcaggctggaatgcagtggcacaattttggctcgctgcaacctccgccccccaggttcaagcaattgattctcctgcctcagcctcccaagtagctgggattacaggcaggtgccaccatgcccggctaattttttgcatttttagtagagacagggtttcaccatactggccaggctagtctcaaactcctgatctcaagtaatccacccacctcagcctcccaaagtgctgggtttacaggcataagaaatcacaccccacctagaactattcttaatatcctaaaaaatatcagaaaatacgtggcagtcatgacaaagaacaatgtataaataagaaaagacaagaaaaacttttagatgttaaaaatatgttaccataaatgtaaaaatcaatagaataattggaagttaaaggtgaggatatcttccagaaaagagaacgaatggatgaagaagcggaaatggagagaaaatagagacaatcaattctgaaggtctaccatctaaataagatttccaaatggagacaacaaaacagaagttaaggaagatattatcaaaggaagcataaaataaaatttttcctaacaggacttgagttagcagattgaatgcatttactaagtgcataacacaatgaagcagggaaagggatccttgagattaaagagaagagtacaagaaatggaagaatttcacacacacaggatcagaaatctgaataatattggacttttctaaagcaatgtaaaaagcttggggaaatggcacaacatacttaaaactctgtttaaaaaaatgacttctaatccacaattttatacctagccaaactgttaaacatatgtgaagtgcaacacaaaaatattgtaattcatgcagagtctcaaaaaatttacctcccacataacatccttcagaaaactcttaggaaaaaagctacccaactgaaaaaagccagtaaagaaagacatgagtttcaggaaatggggattccgaaaaaagagagaagcaataatagaaagtcctagtctgacatcagtgcatgtggctaggaaagaagccaatcagccctggagcaggaggaatgtctccaactgtggaattcatttatcacatgacatgccagacaaaattgctggagacttagcaaagaattattcacggatataaagaagactaatcaaattatgtaaataaagctgttaactccaggaaagaaacaattttataagaaaactataaatgcagtatatcacgtaactcaactgtaacaatatttatctggtcataatataaacataatgtaaatgatttttatttttaaaattgtgataaaattatgttgggagtaaggagaaagaggtttctatgtgtgggcaatagtttaagagagttatatcatatttatagtaggaaccaatagataaaaaaaattttggctgggcacagtgactcatgcctgtaatcccagcactttgggatgccgaggcagaaggatcacttgagtccaggagttcgagaccagcccaggcaacataacaaaaccacgtctctacaaaaaatacaaaaattagctgggcctggtgacacacacctatagttccagctactctggagactgaggtggaaagattgcttgtgctcaggtgtttgaggctgcagggaactgtgattgtgctgctgcacgccagcctgggtgacagagcgacaccttatttcttaaaaaaaaaaaaaaaaaaagaaagaaaaaaaaaaagaaattgaagtacttgcttctgaggggaactcaagaatgagaaggatagagagctgttattctttatcagtctcaagcaggggtcagcaaaccacggcccatgggtcaaattcatcaggctgtctgtctttacaaatagtgctttattggaatacagccacaccaaatcatttatggattctctgtggctgcttttgtgccaaattagttgctacaacaagagagtttagcagtagtgacagagactgtatgaaccacagtctcaaatattcactttctggctctttacagaagaaatttgccaacctcacgtctagagctgtggctctcaaatgttagctgcatcggagtcctctggagggcttgttagaatgcatgtgaggggaggctcttcccagagtttctgattcagtaggtctctccggtggggcctggagaatttgcatttttaaccagtttgctggtgatgctgatgttgccagctgagggacccactttgagaatcactgatctaaagaaactatttgacttttaaaaatcgtgttgtaagtattatgtttataaaataaatttgaattgtcgagaagtataaggttggaagcttacatgcaaatttgagctaaacttaatacaaaaatgacctctcgtgaatgaaatgcaacagaaaatcattcaaatgttattttaaaaatgttttcatagaacaaaaataattgtggaattgatttccacaattatatacatacagagaaaaattatatacatatgtgtggagaaaaatagaaaaataaattattttgttaataagatatcgtagatacaggcataaatattaaaatttgtaaagattaccaagaccctaccactaaatgtgcatgtgtgattcaagtggttgaccaatcatgctacctcctgtctggcgttttgtttatcaaaggcagattattgcataacaatatcaactataccgacaattattattttaatcttttttttttcatttagtatgttcttgtaaaacacttattttctggaaaatgcagtttgagaaacttgacataaagcctacttctcttcacttgaccccttttacagattctgaaactgatacccagagaatctcttggctggtagatccaagaccttctaacccagtccctacttccttcctgtcttccactcagctcctgtttgccttgcctgaggtggtgaaggaaagaaccccagatgagcacaaactcaaatcagacttaaagaaaaaagagcactgctaatctttttttctaaaagcctgaaacaaaggaaattctctgcttccaggaatagccttaatcagtcacatatgtgaacatagacccagtgactgctcagacaattttccaccaacctaatgtcgggattttctcgacacattgatttttttttttttttttttttgcctattatcagtataagcagtttaaaaaaaaaaaaaaaaaaaaaaaaaagcccagacatgataccagacctctcaaccagacaggcaagatgctgacaatctgcagcgtttgaaagcaaagagaaatgaaggattattgagggtggaataatggttttttcccaaccagtccctggttggtaaaaaaaaaaaaaaaaaacagctttaaaaatcagaattgtgccctgcgggggtggatttgctgaactgtcagctccaccagttaatgaggtagtttgtcaaatggagatagaaagaccatttataacaatgctatgctttgtgtgtgatttaaaaatcaaattgagtggaaactcagcaaatactaaattgtattgtttattttctaattaatttgctacaaactacaaaataaaactattgaatatattggataacgtatgcttttttgaagaaaaagcaccaaaatcatctctgagatgaaaccgattcagaggctgtttactttcttttcatcagagaaacaagttgtagtttgaaagtttgaaaaaggcattgaaattttgggtgggatttttagaattagtgtgttgtataagccaacaggcaatgtcatctcctttgtaagttcagcggagtactagggggcctgggaccatatggtctcactgttgacactgttcgtttttaatattaataggccagggattcaaggccctggggcagatgtcatctaagtgaggacagaagcaaatatcacgactgctcactgagtttttcctctgtagagtacaaccagcataacaggcgttcaaaatatataagcttagcttggcagaggggcaagagcagagaaggtgattcaaattctggcttagcgagggcttactctgtgacattgaggggaattcattgaaactcactgagacctactcttctcatctggaaaataaaaaatatctgccttaaaaagggttagagcttatagtgaggtgcctcacatatggtaaatagtcaatgaaaattatatttgattagaacattgtagggtttataagaatcaaactgactcacttcaaaaactgaagtcaagaaggcttaatgagtgattgttctcaaccttacccagatccctcgttttcttccttacttcaaggacgtaagctttagtcctaacattgttttcctgggattactataatgtagtctccctgccctaaccccaaaacctcttgtctattccagcaagcttgttgtgagaagcatattattttgatgtgataacaaatatgttaatgttaatagaaactcttaccaagcgtttactatttacctagtgtttactatataccaggcactgtttctctgttgtattacttcatttaatcctcacaataccattctgaagtaaattctattattcttattttacaggaaaaaaaaataacattgaaaggacaaataattgccagaggggcagaattatttgagctggacacactggctctagaatcacgctcttaacaactactctattctggccttgaagtactcttgtttcgtgccacatgaatctttttttgtgccacatgaatacattcagaggttgccattcagtgggcagagtttgggagcttctacttaatattggttatcagggccaaggtgaggctatgaagtttacagccagcccactctagaatttaagcttcttctattcccagtctcaaggaatcctaggtgttgagcatctctggattgtccttcatgaagcatggggcagtttagacttctttaacaatatgacctcaatcaatagttgttaaaactagcagctcagggcagaaatcacattagtgttctttggcactgtgtatatctctagttcttacattagtgcctggcacataatagtgagatttgattggtgaataggtgactggataggcagacagacaaatgggtcaacaaatggatggatggatgcacagttgtgaaagatgttgataataaagaagtgatacataatattttactatctctctcattaggttatagtttctcccataattttattatcttggctatgtcactccaaatagccaccgtaaaatccaaagttactcatataaaagaagtaaaatttggaagcatatcagttagaatagcattaaatagtttccctaaaaaagcaagaaaaaaaatttcattcattcaactaatacatactcagggtctatcccttgtcaggtactcttctaggagcttaaagcataactgttaacaaaaacactctgccctcctggtgagtgcatgctaatgggggagacagacaaaaacaaacactcccacatgtaatgtatcaagtcgtttaactgccatggagaaaaatttagcagagtgatatagtcaaataacacaggagtggaggttttgctatttaatatcagatggccagttatttttaaattgagtaaaagttgtagtctatgttagaatgtgagaaaagaaaattaacactctttgggaagcagtaactgtaggaagacaaggaattaggagacctggattagtattagagacgttttgtatagtaacttgataaaaagggagagattttttgtgatatatatatttttttcattttttcttacagaattaacagctctgaaatttgaaggtgctagtgtctcactggtcttaaactgcgaagctgaacgacgaaagcatccttcctgtaatcagtgtagcaaaatgacaggcagagaaaccatgctgggaagaagcaaggtcatcagttgaaccatcttgactttggcccagaacacagctcagcctcaactcctgcagtgcatttgcctccctcactttggtttaagacctggagtgatgtgttcctgctccagagcacctttctttctgtgaggcccgaaacatgaccaccagcggccacgcatgtccggtcccagcagtgaacggacacatgactcactatccagccacaccctacccgttactctttccacctgtcatcggaggactttccctgcctcccctccatggccttcatggacatccgcctccgagtggatgcagcaccccgtcgccggcaagtaagtcctgctggaatttgctctcttttctctgggttgattggatgaagggacctgagaaaacggaatggttggtatccagggcaatttcttatttcattgggtgctggtttcttttggtcttgaattctacttttagttctgtggaaagagatatgatttgaaactagacaagtggcaaattttagaattcaacccgttcaaagctgctttggtattttgctctgtttcataaaatgcaaacacaaaaagtgatgagcatgtgtggttaatatctgtgatcaatatctaaagaaattggccatatgataaataatggaagcagtgaattaggagatgataccataaaaatcactaatgataatactagagttaaaagctattttggttgtgagatcttctctgaatcttttacttgtttcctgtgtacaaatgatatctgtaattgttctcaacttcccatagacctttgctaccaattcatatcacattaagcttttttagtgtccttggcaccttttgtttctgtactagctatttcttatcccagatcttcccttaaattttctgtataaggtactataaaataaaaatagtcaaagttagaattctccaagactgatatgacttccacattgaaacatctatattgtgcaatttttagaaagttctgcctgtttaaagacaaactgtggtagccagcgagcttttccacctgttaataacaacttacttggtttagcatctggaggtgaaaaggcatatttatttaacaacaggcatccacagcatgttctccaagtcctttctggctcatagagcaacagttctttgtaactcttcctggtgattgttttgcattttgcttctcttcaaggacttcccccaaatattagcatggtatcattgggataccaccttaatctttctatattgtgctcttcgtgccttcagtcattccttctactacatccttagctcaccgaaagcagggagcttgttctacctaagtagaatccccggtacattgccttcaaaaatagtaggggatgggtgtttggatggacgaacagactgacagataggcaaacagatgatagacttgcacttttgggatgttgattgcaatcatagtactatatcattcctgataaacagtgactcgatttgctgatgagtctttccttctgtgtttcgaatttctggcttgaacatttgaccctcatgtctctggaattgcctaaaaacctcctcccatgcttctgaagttcaaactgaaagttgaagcagccaaagcggcgtattgactatccagagaaatggacatagtaccagtactcaaaatatcttgctgacccaagtgctgtttcaaatcatgttcactcaatatgcaaatgatataatgaagttacttttagctaacaaatgaggaggtctaaatgattgataaagccattaaaattttacctatgagcctctgtgtctaattccgttgctcaactggcctgacagcacattttaacaggtttctttcctgagatcagaagcatattttgtagatgtagccaagaagttgagatatgagtaggattcccatgctgaatgatcaaatttggcagattgaaactctaaggcagcctgaaacctctaggttcccaaaagcaactttgggctttgggcttctttggctactgatttatttttatttatatttatcttttctttctttctttctttctttctttctttctttctttctttccttccttccttccttccttccttccttccttccttccttccttccttccttatttatttatttatttatttatttttgagatggtatctcgctctgtcgccgggccagagtgcagtggtgtgatcttgactcactgcaacctccacctcccggtttcaggtgtttctcccacctcaaccctctgagtgactgggactacaggcacgcaccaccacacccagctaatttttgtatttttagtagagacgtggattcaccatgttggccagaatagtctcgatctcttgacctcatgatccagccacctcagcctcccaaagtgctaggattataggcgtgagccaccgtgcccggtcttggctactactgattttaaggaaaatgcagagcatattaaatggaaaaatggttgagatatatcatatctaagcctcttttgcactcaaaatacaaggtaattatttttatttcacagttactaataaagtacaagatgccattactgttagattaaactataatgcagttgtcattttctagatcaaaactggttatatagtggcaattgaatagattcaacctttgaaaagcgagggtttgaagttcaaaaaaagggtaaatagtggctgacttttttcttgagggccttgtaaggagagtgctaagtaactgcaccttaaaaggtgtttggagaaggggcagaaaaaggactaggtacagaaagttcaggctggaacatcaaagattacttacttcataccctaataccttgtattattatttcttgctacagtcgaagcacatgaaagctgctcagatggaaatgattaaaagaagccacaatgaatatgactctgttagttggccctcaaagaaggaattgtccttgttaaagcccgtgttttcaaaagttcctagaaaaggacaaagacttaaaaattaaccacagacttggctaaaaataaatttaaggtttttatccatgtactgagattagtaggaaggtagccaaattctgtaaagactcaataactagcaacacacatacttgggtggaaaagctgaccaacgtggaataaaaagggagcaaacatgttggagaatgactctgtaaagagattcatgtcattgaactgtaggacttactgatatctcttttgtaatctgtacatgtcttgattctgcagctcactagaaagaataaattctcctgcccctgtagtgagggtctgtcagcaccaagtaattgtaaaggctcaataattctctacctcaaaagcaagtaagaacaatttccatagcagctactgaggttatacctgcttgtcactcttctctcattcccttctaactcttgtcagctttatctcctagacctgaacctgagctctgcatattgaacttctctaagcctacagcacaatggctccattcccacacataaagttgtccttgatgctatatctactttgcagtcatttaacctctctgaatttctattctatcaactataaaatatttttacttacagaacagacttttattatatatctaaatcttttaagaatgaagtcgaagtctaaattagaaaggaaacttgtactttaaaggggtgaaatcagatcatacccaagatcttttcagctctaataggcaatgatttcacgtaactcaggtttctcccggtccacatgccatttacagggggtgggccctgttcttttgcagtgtggaataattggctattggtatgatcatttgtgaccactcacaattcgtaggggaagatgtggccacttttccgaaggtctgttctcaagaactttctaccttaaagaagaaaagttatttgcagaagagaacttgaaagcatcttctgtgtgtacatgcccttgtctttgcattctgacttaatttttatagcatagagtttctgtaagcttagaacacagggaacatacgaaaaaagggggagttaaaatatgtaattagaaaaactaccatgcattgagcacattttggattactcacacagcatttagtgtatgccattcttagtctttttaatagcctcgatgtcactgccattccattacagaagttccattttacagataaagaccaggaggcttagagagagtaaagagcttacataaccagttaatgttggagtcaaattccaaatccagaccccgagaccccagagcgcatgcctttcccagtgttttgggcaatgaggccagcataatcccttggaaaattgacagctccaccatggacatcttttttccacgatgttccagggagtccttggagatgatagatatttaaaggaccttgcaacctctttaatttaatcaactactgtggaagccactatcagttttcgtcacaatggagacttgagagagtgccgccgtactgcctttgataagcatgacttccaacaggagaagagcctgatatgctatgccagggaacactcaaaatattatgtggtagggctctctgtgagagttggacagctgtctgtctgtctctctttatgttcctttcatggctgcttgttctgttttattgctgcacatgtgctttttataggttgttgcaagctggaaaatattgttaagtgttttggcttcagaatctctctcaaaatgatcttagtttaactccagcatcttaaaatgcgaattcttttccccttcttttttaatgatcagaaagtgctctcctgtcaaaatcacaaaatagggtatttgcttaaaaaatcccaaccttctggagagacaggctgtgcaatctcagaattaccaatgatggaacataaaatgagtcttatttctattttttgtcttaaactaagaagagctttgttacctagcttgtctaaagcagggtgtgctgatcgattgaatttccttattacatgttagggacaattggctcagaggtgtggatcctgttttaagtatatgcagattgatggcaagtaaatccaactcattaatttctaccatcaccttttactccatagtcttgtcttctttctattgagttatatttgtccttaaacttatgcaatgactctactggacaggaatcacatttgattttaagatatcagggacttaatatattgctggtattttgtgaaagtcaaacataatagtatcatttatatctatgtatccttacattgttaaaccaaataaaaatgaatgaaagtaagacacttcttgggaatttgagtaaactcagttataacagttttgtccattttacctccctcattggcttagggaggtcaaaggctttgaatgtttgagaaatagagtttatactgttgacatgatgaaactattttagtggactttcttaggcccagagtcatgtgtatttaagaggccattccttaaagctgaacaggtattgattactttagtgcctcttttccccccaaaaacaagaatctttgtgtcttcttgatgtttctacaacttccccagactctggttgagtataacatgtattaagtaatcacattgccattaaaagtaatggcaagaaccacaattacttttgcaccaacctaataatccttagaagagttctaatgaggagctgagctcattctgttttttgatctttacccccaaagggatcaagaatatatgaatatgaattaaaaacaaaaagaatatcattcactttgatcagattaactacaatgcccaaaggagtgtctcaattgtggaagtatgtccctaagtagaggtaggctttcagtccgtagaggccatcataaagacgggaatgactttaccttcaagttacttctgccaatcacctttttcctaggaaggacatgactgaaagaatatatataaagaaggaccaagaatggagaaaagatggagtaatggtttaagaatttgtattagaattcctttcgataaagacattccggttgtatttattagataaaatgtagacgtttaaaaagagcattttgaccttataaaaattgaactttggaaaagttagaatcatgacaatggctttgagttggctgagttcattatagaaaatgagactttccatatctcatgttctaaagttctgcctcaatgaactcatccatctgcaactcctatagatttcaaataggttatattcagatggccttgagcgatgggagattagcctccatgcaggtaggtggacatgaggtcaggtggagtggcctgggccatcttcaggatatatcccaggaagtcccacaaaagctctggtgacttatgccttgtcactgacgtgatgcagcgactcattctgtctttgtttctctgttttctcctttagttccctctgacatttgaatgaatctttgtaattttatgtagaaggagagggtaggggagaaggaaagaggaagggagaaaaagagggagagagagaaagaatgaatctaattagtcttgttatttgaacacatccaaaaacttggggctcccagaccaaccaatggtcaggtggtaccatcaattcccttgcttttttttaaccttgccatgaaaattaattgtcaaaaataacatttcttttgctacatatattacctctgtctgccaactggaaaagggaaatagagaaggtaagatccaggtaaccaacttttctaaggttgctcagtggtggggctgggcttgaactcttcttgttatgaccaaagtcagtcctcttttcataactctatgtttgctgtggatattgaggggacacacaggtttttaaagcactttgtctgtctttaaggatattgcattcctactgagaagtcataatcactgaaaaccatttagatctaaaaccctgattgctctttggcccttcaggacctagattttatgaagcttataacattccttcccacccaggtacccactgtgcatcgtaagtactctgatttactatgcatgtcttattctgctgtctttagttgttttcataacttttccttcactgcttatctggtgatctaacacatgggacatagtagagaaacccatttcatctttgcggaatgattgaatcaatggtttttgctggtgagggaattttggaaatttgtagatgtgcttttgagtgccatgctcattgggagcgctgtagagatttagtgggcagaagctaggaggcttaatgtcctgcaatgtatgcgatagttgcaaataataaagaagtgcctcatgttctcatgactttccgatgtcccaccaggcattcctgttaagaaccacccctacccccaaataaattatgatgaactgatcctaaatcataacttcattttacatataaatgcaaaacattgttgtatgcttttattataccctaaattatttaggattttaattgccatgcaagtcagtagtaggttgatctttgttctgttgggaactcttctgagagtcattcatcattttataaaatcatgtcaccgatggcagtgctgttctcggtattcaagtcaccaattccacaaacttgtgtcaatctgcattcataactaaaacattcactctaattctgcatagaggggcaagcatcttaccacttctttatgcctgagcaattacacattgaaataaccattactttattaaaaattacatttttctattcatccttggtattgcagtcagagaaatgtattaacttctttggaattacatgtaggtgtaggtggcctatattacctatgactttcattttggaatcatacagcaggtgatatgtgttgctaaaagaagcattggttccaaagggttgagaatctttggaatgaatgagtgaatgaatgaatacatgaatgaattagtgaaaaaataacagtgtgaaataaactgactagaaaataaatgctctagctgttgagaggaagggagttaataagtgagatggacaaaggagggcttgcaacaccagaaccagcaattatgccagccatggggtactgggcatggtgctgggaacagcgatatgcagaagacccagggaaagcaggaaagtttcctgtcttggaaggcatatggggttaggaagtaaccatctagtacttgccttcatttcttgatgtgtagccaatgtagccaatgtccccaaggggtataaaagggactcaaaagtattgttataatgaattcactcttctgatatatatttaacacataagggttgtgttaggtattgtgtcagacacctcagaagctctgtgagaattttctgggtaaatccatgagaatgatgggttttcacttgtgtgtggtgtcaggttctatctccaatgagacattatattagtatttaccagaaaaattgtaaaattattatggattaaattgtgtcctctaaagagatgttgaagcctttacccccagtacctgtgaacatagccttatttggaaataggattaagttaagatgaggttattagggtgagccctaatccagtatgactatgtccttataaaagggggaaatttaaacacagagatagagacacatgtgaagattggagctagctgccaaaagccaaagactgctggcaagccaccaggagctaggagagagacatggagaacattccccccacagctcttagaaggaggcaaccctgccagcaccttggttttggacttctggcctacagaacggtttgtggtattttgtgacagcaactctagaaaactgatacagggaccataacttcttactaccgaaaaagaaaaaactatgttttcgaaactttctccctctaaaaatatccattaatttgtttattttctcataattttgtccttataatgactttcttttcctacttcatgtggcttctttggcttggactaatgaataatatttgaagaaaggactttttttattactgcatagccaatctgtctttatcctgacagctacaagtccgtgattataattcacaatgttcacaatttttcagaatgaatttctttctcttcctctgattttcattttgtcttactggatggcaaactcccatctcctttcttgacctcaacatgttctctttaatattcattttattcttcattttaaaacctttgcctcaaaaccctgcaggattactcatcactgtcaaattggaatctgtgagattcttcagaaaaaccattcatattacaagttcatattcaagtttcagtcaccgagggattattggtggcagtgatcttattataattatcagttctgtattatcttgaacatcgccttattggcttatcttctagtctctctttaggatttgtatactataaatttatcgtacaaacttacatattgactttgcctcagcttctagtgtccagaattcttggacagtctttcaacagtcaaattgtaacgattcctctgtccatccctagcatctctcctgcaataacacttattgtcttctcccttatatttagagctaattttgttatgtaattagttgtacacacttttggtgtcctggtctttatatctgtccccattagttccccttatccaggattcttttagtttcttatggccaaaagcctatgtaagcttctttgaggtaacctagggtttcaccacattaaactttactaaaggattctggccctaactaaatccttccctggttaacttggcccctaccattgtctttttatgttaatcagatgaatcaaacttaataatatgaaaatctacaaatacagagtttgttgttttttttttctagttattgcccaaatctgaaaaaagccattgtacatttggtggaaatgactgcttttcaatgagaatgtgcattgttaatttagtgctgagatcctttgccaaatgcccataagctttgcaaatgttcagacaaaattaaaaaaatagggcattttgagagtaaggccagagtttatctgtggctttgtgggcactgatgatagcacagagttacctggctgttgtttcatggtgaatcacatgtggtcccgcgagaagtactgcttggagactgcccctaacctctgggagcttatagttaactcaaaactaatcattaggaaaggttcatcttgttgaaccacaattgatgttagtgttgaaaatctaggggagcggggagatgcagaaagataggaagttgaaaatggagtgagagaggtggctgcttccagacccagtctgtgttcttggacagatttttaacctctgtgtgccattttctctgtaaaataaggacaatttatctttgaaaaattatgatgttgttcatgatcaatttacatcaattgatacatgtaagctacttataacagtgttacaagagtaaaaagtaggctaagtatggtggctcacacctatactcccagcgctttgcgggactgagtcaggaggatcacttaagctcaggagttagagaccacgctgagctgtgatgacatcttggcactccagcctgggcagcaaagcaaaaccctgtgtccaaaaaaagaaagaaaaaaaaaagtaaaaacttagtaaataatagcattcattattattatccatgctttgcggccacaattcatccacttactagcaaaaatcttgtcacaggacaatcattccattaattatgcattctaacttccaaaatgcaaaggtctttctacatgtgcatgtgcttttgcacatatttctaaagtttacattaggcatatggaagttttcacttcatagagcttataccctgccaagatatatttttttttaatttcagaattctcaaggggacaatcctaagtttgggtattagaaaagacattttttcataagtaagcttgccctgatgaataattttgtatttatcatgaagagttcacatccaagaaatacacaacatttaaggctatttttcatagatgaggatcctttagagttggagaactagttaaagaccaaacttccttttctcttaggacctgcggggtctgcatgtcactttgtcctttataaacaatctctaataatgcttgacttaatttcagtgatgtttataataatgaacactttctaacactaatattaattgcttaacggttgtgaaattggccaaccaaaaagaagtacctaaggagaaaaattaaccttgacatttcatacaagtgaatagtgctttaatgataaccacatggttaaaaagaactctacacttaagaatatttagtaaatcattttttttataatcagaatggcttttattagaatgccaaaacaggaatttctgtgagtcctgatggaaatctctgagacataaagtgactttcatagccacattgacttctgtcctgactttgtgtaggcaattttagaatttgtctttcattttttcttctataagaaatcttattccagaactaaagccaaataacaaatcaaagaattcgtatgccactattgatgataatatttggtgactacattaaacatgtaatagaattatatataaattgctgcaaaggctaacatcatctttagtacttgtcacagtttttctgtcttcactttaagaacagaaaacagagttgtatgtccagtattgggtgaacaaaggagtattatggaatggaaaaagaacaaaatttgaccctgggaattccagcattccaattaaaaatacaactaacaaagacaaaatatataagagcataaagtatgtatatagactttgtgcaagtcagaaaaaaagacaaccccaacgaaaaataaacaaaagattttatttcactaaaaagaaattcagatatcccatatcaacctcatattggtgatacaaatcaagacaaccatggtatgccattttatatccagtacagatgaaaaaattaagaattatggctacaataccaagtattagaaagagtgtggatcatcagatactttgaaacacacggctggtgagatcctacactggtataattgttttgaaaatgacttagcacattctataaaattgaatattcagattcgatttcaaccaaacaattttacctctatgtattattctagagaacctctttaatatgaatttaggtttaagaatgtttatggtagcactggtcatagattataaaaaaaggatgctatttgaatatgagcagatgtaggcaaaataagtggtatattcactaaattgaatattattcatcagtgaaaatttatacaccacgaacatggatagatcatagaaagataatgaatggaaatgaatgaaatgataatgaatgaaaaactctttaagtgcacatatagggtgccaacatttttataaattgtagaaaagaaatgatttttttcctcacccatctctagattcatgactgagacacctataacaaaagacagattaacatcagaaaaaacatacaaatttgtttaatgtaagttatatatgcttgggaaccttcagaaatgaagacccaaagaaaaaggtaagcctgtgtgtgtgtgtgtgtgtgtgtgtgtgtgtgtgtgtgtgtgtgtgtgtgtgtgttttcctgctaagtttgatgaagagtagccagtcatatcagtcacacgatggaacaaaggaagtaggatttaatggtaataccctgaggggtgcttctcaaaaccagtttgcttagattcttgtctgtgtccatgcttcttcagagatagggatgtgcctttcctcctcttattgggagggaacctctcaaatgagggtcttatgacctgcaggagagcatggtgagaggaagaagacaatggcctcttacctctgcttttttctcaaaaaccatgctgccataatataggactagcatgttctgaaccctgttaaaatctaaaataaacattgtttagaaaaataggtatttgtaagaatgctatatattatttatttgttacactaacctcaagataacaggtacttcttggtggtgcagtgggacaggcaagtgggtaggataaagaacacatgagtagacacagcagaaaggataaagttttaagtgattaagtattcatcttccagtatgctttgccatatgcatatatgttacatttttatagcttattaaacgtacattacaaagataaaatatgaatatatccttcatgtgttagagacaggagaaagggaaagttttttttaaggcaaatggctaataaaaatacttttaatctttgtcttaaaagtaattgaacaaaagcaattttaaaaagaaatgcaaatgaagatttcatttgttgtgacgaggcacagatttaaaagatttctgatggtgttcaggctacagagaaatgaacactcagatacagccttgttgtggagaaagaaaattaatatctcttttctgtgaaataattttgaacttagtaaaaaggccttaaaatattttacctatgactttacattttgttacgatgaatttattcataataaataaatgttttagtgtgtttgagacaacacagatattagcacagacatgtttgtaattaaaaaactgaagacaaccttcctggctaataagaggtgactgattagagaatgaaaataacaagcagtcctttaaaatgtcgatggagaaatgaatgtattgacatggaaatattcaatgggataaacaagttaccgaattaatagaattaaatattaagtatcaagacaatattcttacatttttaacatatatattgtatatgttttggggtatccatgtgggtttaggacaaattctagcaagcatattaatagtcttcatttctgggtcagggaatcatccctgatgttttatttatctttattcagggaccatgacatcttgctcatcattgaatactcattgctcagagcttggtgcttggcacatagtaggtgctcactaaatgtttgttgtataaataaatgtgtttaataattatttatggaactaattttaaaaagggagaccttttattgggttaattcaattgtattcggctgaaccaaatatcctagctaaatcaagatcaaaagtattcatgcctgattctatttccaagaaattaacccttcagaggtttattagcattttgaagtgttaacttctaagctaaggtcctgatcgtgcagtggtaaaatttccaaggaggtattttggagtagaaaagttattctgtcagcttctttgaaagcggtatcatctgatatccatgtactctacccatgactaagtcattctgtattttattaggcttcagctaaattataaatgttgttattattactatctataataattataactaccatttgtgtgagaaactatatacatcatcttgttttttacccacaatagataatatgaggtatttcttgaattcatttacttatacataccatgttttatttggaaaaagaaagattttatgaccacttgtgaaaaaattatatgtgtaactttttaaaattgtaaatgaggacatttggggaaagagaaaataagtacagggaaacaggttgaagcccatttgaggccagtgcattaaaatgcatcctatgatatagataataaatgttgctcaaacaaactaaaagtctaacccaagaagaggagtcacaaagtcatatagttgacagagttcataaaatgaagtcatccaggcatgcagagaagcacaaatgactgtaccatgaaccacatcccaactctacctttataataaatatgattctttatgtgtgtttgtgtttttaatatcatccctcaatgtaggctaaattaatcattccaaaggtcagtcagcaaaagcaggtccctgcaggggtccaaaccctgtctccaggtacatcgctctctgacagtctaagtttaatccaaaaataaatattagagtgtcaagataaataaatgatcttcatagccttcgggcaattatccataaaaactattttccttagccaaagatttttgtaagcattgagaaaccatgaatctgaagtaatactcccttgacaaggacctgaggagccaaaggcccaaccctcccctaggagcaggggccccagcagtgcccaggaaaaggccaaaatgttccctcacagaatcattttgaatcagctccaacagacaacaggtgatggaagatgtacagcagcatgttcaaaagcttagaccctggagtcagaaaatcctcagttgttgggctggcatggtggctcatacctgtaatcccagcactttgagaagctgaggtgggtggattacttgaagtcaggagttcaagaccagcctggccaacgtggcaaaaccctgtctctataaaaacacaaaaattagccggcatggtggtgggcgcctgtaatcgcagatactcaggaggctgaggcaggagaattggttgaacccgggaagtagagtttgcagtgagctgagatcatgctactgcactccagcctggatggcagaatgacattctgtctcaaaaaggaacaggaaagaaagaaaatccttcattggggcccagctgtgtgatccccggataaactcctcacctttcctttttatgtgcttgcagtggggccagagttagaactgaatgaagtaatgtttaggagagactttgcatagagcctcagttaagcccaatttattcctcagtttgggtcaatttatcgattgtgatgcataggggttgggggaagaggaggaatatgaagaaataaaggtaaattgtcaatggaaaatcatagtatctagaactttcccatggaaggagaccagtagaaacaaatggattcaagagttaaattttcctcaatctaattctctctggacataggaacagtcaatgagtgtactcacatgttcccttacacccccaaccaggcccataccccaggcagatacacgcaacaaaaacactcaagggagagtatggttcatgtttccaaatgataatgccttcttttgtgtactgatatgtgcaactatatatgcatatatatgtgtgtatatatattttgggtagaagtgtaaagtatttctaatcttactgtgggtcttgcattatagagcactccaggagatgtttaactggcatgttctgtttgaggtcacaatgtgccaaattttttcatggaaagcttcagctgatcaactaaaaaatgcatttatttaacaggcaaatgaaaaagagactgccaggtgattccttgaggtgtggttaattaattccaatctgtttatggcaacagttttctagtttcaaatgataaatgcccttcctccaaaaaggaacctcaaagagaaagggtctcctccccacttctagatttttttctttgtccttggctacttatgtcgcgtgctgcttagaatgagttcacatcagtaatagtcataaatgatttacaaaagtaattcctgtctaatcacttgggacttggagtttttatgatgttgccagatgtgccatcaaaaaaaatcatctggttcagaaacttgtgctaaatcaagtcagagtcaattaattccctaaaggcaactgattggtttgcatggatctgtgttgggggcctcgcccatcatctaactcttttcctccttaggttcacgtttgttttgtaaaaaacaaaaacaactctgtaaacacaaagttattgggaggctgtcagcatgggcatgtattacagactttgatataacttccatgtttctttcatgtattaaaagggcattttagtccatgaaaaaaataggggaaagttttcaaaaccccaagcaaacatatttcttatatagactctgttactcacaatactggcagcaatattgcataaatacttggacattgcttgtgggacaatattattcccttttgaatgaaagctccccttagaatccatctttacttcctctgggcccttaacacatgagttttatatctctaataaagaattttgtttattccaccttataatgtggtcattggtttaaacttttatccctcccatgaaattgtcccgtgctaagagcaagtgccatattatctcctacctcacttagggtgatgcctttgaccagggagattctgagtaactttgttaaatgaaggaaagaatccaaaaatggacagctatgaattttccttccaaagcacatggggaaataagtgaaaagatccatattgagcttttaaatcactttgctggattgtgttacagtaactaagctgggcaataactaagtaacttgcattgggggaagacattaactcagtctcttccatctatgcaaggatttgaaatggcacctcccaaaccagaaattctctgttcccaaattatactccctcagtggagattaaaatatctataatccagtgttacaaggcacagtagtttgcttcaatgacaaattaaatctttgagaaaaggttccccatgttgtctctgattacatagtcaaggaatcttgtgaatttgctgatgcgtaagttttcctttaatgtaaagcaggcagacgaggcgggggtgtggagaagagagtctcttaggggaagacagtgagtgttgacataatatcgaatcacggcagttattctggaagtacttatttaaacagctttgcaaaagtgtaacaatgattgagagttttgaatgttcaaaatctaatatttacatgattcttcatctttggatcttgtaggacatgaaggtagtgtctttgcttaatgatgttgtgaatatcagaatatgaatgagaaaccttgttggtatgattctctaagtacaactaaataacctctcatagttaaataatttatacataagactgaagcatagtagcctcttgaggcatctcataagctattcttcagatatcctgctacagttaaaagattttgattggtaaagatcgtgtaattgttttaaaactattggttgacaattttgtggtactagctatgtaaatatcctccctgatgaatggaagggaaatgatggagcataagatacacctattcaataaaatactacagacactataagtgaacttttaatatgcctgtaataggaattaaaagttttttgtagataacctatcatgctatttattaatttaacatttagtactgctctttactcatcgtgttttccatcagtggttctctacttggggcagaactgttccctagcaggcatttggaattatttaaaagtttttggtttgccataattaggggttacctctggcaattaatgagtggcacaaggatgttttggcatctgtactgcctcagacaatcctgaaccacaaaacacacagacacacacacgacaaaacttgttctgttgaaaacaccagtgtcacccatcgaaaaacacaagcatctttagacatggtcttactcataattgggagcaggtgactggcatagtatctagtccctcgtagacaaacactccctgagtacctactgtatgtcagacaactcttctaggctcttagaatgtacatctgtaaatggaaccaagagccaggccctcatgaagcttacattctagaaggaagctctaaataaatgttgcttcagacattgtaggtggaaaaagcaagaggcaaactttcattcactgtttaaccaaataggaaatgaaaactttgagttacaggcatgagggcctcaagtaattgctaacattccaagcaatggaaaagcatgtaatcacttgtcccatcaacctccttttaatcttaactttttggcttagttgtgtgtctcccttttccactgatcacaacttctctgaaccctttaattctgtttacattcttccccattcaaaggaagaatgaagaaagagaaaattgtattctcatagaacagaagctaccttccactggatgtttagaaatcttaaagattgttccaatgcagaggaagtctgttaaaaaaattaaaataaaaaaaacctgtttgcactgaagtaaaaagataggaacattaaaaccttaagtccctaaaaagttcagaaatcaattatctgagtaagatacttcattgtacccatgatctgattgtgctttttattgttttatatgtttcaattagctcaactgtaattgcttgtcagcatctcattctaagcaataaacttgtcataaaaaatagtagaaattatcaaattttattgttcattttagtatttgttcatcttatttgttgctgctacactggaatatattctttgctagcagctgttgtgatattttatagcgacatatttcaacaattctcattctaatttttttctattgtgtatgtagattgttgtttttcagagaaagaaaatgttcaaatggaaaaggaaaaagggaaatggaggcaactatataaacgtgcaatatttacattttctgtgtttatatgacatatacactatactgacactcagtttcaaaatatataccaataaatattcaaaattgtatatgtaattaatcagttagtaagatgattatttagctacacaatttagatgaaaacatttgtattttaatattacactattcacaatagccaagatacggaagcagcctaggtgtccattaactgatgaatggataaagaaatcatggtatgtatatatatatgaatattcaggctttaaaaaaggaagagatctttccatttgggacaatacagataaatctggagaacattatgctaagtgaaataagccagacatagaaaaatacttcacagtctcatttatgtggaatcctaacaccattcaatacatagaaacaaagagtagaatggtggttaccagggtaggaaggagagaaggtcagagaaggcagacttgtagttgtgtagcatgaataagcctagagaactaatgtactgcaggagtatagttaataatactgtatactgaaaatttgctaaaagaatagactttaggtgcttttaccatatgcacatacacaaaaaggtatctatggaaggtgatggatagcataatttgcttgacagtagtaatcaaatagtatatatatacagtagtgtgtatatatatatatacacacacatagtgatatatatatgttgatatatatatatataatgtatatatcatgttgtacaccttaaatacatacaatttaataaaaagattacccggaagtaaaaggctgtcataggagcttaattagagtcccttgagaacaaggtctttttttttttaatttaagtctccaattcccaatgcactgaagttttaaataaatgtttattgaccagaagaatgtacgtatttgtataagcattctggaatcaaataaattaacacaatgctgcttttattaatttttaaaaaagactgtggaattttgttaatttctgtgaaccccagtatcaagtttctatgatggccgctctggtctgtgccactttgaacattcagtgacattctcttcttttcctggctctgcttttcaaagcatgcttgaaagagtatggtggaaaaggacactaattcatactaaagagtaaaggatttatatggcttgctttcttatacctccaatggatattttcttttaacagaaacaaaagctttaacaaaaaagtttcaaatgtgtctctaaaagtgtgtgcttgacatcagtcagtaattagaaggcaaaagacatttcatggtacaaaaggtctttatcatactgctgaaatcccatcatacaaactattgcccatcctctctgtaggtcttgttatgaaattttttttttccaaacagtttcacctgaagatatccatttcttgggagcctaccaattcctcatcaacccaggcctagacttaaaattgtatcacttaagaataggtagtgtcatacatgctcaatttctgacaacagtttgcagaaagtttcgtatagttattcatgggctaagagaatagatatttgatgacattggatttggttggttaatttcagcagtaacatgctaaagtaatatttcttaagacgattcagacattaaaaaatagcacgtgacgtcagcttggagatccctaatatattcaacttctgaatttattccaggtgaattcatcacatcttattcctttaactactttccaactttactgaattcccaagcattttcttaggaccttataaagttcaatgagtttaaaattcttgttacagaacaaaggtgcattgaaaaattaacttgatagtgaattttagctcagtggactgtattttgccattaacttatcatgaaattacagcttcattcccagaatgaaaagggaagttaagtctaaattaaaattctatgtagaaattttgtgaagctaatcagattttaaaagaaagccatgtcttgagtgataaaatatgaaaatgtaaacatcttctataaaataaagttatataaatatatctgaagtatatgtaatctgttaatttcctggaatcaatgtttatggctctattttaaatcagttatttggttagtgaactaatgcaaacaagactgggagttttgtggttatatttgttcctctgcttcgagtcatttaaaaattcttcgtggtcagcatgtatctataggttatcaagtatctcattaatagaatcagctctaaaatttttttacttttattctttatgttctagggtacctgtgcacaaagtacaggtttattatgtatgtatacatgtgccatgttggtgtgctgcacccactaattcatcatgtacattaggtattactcctaatactacccctcccccatcccctcaccccacaacaggccccagtgtgtgatgttccccttcctgtgtccaagtgttctcatggttcagttcccacctatgagtgagaacatgtagtgtttggttttctgtccttgtgatagtttgctcagaatgatggtttccagcttcatccatgtccctacaaaagacattaactcatccttctttatggctgcatagtattccacagtgtatatgtgccacattttcttaatccagtctatcattgatggacatttgggttggttccaagtctttgctattgtgaatagtgccgcaataaacatacgtgggcatgtgtctttatagcaacatgatttataatcctttgggtatacacccagtaataggacggctgggtcaaatggtattactagttctagattcttgaggaatcgccacactgtcttccacaatggttgaactagtttacagtcccaccaacagtgtaaagtgttcctatttctccacatcctctccagcacctgttgtttcctgactttttaatgatcaccattctaactggtgtgaggtggtatctcattgtggttttgatttgcatttgtctgatgagcagtgataatgagcattttttcgtgtgtcttttggctgcataaatgtcttcttttgagaagtgttggttcatatccttcgcccactttttgatggggttgatttttttgttgtaaatttgtttaagttctttgtagattctggatattagccctttgtcagatggatagattgcaaaaattttctcccattctgtaggttgcctgttcactctcatggtagtttcttttgccgttcagaagctctttagtttaattcgatgccatttgtctgttttggcttttgttgtcattgcttttggtgttttagacatgaagtccttgcccatgcctatgtcctgaatggtattgcctaggttgtcttctagggttattatgttaaggtctaacgtttaagtctttaatcaatcttgaattaatttgtgtataaggtgtaaggaagggatccagtttcagctttctgcatatggctagccagttttcccagtaccatttatgaaatagggaatcctttccccatttcttgtttttgtcaggtttgtcaaagatcagatggttgtagatgtgtggtgttatttctgaggcctctgttctgttccattcgtctacgtatctgttttggtaacagtaccatgcaataagacagtagaaagaaaggcatccaaattgaaggaggaagtcaatgtatccttgtttccagatgacatcatcttagatttggaaaaacctaaaaactccaccaaaaaactattagaattgttaaagtcagtaaagttgtaggatacaaaatcaacctacaaaatatcagtagcatttctatatatcaatagcaaaaaaacttgaaaaggtaaatggaattactttcttgatttcaatagttacaaataaaataaaatacctaggagtaaaccaaagaaatgaaatatctctacaattaaaaaaatggatgtaataagttgaagaagacacaaaaaaatggaaagatattccatgttcatggaatgttttaaaaaatcaatactgttaaaatcttcatactacgcgaagcaatctgcagattcagagcaatccctagcaaaataccaatgacattcttcacagaaatagaaaaaataatcctaaaatgtatatgggaccacaaaagacccagaatagctaaagctatcctgagcataaagaacaaaactggaagaatcacattacctgacttcaaatgtactacagtaaccaaaacagcatggtactggcacaagaacagacatatagacctatggaacagaatagagaatccaggaataaatcccatcatctacagtgaaatcatattcagcaaagctgccaacaacatacattttggaaggtacaatctcgtcaattagtggtcctgggaaaactggatgtccacatgcagaagaatgaaactagaccccttctcttaccatatacaaaaatgatatcaaactggattaaagacttaaatctaaaacctcacactatgaaacagctaaaagaaaatattggggaaaccctgcaggaaattgatctgggcaaagatatcttgagcaataccctacaagcactggcaaccaaagcaaaaatggacaaataggatcacatcaagttaaacttctgcacagaagaggaaacaatcaacaaagtgaagagacaacccacagaatgggagaaaatatttgcaaactatccatctgacaagaattaaccagaatataaaaacaactcaataggaaaaactattgtaaatagtattcctataaataggagaaactctaatctgatttaaaaagggacaaaagatttgaatagatatttctcaaaagaagacatacaaattgcgaacaggtatatggaaaggtggccaaccttactgagcatcagagaaatgcaaatcaaaactacaatgctgtgtcatcttacccaagttaaaatggcttttatccaaaagtcaggcaataacaaatgctggtgaggatgtggagaaaagggaccctcatacagggttggagggaatgtaaattaatacaaccactgtggagagaaaagtggacattcctcaaaaaactaaaactagaaataccatatgatccagcaatcccactgctttttggtatatacccccaaaaaaggaaatcggtatattgaagagatatctgcattctcatgtttattgtagcactattcacaatggccaagatttggtggcgacctaagtgtccatcagcagatgaatggataaaggaaatgtggtatgtatacacaatggagtactactattcaaccatgaaaaacaatgagatcctgtcatttgcaacaacgtggatggaactggaggacattatgttaagtgaaataagacaggcacagaaagataaacatcacatggtctcacttatttgagggagctaaaaattaaaacaattgaactcatggagaaagtgagtagaatgacagtcacctgaggctgggaaaggtcgttgaaggttgggggtgggggaagtggggatggttattgggtataaaaatatagttagaatgaataagatctaatatttgacagcaaaacagagcgattacagtcaacaataattgtacatttaaaaatgactaagagtataattggaatttttttattattatactttaagttttagggtacatgtgcacaatgtgcaggtttgttacatatgtatacatgtgccatgttggtgtgctgcacccattaacttgtcatttacattaggtatatttcctaatgctatcccttccccgacaccacaacaggcactggtgtgtgatgttccccttcctgtgtccatgtgttctcattgttcaattcccacctatgagtgagaacatgcagtgtttggtttcttgaccttgcgatagtttgctgagaatgatggtttccagcttcatccgtgtccctacaaaggacatgaactcatccttttttatggctgcatagtattccaccgtgtatatgtgccacattttcttaatccagtctatcattgttggacattcaggttggttccaagtctttgctattgtgaatagtgccacaataaacatatgtgtgcatgtgtcttcatagcagcatgatttataatcctttgggtatacgcccagtaatgggatggctgggtcaaatgggatttctagttctagatccctgaggaatcaccacactgtcttccacaatggttgaactagtttacagtcccaccagcagtgtaaaagtattcctatttctccacatcctctccagcacctgttgtttcctgactttttaatgatctccattctaactggtgtgagatggtatctcactgcagttttgatttgcatttctctgatggccagtgatgatgagcattgtttcttgtgtcttttggctgcataaatgtcttcttttgagaactgtctgttcatatcatttgcccactttctggtgggtttttttttttcttgtaaatttgtttgagttctctgtagattctggatattagccctttgtcagataagtagattgcaaaaattttctcccattctgtaggttgcctgttcactctgatggtagtttcttttgctgtgcagaagctctttagtttgattagatcccatttgtcaattttggcttttgttgccattgcttttgctgttttagacatgaagtccttgcccatgtctatgtcctgaatggtattgcctaggttttcttctagggtttttatggtttaggtctaacatgtaagtctttaatccatcttgaattaatttttgtacaaggtgtaaggaagggatccagtttcagctttctacatatggctagccagttttcccagcaccatttattaaataggtaatcctttccccattgcttgtttttctcaggtttgtcaaagatcagatagttgtagatatgtggcattatttctgagggctctgttctgttccattgatctatatctctgttttggtaccagtaccatactgttttggttactgtagccttgtagtatagtttgaagtcaggtagcatgatacctccagctttgttcttttggcttaggattgacttggcgatgcaggctcttttttggttccatatgaagtgtaaagtagttttttccaattctgtgaagaaagtcattggtagattgatgaggatggcattgaatctataaattaccttgggcagtatggccattttcacgatattgattcttcctacccatgagcatggaatgttcttccatttgtttgtgtccttgaacagtcgtttgtagttctccttgaagagttccttcacatcccttgtaagttgtgttcctgggtattttattctctttgaagcaattgtgaatgggagttcactcgtgatttggctctctgtttttctgttattgctgtataagaatgcttgtgatttttgcacattgattttatatcctgagactttgctgaagttgcttatcagcttaaggcgattttgggctgagacgatggggttttctagatatacaatcatgtcatctgcaaacagggacaatttgactttcccttttcctgattgaatatcctttatttccttctcctgcctgattgccctggccagaacttccaacactgtgttgcataggagtggtgaaagagggcatccctgtcttgtgccagttttcaaagggaatgcttccagtttttgtccattcagtatgatattggctgtgggtttgtcataaatagctcttattattttgagataggtcccatcaatacctaatttattgagagtttttagcatgaagcgttgttgagttttgtcaaaggccttttctgcatctgttgagataatcatgtggtttttgtcgttggttctgtttatatgctggattatgtttattggttttcgtatgttgaaccagccttgcatcccagggatgaagcccacttgatcgtggtggataagctttttgatgtgctgctggatttggtttgccagtattttactgaggatttttgcatcgatgttcatcagggatattggtctacaattctctttttttgttgtgtttctttctgccaggctttggtatcaggatgatgctggcctcgtaaaatgagttagggaggattccctctttttctattgattggaatagtttcagaaggaatgctaccagctcctccttgtatcctggtggaattcagctgtgaatctgtctggtcctggactttttttggttggtaagctattaattattgccttaatttcagatcctgttattggtctattcagagattcaacttcttcctgatttagtcttgggagggtgtatgtgtcaaggaatttatccatttcttctagattttctagtttatttgcgtagaggtgtttatagtattctctgatggtagtttgtatttatgtgggattggtggtgatatcccctttaccatttttcattgcgtctatttgattcttctctcttttcttctttattagtcttcttagtggtctatccattttgttgatcttttcaaaaaaaacagctcctggattctttgattttttgaagggttttttgtgtctctatctccttcagttctgctctgatcttagttatttcttgccttctgctagcttttgaatgtgtctgctcttgcttctcagttcttttaattgtgatgttagggtgtcaattttagatctttcctgctttgtcttgcgggcatttagtgctataaatttccctctacacacggctttaaatgtgtcccagagattctggtatgttgtgtctttgttctccttggtttcaaagaacatctttatttctgccttcattttgttatatacccactagtcattcaggagcaggttgttcagtttccatgtagttgagcagttttgagtgagtttcttaatcctgagttctagtttgattgcactgtggtctgagagacagtctgttataatttctgttcttttacttttgctgaggagtgctttccttccaactatgtggtcaattttggaataactgcaatgtggtgctgagaagaatgtatattttgttgatttggggtggagagttctgtagatgtctattaggtctgcttggtgcagagctgagttcagttcctggatatccttgttaactttctgtctcattgatctgtctaatgctgacagtggggtgttagtttccattattatactgtggaagtctaagtctctttgtaggtctctaaggacttgctttatgaatctaggtgctcctgtattgggtgcatatatatttaggatagttagctcttcttgttgaattgatcccttaccattatgcaatggccttctttgtctcttttgatctttgttggtttaaagtctgttttatcagagactaggattgcaacccctgcctttttttgttttccatttgcttggtagatcttcctccatcccttaattttgaggctatgtgtgtctctgcatgtgagatgggtttcctgaatacaggacactgacaggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagccttgatggtctttacaattcggcatgtttttgcagtggctggtactggttgttcctttccatgtttagtgcttccttcaggagctcttgtagggcaggcctggtggtgacaaaatctctcagcatttgcttgtctgtaaaggattttatttccccttcacttatgaagcttagtttggctggatatgaaattttggattgaaaattcttttctttaagaatgttgaatattggcccccactctcttctggcttgtagagtttctgtcaagaaatctactattagtctgatgggcttccctttgcgggtaacctgacctttctctctgtctgcccttaacattttttccttcatttcaattatgaatctgacaattatgtgtcttggagttgctcttcttgaggagtatctttggggagttctgtgtatttcctgaatttgaatgttggcctgccttgctaggttggggaagttctcctggataatatcctgcagagtgttttccaacttggttccattctccccatcactttcgggtacaccaatcagatgtagatttggtcttttcacatagtcccatatttcttggaggctttgttcatttctttttactcttttttctctaacttctcttcttgcttcatttcattaatttgatcttcaatcattgataccctttcttccagttgatcgaatcagctactgaagcttgtgcattcatgtagttctcgtgccacggttttcagctccatcaggtcctttaaggacttctctgcattgattgttctagttagccattcgtctaatcttttttcaaggtttttaacttctttgccacgagtttgaacttcttcctttagctcggagaagtttgattgtctgaagccgccttctctcaactcgtcaaagttattctccgtccacctttgttccattgctggtgaggagctgcattcctttagaggaggagaggcactctgatttttagaattttcagtttttctgctctgttttttccccatctgtgtggttttatctacctttggtctttgatgatggtgatgtacagattgggttttggtgtggatgtcctttctgtttgttagttttccttctaacagtcaggaccctcagctgcaggtctgttggagtttgctggaggttcactccagaccctgtttgcctgggtatcagcagcagaggctgcagaacggtgaatactggcaaacagcaaatgttgctgcctgaatgttcctctggaagttttgtctcagagtagtacccagccgtgtgacgtgtcagtctgcccctacttgggggtgcctgccagttaggctactcgggggtcagggacccacttgaggaggcagcctgttcattctcagatctcaagctgcgtgctgggagaaccactactctcttcaaagctgtcagacagggacatttaagtctgcagaggtttctgctgccttttgtttgggtatgccttgcccccagaggtggagtctacagaggcaggcagacctccttgagctgtggtgggctctacccggttcgagcttcctggctgctttggttacctactcaagcctcagcaatggcgggtgcccctcccccagcctctctgccaccttgcagtttgatctcagactgctgtgctagcaatgagcgaggctccatgggcgtaggaccctctgagccaggcgcgggatataatctcctgctgtgcagtttgctaagactgtcagaaaagcacagtattagggtgggagtgacccgattttccaggtgctgcctgtcacccctttccttggctaggaaagggaattccctgaccccttgcacttcccgggtgaggcaatgcctcaccctgctttggctcacgttcggtgcgctgcatccactgtcctgcacccactgtccaacaatccccagtgagatgcacctggtacctcagttggaaatgcagaaataatttgtcttctgcgttgctcactctgggagccatagactggagctgttcgtattcggccatcttggaacaacccactgcaatgtttttaacccaaaaaaaataaatgcttgaggtgatggactccccatttaccctgatgtaattattatgcactgtatgcccatatcaaaatttctcatgtgcctcataaatatgtgcatctattatgtacccataaaaataaaaaataaaaacaaatattaaaaacctttttttttttcttgagacggggtctcactctgttgccctagctggagtgcagtggtgcaattatggctcactgcagcctcaacctcctgggctcaaatgatcctcccacctcagcttcctcagttagttaggactacaggcatgagccatcatgcccagctaattttttttcttctacaaaaacaactttagtataaaataggctttatgtcagatgatttggcccaactgtagtctaagtgttccaagcatgtttaaggtagactaggctaagctatgatgcttggtagattagctgtatgacgtatgtttttgacgtatgatattttcaacttacaatgggttttttggaacataacctcatcataagtcaaggatcatctgtatagatgatgataatatggctaaatgttttctcaagttctattttccagctgtaataatatttcatctcaagtgaatcccctccttggttctggttgcccatgcagtttaaaacagcttttaaaattgaactagctagtgttcttacataaatttgatatttttaaggcattgccaagtgaaatttgtaattctaaagaggaaatctcgaatgtttacttgtttttacacctaaattactcaggtgacattttaaaattccagggaaaaatgtgtaaatcactactgctttacactgaggattttgctggctactcagggcagcataatgaggtcttttgactgaagatatagttccaactcagatctactaagtatgttttcattttgaacctttcgagaaaatcttttgaggtcattccctgtgcccatctacccatttcagatcatttatctttctaagcttcccgtgtgcttgagaaaccccttaaagacaagtcaattacagagttaacagtatttgcatgaaatacagtagctcaatgaaacacacaaaaattatgttggggttattctttctggaaaaaatgtggtagggtgagtactgcttcagtgctagcgtactatggatgcttattcatgcccgatagcttccaagagatttctccaaaccctgactactttttctcatccatgttcaccacttacacctagactgatgactacctgagtgctagaatcaattgttagtgcctctccagttgtcagtcacaggtgcacccacagctacttgaccacatgaaagtggattacagtgaattttatgaaagtggggactttgcagaatttaccctgacatctgctttttccatggttatttacttctctcctaataaggtaatgattgattcttagaatcacagaatcatgaggttaagataataactttttagaaataaattatcagtctggtcacattttgaagctcaggggaaaatgtataaatcactactgcttttgattgaagattttgctccttattcagggcagaataatgaggtcatttgcctggagatatagttccaactcagatctactaagcatgttttcattttgagtctttactgagaaaatctctgtgatcctcccctgtgcccatctacccatttcagatcacgtatcttcttattcacttaacgttcaatgacattatcttaacaatgagaaatttgaaagtggtctgcttttcccaaggaaacacagcttgtttgggacatgtagtcacatcttatctttcctgttttaatgtgctgcttatatattctgaataatagtaggaaggttatatatcaaacacaggttatatataaaaattgaccatttttgacaagggatgataactagtaaaattacaaaacataaataaaaatgccagtatttcccttccctcctcattttttctatactaaatgttttattataccaaatcatttacttaattatttaatttctctctccctgcgggaataaaaccctgtaaagagttttgtttgtgctgttccctaacataccccaagtagttagagcagtattaaggtgctcagtaaatattgcttgaatgaatgaatgaacgaatgcaattaagactcttcagagggatagaatgtgtgttaggctgttcttgagttgctacaaaggaacaactgaaactaggtaatttatagagaaaagagatttaattggctcacagttccagtcctgtaggttgtacaagcgtggtgctggcatctgcttgggttctgaagaggcctcagggaggttttactcatggcagaaagcaaagcaggagcaagcatgtcacatggcaaaagtgggagcaagagagggcaagggggggagcaaattgggggaatgctacgcaccgttaagcaaccggatctcatgagtactcactcattattgcaaggacagtgccgaggggatggtgctaaaccattcatgagaaatctgcccacatgatccaatcacctttcgctaggccttaccgccaacactggggattacatctcaactgaagatttggaggggacatccaaactatattagcatattttattgttctgaatgagacgctaaggatccaaggatttcagtttcaatcaggggaacaaattttttcttattctaatattctgaaattttgaatataagttcatcagaagtctcatccacttatagacagtaaaatgctgatttctcaacttcattccagtgattctgttgaatttctcctgttgacctttcaagcaagtcatttgctctaattttgcgtttctttgctatatttaaacattctatcaataaagcccatcttaggagaatagccccaaaatctaggatgttgtctcatcctaaatatcagtgccattctgtgttgaaataggatactgttcccttccgctctctttgtctattctttttttttctagaaaagagaaaacatctcactgcaccatacatttggcccagccctctgacctgacaatgctgtctccttttgttatttgttttacagaagaaatgtatttcctttcttaaagcaatgagatctcattgagcccctcacatgttggctgccaagttcccagctgctgagcttgtaccttttgtaactcaccaggggaaggtgacctggactcagggcccatcatactcctgggaagcgcctgcctacttcattatctttagagttcatcaaaaggtctttcctcttacgaaggaactctttacttaataaagtgctccacacggaatacataagcagcagactaccctgggtctaggctaatgtttgcaaacaaacatgaagcatggctccctgtgttgcgacgacgagggatttaggttaaaagtgaaacagaaggctgaagacgtgtcacctattctcactgtcagcataacaagtggccactaatatatgtgagtccacagaccacagtttagtcaaaacttggctttgcgttttcatgggtcccaaccagttgacccttcgtcggtcagttggaactccattttgctggtgactgagtcaggttagtcatgcagaagatccctgggaccagaggaagttactcactcctcctctttgttgtttctgagctattgtgattttattcaactttggaagcatgagcacctttttaggtgcacagtcatcccataggtgggtgttgaagacactacagagtttattcttctctttcagaagcatatatagatgtgatgaagtcctgtagtcatgtaggctaggatgagttcatacttcatgtccatgaagtcacaacccaaagatttgccaaagtcaatgttttacagcaccataggatgcttttgtgaacattgttaaaggaatcaccctgaagggaggcagacccatggatacgtggcttggagaatatatttcggctctttcacccttcttagctggacctctgcttctgctgggtgcaacatgcacggttgtgcagagcagacctcagttttatgtctctcctccatccctagctctcctgctccctgccaccatgtcactttgaaaataaaaaaaaagaccaagttctcagacttgcaatgcagtcctattcaactgaaaacaacttcttcccttaggttggaaggttagttggccttcagaatgcattttggaaattttgcacctgtctgtcctgtgatgtgaccgaaactactgctgggaagctctcctctgccatcttcctacatttaacttggatttcaaagttataaaactaaacattcttaataagataactttgataatccctcttctgacatattactatagccaacatcttactgaaattaccccacaagacattctcaggtgtctttttaccaacacttttctcctgagctggttctattttctggagatgaggtttcagaataggctctattgcttctcagattatcaatttaagacagaaaataatagaagtagatactagctagcagaaaagatttgtgaagtaacaaagctaggcatggcctgtccgttatggtctacactgggttagtgaattctggagaaaattctcttcatatcatttctccttcctgtcccaatacaccctgtgcagcacagtgctaggcatataaataaaatttataggttaggagtatcatcttgaccacaggccagcaaattatgaccacaggccaaatccattgtgtatgcagcctacttgagtgaacaagattttcttgaaacccagctatgcccattcacttatgtgttatatatgggtgttttctcaccacagggtcagagttgcagagacttcatctgacccctgaaagcctgaaatctttatctgattcttttttttttttttttttttttttgagattgagtctcactctgttgcccaggcaagagtgcagaggtgtaatctcggctcactgcatcctccacctcctgggttcaagaaattctcgtgcctcagtctcctgagtaactggggttgcagggcacaccaccatgccttgctaagttttacatttttattggagaaggggtttcatcacattggccatgctggtctcgaactcctgacctcaagtgaatcgcccacctcagcttcccaaagtgctgggattacaggcatgagccaccatgcccagcctttgtctgattctttacaggaaaacgtttactgactcttgctctagacctaccacataaaagtccactcaatattattttttaatgttgatatggattcttctggtccagacacttatttgcgatgtgactttgagtatattacccttctgtgcctcagtttcctcattgtgataaaataaagttaacagtacctatctgataaagttgtaaagattaattaataaagttacagctctcagagtcatgcctgggacatagtaagctgttaacaaatattaacttttattcatcagatcaattgatattattgatgttgaaaatatggtcttgttaccaaggaccaagatagacatgttcaaggcacttgactatattattttatttgagagtgacaaaaacataaagtagacagaatcctaaaagtgaactgacaacagggtgagtgctgagcaggggaaaggaataagccttcatgattataagccttcatgattagtatagatttgagccatttctacaaagacgcaggaaagaatgtttttagaatatatatattactgcagtcattaattttaaaagcaccattagaagaaatagttcccagaatatagtatgttttgcaatatattgcaaaagcattatagtcctgtggaaatttattaataaagatcaataacaccaaaaaatacatagaacattttcttgtagaatgaaaactccagcatcaagggatggagcagctgcctggttcaactccccatgattcaaatctgaaattcaaaatgtaaactttattatttttatcagagattgacaaacttttttttattaagggcccaacagtgaaattttttggctttgagggagtcatgtggtcttttgtaactctgctgttatagcacagaagcagccataaacaatatataaatgaatatgtacatctgtgttctagcaaaaatttataaaataggtgatgggccagattttgtccatgatccataatttgcagactcatgatttaaacaattacaaatcatgcaaatcatgttttctttttctcttctttcgatcactttccctttcttgcatatacaactttatttccccacttaaaatatttccatttgccaataatataaggtctatctgaaggaaaagagatatattttactacctaaatttcactttgtttggctgggtatttctgtttagtgggttggagtgggtggtgagcattgtcattttcttctaataagttgaagtgacattgtcaaagacattaatgaacaacaaaccagcaatgggttgtgattaaaaagtttacctaaactctatttttatttttatgtttctaaaatgaaactgaaaggaaaatgaaaatgtacctaagtaaataagctcaatgcataaataaataatatagactatgctaaattgagcatcaataattttaacaactttctatttacgtgacctatgttacattagaaaaagtgtacttggctgggtacagtggctcacgcccataatcccagcactttgggaggcctaggtgggcagatcacaaggtcaggagttcaagaccagcctggccaacacagtgaaactccttctctactaaaaatacaaaaattagccaagcatggtggcacatgcctgtaatcccagctacccgggaggctgaggcagaaggatcgcttgaacccaggaggcggaggttgcagtgagctgagatcgcactactgcactccagcctggcaacagagctagactctgtctcaaaagaaaaaaagaagtgaatctcattaattctgagacaatgtgctatccagaccattgtgtccctaaatctttatatcacctatcaaattatctctccatctgatgctatttccataaatgtgccagttattttccactttttttgtgagtatgaaaaaaatatattacaaacctatgattgttagcttgaactccatttccccatgaactaaaagaccaaagcaatttagggaaactccaagtaaagctatgtagagtaaaaatcttaattaccaaaggtcgctcacttgggagcctgaactaggccacggacgggaagtaaggaaggtccctgagcattgcggcacgtaatgttctcatatttcactctcaggagaagctctcaggttttcttccaaattcgcgtagtcttaaagaccatgctttgcttttttttccttgctcacaacagtatttttttaactgttaaatgaagcatgccatccatataagatactatatatatagtaagaatatagttgaaagaattcactggtgtacataatgcttgggtcaaaaaagagaaaattaccagcacctgacgagcaccttattttcccactttcttccctattccccaagtcctcgctgtcctgccttctgacagcatagatctgtacagctttcttttgtacactacatactatataatcacacagtttgagtccttttgtgtctgacatccttagctcaattttatgtttttgggatttattcatattgtcctatgtagctatggtcggttctttttcacttcccggtggtattccattgtatgaatataccacatctcatttattcattctattgctttgacatttgggaagtttccatttttgaagcattaccaataaggcactctgagcatccttgtacatgtcttttggtgaccacgtgcacattaccagagtatctacctagaagtgaaattgctgagttgtagggtatgcataagttcagcttattagtttctgctgaacaatttccttaagcccaaaacagcttttaaacaaaatggaagtcagtcctgctgaaggcaggcatactgatggcaacggcaatgagagctagaataatgtttaggagtgcttagctttcattcaccaaagatgtcaaactatggtcaatcatgcctatttaaaatggcaagggagggcaccttccataatgtaatgattaaagtctggactcttatgataagtttctcttacttggcaatgttatttttgtaaaccattcatttcccactataatctgctcttatgaatgaatatagattttgttatatatttctagacatgctgatggccaaccaaagcatagaaatactagtaaaaaaataatccagagatgccaactcaccaaagccatgcatacagagcattttcatacatttctgtgaagatgcaatacatttgattcatagtcagcatagatagatgggagttttgaggtcaaatataaagcttgtgtgctcccagaaaagcagcattttgaaagtttgaaactcaggccaaagcactctagtggggccctatccttggcttctttgctttctcactctgtgctggcagggctcttgttgacttcaaagggagaggctctggctgggtaagagaagttctctttgagcgattaacttgagcaaatgagctgcattggaggacttcctaccaataagatcttgcctgtgataactaggagcacatttctaactttgaagaatatgagtgcttataataagtatttcagccacacaccgggagacaatatctgaggtaggtgggttcagtagcttttaaaaataaatttaaaataacatatcagtaagtatgtatgtaaatataaatacataaaatatgaacatccatttgtataagtctgtatttttcacatcgaataaatgggactgcagaagaaattttcctactgtaagaatcctcaatattttaacagggcgtcctgaaatgcccctgaagggacttcagcacttgggtggagctggctcaatttacacagttcccaagggaattataagatgaaagtgtcctgttctgagccctcactttgggctaggttctttttgaacattgcttcccatctttgagataaccctgaaaggataacattgctgttcccattttatgtatgcaaaaacagaggctaagccttttccccagtgtcatgtagttagcatagaagaagacctatgaccttcacccatccactttctccattcttacctcagggaagagtcacagaagctatttttgagggtgcatgtgaaccatacacaatagcaacatgaatgactagggaaggaaagaatgggaatcaatatatgtccagtgagtaccaggtggaaaatcgatgaagacataaaacacctatataacggggctgattgatttcactcaagttagtaaaaatcccagccagttgttcttaatcccaactgtacacggactcacctggggcccaagtgtcagtaccttagcttctgtttcgtttggttttggatgaagcctgggcagcagtttatctgaaaggattcccaggtggttctctgtagccagggttgagaaccacagactaagatgaaatgtctttgtagacagaaaaattaaacctaaatcattaatgtgacttttttttaagaaagcatggaaatagaagtgtttgtgggaaagggtttgacaaactgttgactgttgtacctgtgacacattagtgaaatgttaaatggaaaagaccataatttatggaggtcgtctgacatgtccatccacagtactgaccattcacatagttgtgaatatggacaagagagagagtgagcactctggcggggtcatctgtattgcctctccagacagggcaagaaggcctgtggttgaagtgcagcaggaggaagttctgccttgggaacccgtgcctgaggaacttcatgggaccaccagaaacagcatgttggagggtattaaggggatcctttctctcgatgatgatttgaaaccagcctttcctggtagcttgcccatcacagttcctctggccttctgtctatggaaaggaaactcggaatgaagggagtcattcaaaagtggaaaaaataagaggccacctgggtcttacgaggatcaggactcttctctggaatgttctacaaatggagccacactctgtgattcaagaaagtaatgtctggcgtattttgatgtcagactctagtatttttcataccaaactgaaactggcactttacaggggaagaactttagaattttcatttcaaataagccaggttttaaaagaaattcttcccagaagtgcctttcatactcaagggcatggactaatgctttcagagccctaaacttaaaaatatgtgcttgaagcagtcagagaggtgcaggtatacatatgtacttattgttaaaataacgtaaatgtgtagtttcattattaaaggtggacacctcaaaccaccacccatggaagaggctagatgttaccagacagccaatgggccccctgcttgctgcctcctaaacacaatcctctcccccacaagaggaatcactgatttctttggtaattcatttcttatttttttcatttctttatacttttatcagccaaatgtatatccataaacactaaatgttgcctgctttaaaaaaatatttattgatagactggataaagaaaatgtagtacatatacaccatagaatactatgcagccataaaaaggaatgagttcgtatcctttgcagggacatggatgaagctggacgctatcatcctcagcaaactaacacaggaacagaaaaccaaacactgcatgttctcactcataagtaggagttgaacattgagaacacatagacacaaaggggaacaacacacaccggggcctattggggggtggggggttgtgaggggaaggaacttagaggatgggtcagtaggtgcagcgaagcaccatagcacatgtatacttattgcaacaaatctgcacattctgcacgtgtatcctgttttttttttagaagaaacaaaatataggtactacatatatatatatctagtacatatatatatattttgtttcttctaaaaaatatatgtatatattatttagagctcttttagtctatagttttgctcctccattgcaatttatttgttgaagaaatcagatcatctcttgtttcccttggctgagattttgctgatttcattcccacactgtagagtcccatctttctctggcctatgtattttttacaaattggtagttggatctagagacttaatgacatccagatttgattgtttaaggatggcttcttaggtggtgatgtgttctcatcaagaggtgcgtgctatctaattgtctttcttggaagcagccattgattctcaatccttccttcattaggaggaagcggtgatattgcaattttattcttcattactttattagaatttatttctatacagagaaacttcctctcatctacaatttggttacctgttggtacagtttgtagcagaacaggataaatgtttaagtatttaattttaccagtgttcaaaataaaccatcaattccctagcatcctttcaaaaaggtggccattttattatttttgtatcattaggagcttgggattataagcatatatgactcgtttcaatctatcataattgttacaatacctcttaggagaatgtttttatggttacattatagccaatattatgcctgtatagccattaccccaggaatgattgagagaggacaaagggggcatgaaaaggcctactcccaccccccccaattctgatccttgaaagttgtatggccaagggaggcaagatggcatagtagagagagttcgggatttggagtcactgccaggagacctgggattgaatctttggtttgtcagttactagctgtgtgaccttttgtctccccctgaacctttctgagactccctttcctcatctgtgaaactgaaagtagtaataacttttgttcttcgctcagtgtaatgtattaattgagaatgtgcactaagcacctagcacaatgtctgctgcagagtaggcattcagtacaagttcccttcctgtcctgagctccctttgcaaagctctggggatatgcaccaaaccctaaaggcaatgagttctagacctagccataggcaaacttatgagaaatggaagcgctttaagaatggggtcatccattaggcaacatgttcaaagatttaagccccatgaatccatatggttctctctttttttaaaaaaaattccctctactcttttttgttttcatctacaggaagttttcattattgccattcaataaagtttattttcattccctttgttttctgaataaagttaactggtatttcctataagccttttattataatacaaaccagctcctctagcttttgaaaggatgcccttagctacagtgctgtgggctccccaggcagaggacagtcacccccacttttatctagcttgaaggactccagcttctagggaggatggtttttcctggcactgtttcaggaatgtgagagtcgccagccttgcgcccccacccagtgtgtgtgcgcgcgtgtgcacacacatatccgccccctaggttactttttttgttactacccaccccccaacaaggcccctttaaatacccagggtgctgctgtatagttcccaagttgttccttttcacttgtgaaaagtgtcattgtaaaatagaaacatgctcagcattgccatttattttcaaagtggaagaaattctcctctctgaatgctgtggctgaaaccagaagaagtgaggccaacctcaaccagtggtttcttgaactggatgacctctatttacccagacagagaggaggaccctcaggaaacaaaaaacttcttcaactgcaagagaagcaggaagtcatttgctatgaccttaccttgctatagggtttgaccatatctagcaaaagtctttcatgtgccctgctccctgtgatccttatgataatcctggggaaagctatagagagttctattcccatttcaaaaaataggaaatcgaggctcagagaggtgactcaaggcctcagagctgtagagccaggactaacactcgactttgcttactccccatccagtggtctttctgctaccccaccctgggcttccatttatctcagagcagtgtgagtttctaccttcacgcttgccttgctctcctggtgagatggatcttggcctttgcacctggatttccagctgatacaggcacttgaagcttatttcattccctttgtcaacccatcatgtgggatccattcattcaactataagtatttatttagcatctactatgtgttaagctctgtgccctcattcatggggaaccaaagacccttaaactgcttatagtcaagtggaagaaaacattttatatataaaatttaatagataatatctgaagtttcctattaaagtcatttttaatgatcctctctcttgaaaggaaattgataaaggaattacctctaggttaaaaaaaaaaatatgtatccatacaccatcttatagcaaagactaaggaagtctcaacctaccctattctcattttctggctgttcctgtaaaagagagagagcatagaagaggaggcagaagaataactacgtaatggctctgagttcctgcgcttgaaccactttgagtgtttcctaatttgaagtaatactaacttattgttgtggtcaaaaatcaacaatttgctttataaaacctaatgcatctcttggtaacaaaagcaaggatctagggagaagaagggagtggggagggaagtgcctgttcctttgttgctgtttgatcacacttgctgaagggccgcatgctgccctccccaccactccccaagcccaaaccccgtcttatcagcatcttcaaattaagcatgtgctcactgttgtgctattttctggacaattgagttggatcatgaaccacaacttctaggcttcaggaagtcccgttagatttgtcaaagaaccatactaccaaatggtttcagaatacaggctcctacacactcaccttgccagctccacagaggtttttaactcatccaaagagagtaaagcgtgagccttgatacaggaaaaaataatctaagagcagaaatggaagtaaatctgcataatgtggcacacatacctcattttaaaactattattactgtgtagagtaaaacacttgagaaaaatgagtttaattccttttgttctaaagacagttattgaatagggatataggattatcttaaagaatgcatctatatcaccttacataaaataacaagaaatccactatttaacatgtttcataaaattctcacctgtagccataaattaaatattgtgattgaactgcctttggactatttcattgctaactcaaagtcaaccagtcagcttgacagctacatttccctaactgtatggttcagcagacaacaagtaatagaaaatttccttctgttaggaaaacagaacaatttttctgtatgtaggaattcatcttgcagtaacttagatgttgtgtttttaaccaatatttaagttatcacatgtcatttgattagtattgtgattatttttggagaaggcatgatatcaaagagaactaacacattaggggttataagacctagtttcaaaagctaacttgcatggttaggctttgtgtccccacccaaatctcaaaattataatccccataattcccacgtatcaagggagagaccacacggaggtaattgaatcatgggggcagtttccgccctgctgttcttgtcttagtgagttcttacgagatctgatgattttataaatgtttggtagttccttctgcattcattctttcacctgctgccctgtgaagaagatgcctgcctcccctttgccttccaccatgattgtaagtttcctgaggcctcccaagccatacagaactgtgaatcaattaaatctctttcctttataaattacccagtctcgggcagttctttatagcagtgtgaaaattgatgaatacactaagtcagccacttacttcttatgtgatattgggcaagtcatcttttaagtggagatggtctttcatggtcttggctatctaatggggtcactgatgcaagtcaagtgagatgaacaaatagcacttgcaaaagtgtaaagcaatggattatgtatgacatttttcttttggttttgtttttaaggctccctcccctgctacacacacacacacactcaacacctttgcaaatctattctttcttacttgtaatttatgttctactttccaaaagacaaaaaaagaagtggattttcatacaagatacagatataatggaactaatcaaacaaggatgtataaaaagcagccagatactaaaggcaaaaggaattaggaggaactaccaacactgaacataaaattccctaagcatcatagcagtcaagggaaaaaggaaaaaacatttttgcaaggttctccccgtctaattgagacaactctctgtccttacgctatgtgctaagttagttcataactgagtgctactaaggtagctttatgtcttacataacacaggtttcataaatcattaccactttttaaagaaaccactgtgtcaggcccagtaccttgcctgaagcctgtaactaataataatcgtggtagtgattattcttagaagtttaataaataatcctcctttgtcatcatgtttttctcgctttcctagactgatacaagtactgtcaaaattctgcactagcctaagacattggtgggtataagtctaatccccctaaaagtaatctgtcattatgaagatacaacttgtataatataccgtttctggcagtcttaaagagaagtcacttctcctcttccctctcccatctctttttaaccaaatgctgcttctaggagaacttgattgacacaagctctcaaacccgcatctttcagctgtcaatttagagatctacagtggaaagtgtgtgtttttagcttagaaactaagtggattccagagtgtcttctcatcttgagactgtgcatcctgtttgaacatttccaagtgtatagggtacagcaataaatcatattttgatcagtgccaaaaacatggtgccaaagaacatcttgacattactattagcacatgttgtatcctgtaattaagcagaatcagcttagagatgagttcttctgaagacggagccctcctttcatgggagcgtaatcggaacgagctatcactctcattaagttacttggtaatacatcactggcgtgacctgtcattctaatgatgcattagtgtaattcatcaacagggtaaatcccactaataaggtgttactccggaggcaggactacccagtgcagaaagcatcgaggggcagatatatgatgactgcaacctaaggcccaggaggcctatataattgagccctatctccttcttactatttaaagttgagctatttttaagctatcaaaaccagtgaccacctgcccctaaactcttctaagtttttctttcttattgctgatgttcttactcgtccaaggatgtttgactttcatttcttcgggtacgtaactgagtcacttggttctttcccaaagatttatattttaagagtcagtttcatagttgtcaaagtgcttgtggatttctatatgattcatagctgatataattctcaaatagattaaaaaaacttacacaatgatgccactccaataaatagaagatagaaaaaaagatattaaaaacaaggctaatagagttggtataattgagtattatattcatctctgagaaagcaaaatgaaaaagatgatagatggaaggaatgaacactattctgtttagaaacttcacttctaatattctaattttttatgtagatccttgtataagagatgctaagaacttgatggactttgcctgcaatggtaataatactggaaatacagtaacattcttcatagtgattttttattctcaccttctgacaaagccaaggatcttaaaatattgtctgtttaaggcattcttgtgaagagcaaagctaacgaaattcaagtatataaattactttgcaaaaagagttcgaaaacttaccagaatgaataggatttttttctaccgtttaatatcacttctgtcttctgaacttttttaagaaggtagatagaaataatatattattttttagctttatcgaggtgtaatttacaggcagtaaactttaccctgtgtgaataaattttgataaatctagataactatatataatcatgtaactaccacaattaagatattaagcagttccctcatgtcccttctcagtggatcccaccaactggcccccagccctaggcaaccactcagttcctttctgtcactctaatgttaccttttgtagaatgtcatacatatggaattatacttgtagtcttttgacttctttcatatggcatctgtgttgttgtatgtattcatattatgttcgcttttattgctgaacagtatttcattaggatttatttttatgaggaaaaggcttaatgaatattaagtgtagaggctagaagaaatatccatatgaatttgataacaagcataaaggtggcaatttgtattcttgcttgaatagagaacaaatgccttctattccaatatatttttttaatactttacaatgacaagcttgaaagctgagtgatggctggaaccatgctctctagcttcccattatgtctgcaatatctagcccagtacctgcacttactaggtgcttaataaatcattgttaaattagtgaatgaagacattaatagatgttcatcatccatgtacagtagtcatatgaagagagcagtccctcaaaataagagtaaaatataaagagaaaagttccattagttaccagttattgagcacttatagaagtgcttgtaaagtgactcagttctctgcacatatttcagtttcctttcagatctatttttagcactatcacccgagtattttaaatgcttttcctatccagtgtattttattctaaattcccagctttgggataaccaacttagtacatttactatgcactgtctttttatttactctgagtatttctaaatatttaaaaattttttgagttatacatgctcttcagttccaagggtttttctaaacacataaagcataatcaagaaatggtacacttggaaacacaacaccatagaatgttaacacttgaagatgatttagtctaatgtcctcattttgacagaagaggaaactgaactcttgaaaatggcctcaattcatacaacatttggtagaaaattttgtgcagttgaagataatttttaatagcctattaatgcccaacaaacaagcagttaatttactgaattgaactgaaaacaaaagatagatctcttagtttgcttgcttgttcatatctaaacctaagaggactgctagtatgcagttttaacatgttgagtgatactttagagcatatcaaggaaaaaataacttataaggtgccagctacagagcttaaaatagaattgatgccaaagcaagagaaacatacaaataaagaacaaattctgtactggaagcagaccaagcctcaagtctcctggaaatcacaatgaatggcaaaatctattaattatatgccttaaatgaaacctttggcctttaagatgttttctctctgcaaagtcactaaatattccagaaattaggtgttcaggtaagctcacctgaaatcttaatagattaattttgcctattattatttgagacagggtctcactcttttgctcaggctggagtgcagtggcatgataatggctcactgtaacctcaacctcctgggctcaagcaatcttctcacctcagcctcccaagtagatgagactacaggtgtgccaccacacctggctagtttttgtatttttagtagagacgggttttgccatgttgcccaggctggtctcggactcctaggctcgagcaatccacccgcctcagcctcccaaaatgcctggattacaagtgtcagccacagtgccagccacctcttattatatactgtacctaagcagcttaacgttcacaggatttgtattcagaagataagacagctttagatgtagtcctctatagtactctagattttataaattttataaatctagatttataaaaccattaaaataaaactgaattgtgttttacagattaaggtgatacctaaactagtgctttcggggtgcccttaccactagattaaactctgactcccttcatctctccattaattcaaaaattatttataagatgcttactacatgtttaggtgctctataacacaggaataaaatactctgatagtacaaagggacaaacaaaggatttcaatgtggaaagttaattaaagaagacttcaagaagaggtgacttgtgagctaggccttctgagaggagaggcattttagtaagttaatatgataaaggtgattcctggggctgcaaataatctctatgaaaagggtaatatctgagtatcttctctctggattccattttggaggaatataaatgctttcaaggtgtgatacacatcagtaggtcagaatgactttggccatatttcaacaccaaataaatggaactcagcatcattgtaagaccttatgctttctagaatctttaaattcccaataattaatataccataataaaaatgttaaagtctctcaaaataggatattgatagaacagaatgtcatgacttgacatggaatttcatgaaaaaaatgttaaaagtgagagagaattttacatgcaatatgacaactgggtgatataaacacacaggtacactcacatatacgcacacgtatttgtgatggagataaccaacaccaatattgacagtagtctttttcaatcaataggttattttaatttgcttaagtagcatgatgatatctttgattggaccttaaaaaagggaagttagagttgagcaacctgataattcacccaacaaccttgcacccattacagatttttgcgttgcaaagtttgtttggtcatcttccaaataaggatgcatttattatccctaaaatcagaaaatagatatataataacagtgattgttaaatctcttgcagtttgaatattcatagataattataattgataaaggcaaccgtagcctttttaagcaaactgcccatataaaaattcagtgttacaggatgcataaggaaagacgtgtccacttttctaaaagatttgccatcagtttttttaaaatgttgcctttcccttatttacttgaataatcagttgagttagaaatattttcaattagacttcatgtttactctatgaaatgaggcacctcaatattacagtattgaagtttattttagtaggtattacaagagcctttattaaacaatggagctagattacaattactttaaaatagcagtgaacttgctctgacttcaagataatttagttttacccctaaatagcttcattgcaatatttctctcaggaaaaaaagcactatggccaatctcttttgaaaagggacttaaaatcaggtttattatgatttttcaagtatgtattttgttgagctttctacacacgttttcttgttttctgagaataaaacctacaaacctgccaatcctaatgtcttaatataatctataccacatatatgacaagtgaacaagtacaacatctgctgagggacatgaatttgattttacactcaacttgtcttcaagcaggttggctgctgtctgaattgctggtgggtactcaatcaaaaatagtatctcccttcacttttctgggagattctccccaactccatgtcctttcctatcaggctgctctgtgaatcaaacacaaggagacacattagaaatagatcaagatatgacaggctcaagaagggctgaatgtagggagcttggaactacccacagttacccataattgaacctcaggaagacttaactctgtggtttctctcacaattgaaaacatgtcacactgtaagagaccaattatatgatagcccacaatgtttaagcataagatgataattgtttatttaattagatcatttgctttccttagtgatcccatttactctacttactgtttcgagttgtagtccactattccagaactgctgggtcagacactgtaaagatgttgcttaggagacatgcagggctgggacagcatgtttgccatttaagagatgttctttgatgggctcgtgggctcactgaggaggtaaatatgtttgctgaaacgatattgaaaaatgaaaagcttcaaataaattaataaaagtctgaatatttgagttaggaaatgttttcaaaagaatatgttatataataaaataaatcagtttgacatattaactaagtgtagtagatgtgtttatccattcaaaaggggaatttatttgatgttcattatgaaagcactacagaaatttcatactgttcataagtgttaacaggtctctttttttgctaattgtatcttcccccactctgccaaaattcacaattgagactatattacatatatatttccacaactattttttttatttctcgtaatacagatattctctatattggtacataaaattcctctagaaagtaattgttgacagcttgctgtggaagatgaagaaagtagctacaagttacccacttaatacttctccccattcccatcacaactatattatgtttgctgtattattacattggcattatgaatgtttatggcatttatactcttttattatcataattccaatagtggtttatcattaagtctctgctatatttacatgggaaccagtctcagtgaccatcccttcatttcatagattctcttccctgagttgtacatccctttattcatttcttgatgggctgagttccattatcccagccaggttttactaagtattcacttgctttagaatgacttttttgtctttaaaagtgactgaacccgtgtctgggtatattagttttgtttttcttttaaaaaccaatagacattgcctctatgtcttttgggagtcaatgtcgctatgtggaagtttgaggccagcctgagttttatatcttgcaggtgatttgacaattttttgtctcaatactctcacatttctatccctgaagttcaaaaacttcaccagaatatatgattctactgattataactattttttatgaataatagctgagccatttggatgtgcagatacagaacttcctttttcattggaaagttttcatctatggtgactttgagggttttttttttttttttttttggttgttcatttgtacagttctctcttttaaggatactctactctttgtttgccatatcttgtattactttcattgatttttagtttccctttgcatttatgttattttctcatgtctgtccttgtcattgcctctctttttagcagtatccattctactcccgtttctaatgtgttttccttttcttcagtaattttatggctttatcttctcggcatgatcagagtgccttttatctctttaattatctcttctcttctattatctcctgtattgattctttgatattcttcacacctactaaagattccatattttcttccatttttttaatcagagaggagtatttgtctgtagtcctttttatttcccattccctgaaatttactgattgccttaactttttttggtgggagaccaggaaatgccatggtaaccatgtgcaggtggcatatttgatccttgctaagttctctatgtgtgactttttgtgtgctaaccctagtttaagcattaataaaagcacacatgcaggaagtaagttgagagtagcatggatagtctctcaccagtgtaccttctgctctagatgaatgtttctctcctagaagagcaaatctttgaagtagtccttggagtgactcctagtgaagattcttcaccaagttgcaatttgtttctcttttttccttgtttctttgtttcgcctcctctacaatatgctctccttgttgcaggagccagaactctacaaggatgtttttgtctctgctgtcctatccactaactcagtcttcactcttctaagggatcgactattgtctgagtctttcaagacctgctaacttaccttcagaaagatctatatcctgccagataaatctgcgatgatttattgccagttgtttttacaccccaacttggagcaaatgttgctgtttcaggcaaaccatctttttagtccattatttgtagttgtcattgtttcttagtttgattataggttatattttctattctattttttattccttttattcacttctacgcattttaagaaagataatatacataactttattatcttttaccatatgaatttctttctgaaggtattcaaaaaaacaaatatttctaaattgaatttgataagtacaaaaaagttttaaaattctttctcaaattgacggtaggcagtacagctctctgtaaactaccaccatttgcaattattgtttactaattgctatctattactgatatttatctactttaatacataagtaagcattctaccccaactgggtatattgtatactagttaaaaaatgtgtggaccttttgctatttctctatcaaagataaaatgatggagtgtacatcagtgaaattaagttctatgctttgaatgggcacccttttttttttctttaatgcaacagacatctccccacccccacccccagcagtcattgttagaaagcattaaattgagcattcaagattaattccttggcaggtcaagaggagaacagtgtgtagccaatcctaccttcgtgttccttcttaatggcttcagcacagtgtgaaaaagtaaacagttgtgacaagagaggtaatggatgagctgggtgtgacaggtcacccaactgaagctcatcctctctttaggtacacgctgtaatgaagtgcactctagcttttgagattatcaaagacttgtatgataaaacatatttctagagtggggaaggatcttgagtaaatatattatgaatgatgatgcctagtgacagcaaagaaataaaaataaataatgaatgaagtatgcttatactgaagttttagcctaggaagttctggtattaatgagattccctcttctgtcttctctgtttcttccaccattctattttatatagaaacacattctaaaaataactatttggagaggaatgattttataatgattaagaacagcaagattattgcatcttccccctaaaaccgaacatacttattctctgaacatgtcacacgcctttttacacactgggaacctatggattcctaagaaatgaagtgaacttagtggtcaagctgttctttcccccatttcatgaaattataaataaaaatgggacacttcccttttctcccactcatccccaaatctcagggagctagaatgacatgaagaaacaagcataatgtcctattcaccaacataaattgttactcaaccttggaatagagtatttcaaagaaaagttaaattaccccaggtaggttatattttcccactgatcagtttctaacaataattatcattataattaatatttatctagtattcacgatgtgtcaggcattcttataggcattatatacacatcacctggtttaatcttcccagataggaaatattctttgatttatagaaagctggggtttacctaaggtcttacatccagaatggaaactacatgcttccaaactccagggcccacaggttttgtctttagacttcactgttatagtgctgttcaatagggtagccactagccacttgtagctattgagcacgtgctcaataataaaatgtagctaatatgattgagaaactattttgttccattttaaacttagccacacaggactaccatattagacaacacaaatctagttggtcttctataagattcattttttgttttttgttatgcagcaccagataactaatacactgaacaaaaactatgatatctctaaaatattaggaaaataagaaaatcttaacaaaatacagaatgtgctttgtaagtttgttttattggcttggagctcctgaggataatccctccttaaacaagcaaatacttctataccaagaagccaagagcaaatttacacattgctattaacattttaagtgttatgcaaaacaatgatgtttgaaggtaaaaactcaacacttctggaaagtttaattaaagggattgttcatcaagacagggtccagcaaagcaatgcttgcttttctcaggaaatagaagcgtttacaccttctttaaagttagcttctttgaagttagcttgtatcacactgacctttcctgtttagaagcaccaagacaaggtacctgtgattactgggtgtcttctagctgtccaaagtcaaaccaagaaatccttatagacctttagctttatgttctcacagccaagcaatactctttgttaagaagcaatcagctcccagagatcttttaggttactcctctaagaagttaagctacatcaatgactatcaacttgtgagagttccagttgatctatatcttaccaacatttggtaatgacttttattttttaaattagccattctagtgtgtaatggtatctcattttggtttaaatttgcatttcctgagttaccgataaaattgagcatggtttcatgtgtttacttgccttctttgaacaatccattcaaatattttgtgcatttttaaattgggttgcctcctttcttgttgaattttaagagtttttaatataatctgcttatatgggtttttcagagataaaacttgcaactatttcttttcacttcatagcagatcttttcattctcttagtgttttttacagagcaaaagctcctaattttgatgaaactcaatatatttttttttctttcggtatcgtgtctaagatctcattgcccaacaaaggtcacaaagtttatatttcatttaaaagtgataaagttttatgcttaatatttagatctatgaggtattgtttgagattctttatttgcatatagatatcaaattttctgaggggtatttgttgaaaaaactaaattttttacaaaacagcctttgcacttttgtaaaaggttaattgaccattgtttctggaatctctcttctgttttattgatctatgtgtttatccttttaccaattttatactgtgtttattgttatagcttatgagtcttgaaatcagataggatgtttgctccaattttgttcttcaaaattgtttaacaacttcagttcctttgactttccacgtaagtgttagactcagcttgttggcatttacaacctaattctgaaagtcattgcattgaatctatagattcatttaaaaagaattggcatcttggcaatattaatacttctaatccatgaatctagtatatctctatgtattatatattaataaaagaaaacccaaataagcctaataaaagaaaacttatgatttatttagggtttttttatttctttggccaacgttttgtcattttcagcatacacatccagtccatatattttttatatttatgtctaagtatcaatgctattataaatggtactttttaaaatcttgacttccaagtgtgcattgctgatatatagatggtccccaacttatgatgatgcaacttacaattattcaactttacaatggtccaaaaatgattcacatttagtagaaaccgtactttatctatacaatcattctgtttttcactttcagtatggtattcaataaattacatgagatattcaacactttattataaaaatagttttatgttagatgattgtgtccagttgtaagctaatgtaggtgttctgagcacatttaaggcaggctagactaagctatgacgctgggtatgctaggtgtattaaatgccttttttctttttcttttttttttttttttttttgagacagagtcttgctgtgttgcccaggctggagtgcagtggtgcaatctcagcttactgcaacctctgtcttctgggttccagagattttgctgcttcagcctcccaagtagctggaactacaggcacgtgccaccatacctggctaatttagacagggtttcaccatgctggccaggctggtcttgagctcctagcctcatgatccaatcacctcagcccccaaaagtgctaggattacaggtgcgagccacagcacccagccattaaatgcatttttaacttgatgatattttgaacatattataggtttatcagaacataaccccatcataagtcaaggagcatctgtatagtaaaacaagtgatttttttttatgtgttgaccttacgtcctgcaaccttgctaacatcacttattagttctaggaggtttgtgtgtgtgggtttataaattcttcaagattttccatgtagatagttgtctctaatgtgaatagagagttttatttcttcccttctaatctgtatgtcttttatttcttttaattactttattgcatggctaaaaattttagaatatttaataaggatagtgagaacagacatacttgtcctgttcctgatatcagaaaaaatcattcagtctttcaccctttagcatgaaacccatataagctataggggtgttgttgttgttgttgtaggtgccctttatttgggtaagagaatttattattactggtttgccaggcgtttttgtttggttgttgtttttttttttttaatcatgaatggatgttgaattttgtctaatagtttttctatatctattgagaagatcatatggttcatcttccttaatctgttaatgccatcattaacttcattgatttttgaatgttgagctatccttgtgtccccagaataaactcccaattttctgatatattattctttttacattcaatttactaatattttgttggagattttgaaggctattcatgacaaatagtggtctgcagctctcttgtaatatctttgtcttgttttgctttagggtaatgttggcgtcattaacagaattgagaaatattactttctccttaattttctgaatgagattatgtggaattgctattaattctttcttaaatattttctagaatttaccagggaaacaatctaggtttggagttttctttgttgaaggtttttaactatgtattcaatttatttaatatatgtagactatccaagttacacatttcttcttgagtgacttttgttagtctgtatctttaaaggaattggtccatttcatctaagttattagactttgtgtctgtagagtctgtagtgatatcctctcttttattcttaatattagtaagttgcatctcctctctctgtttgtcagtctggctagatgcttaacagttttgttgatccttttaaaaacacagcttttgtgttttatttttctctatagattttctgtttcaaattttattctattctattcttctatctatatcatttctttctttctttgggtctattccatgcttgggggtgaacctggaacctgtgtcaatttataatacagagctaggggatcttctgcttcacttctcttttccctgggacttttttttcatagtctctcgtcccaaatagttcccttttcttcattcctctgaccagaaacatggatttctccccttaaactcttgtacatttcagagtgattatctgcctttggggtggaagcacaagagtaaatagggaagaaaaaattatgaagatttcatgcacactcttcagcccacagggacccatttttctggttcctctggagaggcaggtttttctcttggggttttacctacccatgctacttgctgctgtcaccaccacatcaacacgattttatgactgggaacattcttagagcaggacttgggagaaaaaaaggagggagaaataaaccagttacttcccctgcaacttccagttcatagggggccccctttttggatctctggccagaaataggagtttctatcagagttcttactgtgcatgatcactacattgttctccagcacaggccactaagcttatcctcagtaaaccagaaaacttagtggttctggccattcttcaagtttttacttccttattatctgcctgcagttgtttacttttcagaatcctcagacagttgctttttattctgtctgaaactcttcggctgtagtaagtagagggagtggtttctagtggatttaccccatcttgatcagtactgcaagttctcatcatcaaatactataagcaaaattttgctcagaagaacagatgcttctggaagttgggattagaataatagtagattcagaatttgggggatatttgaagtgagaataccaaaccataaaaaaaagtatctgtctcctcaccaaaaggagatcagaggtattttcagagtctcagcaaagttgaaaggtgtttagtcttcattatggttgaatttcaactgcctttttcctgtgtgtctgtgatagtcatcatgccttttactcactcaaatcacagacaaaacattccatagctgaaataagcaagtctgctgtttcatgtggttaactgcttttctattatctattacagctcttgagtgaggttacagggtaatagggcagaatgaagacatgcgtgcgagcacacatacacaaacacaggagatggaaaggctttgctataaaaccccttctttgactattactcacttttgttttgtgcattaaaatagaaatagaaatgtcataattttccccatagtatttgtatctgtgaataaacagtgccacatattactccactacttatttgaatactagagatgttaatcaaccctgttttcttatattttaaatcaactctaggattgtaaaaatcaaacatctctagatactttataagattttaaacctcaagtctatatatcctgaaaaatagtacatgtgagttatttcagaggatcttttaactctatcttctttggtatttgtagatctatttttgtgtattcctcagaaatattcatatttctgattcattcatgatgtagttatagctcattgtataaatgaataactttataaatatagccacaggccctgctgtattcattcaacaaatattaattgtgccaagaacaatgctaattgcaagaattggagcagtaaacaaaaacaatgcatgtagtggataattgggcactctgcctaattttactcatcaacagattttaagctccagataatttcaaagataataataccctgttaattcttatctcagaatagcagatgattaatttgttgctttacatatctgtagccacatattcactctgctgaccttctaaagactaagaagtcctcttctaaaatgtcctgaatttttgaaacaaaagccatgaacaatacataaataaagttatcttactagtacaaagaaaggaaggaattgaacatgggatctagtgaaggatggaaggaaagagaagaggaaagaaaaggagcatcttttcttcccttcactatgcactttaatgcatataaaagcgctggtgctccgaacaattaatatatacatgtgtaacaatgaaaataaatgctagattttacattaatgtatgtctgctgctgtttatttagcatttcatattgaatttggtgtttggtaggggtcataagaaaaatagagtggaatttctcctcatgcaatacattttattaagagtgctaggaacttttttgaatgtaagtattatttatctggaagatctcgcatcatttttttatggttaatagagttttctaatataatatttattttaaaccccggaaattcagagaatatcattattctgataattctgttctcttatcctgtttctttacctaactctaaacacaagttgttggtcttccagaactgagtcagtcaactgtgcacttgtattttggtgttgcttgaaagagagtatcttacgctattatcataattgctatctttccatttaataaaggtctccttttatctgaaaagattttctttaatagttaaaagctttcttgcattaatatctcaaaacagaggaattccatataaaacaatactcattatgctttagctaatccctttggagaacttggttactgaagaactgagatgatctcattaaaagttggtggcatttattagacaaccccaaagggtggcttcccaaagcagcattataaaatgatcttaatgtaaccagaatattcttttaataaatattctgctttttttcctatctgatcactgctgtcatttatttttctttttgcacttcaatattctaaatgccatatgttattttctaaatcttacaggagagaaaaatgtatcttctaaacagttttttgttttacatgagcagataatatttgttttttaaaaaagccaccctccaaaaatataatgtaaaacttttgattagaaactctttctgaaaataacagctttattgagatttagttatatattataaagttcaccattttaaagtgtacaatccagtgagtttaatttattaagttagacacccatcatcactatctaattccagaacatgttatatcaccccaaaaagaaacatcataaaccattagcagttctccattctacttcccctcaacccctggcaaatgctactctagtctactctacttttaatgccaaaaccgcaattacttttgcaccaaccctattttggatacctcatatatatgaaatcatacaatatatggtctgttgtgactggcttctttttttttattgatacataatatttgtacatatatagagagagtacatgtgatactttgttgcatgcatagaaggtgtacttaggatatccatcaccttgagaatttatcatttctacatgtcaggaacatttcaagtcttctgttctagttattttgaaatatacaacacattgctgttaccttcttctgtcaaacattagaatttattccttctatttaattgtatgtttgtacctattaaccaacctgtcttcatcctccagcgcccccccacacatccttcccagtctctggtatctaggattctactctctacctttatgagatccactttttttagttcctacatatgaatgaaaacatggaatatttgtctttccatgcctggcttatttcacttaacataaggacctccaattccatccacgttgttaaaaatgacatgattttattgttttgtatggccaaatagtattccattatatataccatatagaccaaattttctttattcatttatccattggtggacacttaaaatgattccatatctttgatgttgtgaatagtgctgcagtaaacatggggtacaggtatccctttgatatactgatgttttttcccttgcgtaaatacccaggaatggaattgctggattgtatagtagttgcatttttagttttttgaaaaattgccatacacatttgcatagtagctgcactactttacatccccaccaatggtgtataagaattctcttttccctgcatccttgtcagcatcggttattttttgtctttttaataatacctgtgggctgggtgcagtggctcatacctgtaatcccagtactttgggaggccgaggcaggtggatcacgaggtcaggatcaagaccagcctggccaacacagtgaaactccttctctactaaaaatacaaaaattagccaggcatgatggcgcgtgcctgtagtcccagctattagggaggctgaggcagaagaatctcttgaacccaggaggcggaggttgcagtaagccgagatcacaccactgcactccagccggggcagcagagcaagactgtgtctcaaaaagtaacaatagccatgataactggggtaggatgatagctcattgtggtttttatttgtatttccctgatgattagtgatgttgaacattttttcatacatcagttgaccatttgtatgttttcttttgagaaatgcctattcatgtcctttgcccactttttaatgggattgtttattactattaaattgtttgagttccttgtatattctggatattagtcccttgtcatatgaatagtttgcaaatatttttcctattcaacaggttgttctataactctgttaattgtttcctctgctgatcagaagcttcttggtttaatatagtaccgtttgttgattttttattttgttggctgtgcctttgagatcttagccataatatctttccctagaccagtgtcttcaagtgtttcccctatgtattcttctagtaattttatagttttgggtgttatgtttaagtctttaatccatctaaagtttatttttcaatttgatgagagataggagtccattttattcttctgcatatgggtgtccaattttcccagcaccatttattgaagaggatgtccttttcccagtataggttcttgacctctttgtcaaaaatcagttggctatatatacatagatttatttctgggtcctctattctgttccgttggtctgcgcatctgtttttatgccaatataatgctgttttggttagcagagacttgaaatatatttcgaaatctaatagtgtgatgcctcccgctttgttttttgtgttcagggttgctttggttattcaggctcttttttggttccatacaaattttttctatttctgtgaaaaattacattggtattttgacagagattgcactgaatctgtaagttgctttgggtagtatcttcattttaatgatattaattcttctgatccacgagcatagatgcctttccatttgtttgtgatttcttcagtttctttcatcagtgtttggtagctttccttgtagtggtctttcaattccttggttaaattttttcctaggttgttggtgtttgtttgttttttttttgttatcgctgttttgggtttgtttgtttgtttttgtaattcttgtaaatgggattgcattcttgatttcattctcggttagttcatcattggtgtatagaaacgctactgctttttgtatgttttatgtatcctgcaactttgctgaatttattaggtgtaagaattttggtggagtctttaggtttttctagatataagatgatgttctctgaagaaaaggacaacttgacttcctcattttcaatttggatgcatttgagttctttctcatacctgattgctgtgactaggacttccagtactatgttgaatagaagtggtgaaagtatgcatccttgtcttgttctagttcttttagaaaaggctttcaactcttttccatttagtataatgttaactatgtgtttgttatatatggcctttattatattttgtggtatgtttccttctatgcctagtttgttgatagttttttatcatgaagcaatgttgaatcttatcaaatgctttttctgcatttattgagtgatcatacagtttttgtccttcattctattgatgtaatatgtcaggtttattgagttacatatgtggagacattcttacatccctgagatgaaccccacttgttcatggtgtattatctttttgatgtgctgttgaattcagtttgttagtattttgttgaggatttttgcgtctgtgtctatcagggatattagcctgtagttttcttttttgttgttgtgtctttgtctggtttttgtatcagggtaattttggctttgtagaatgaattagagaaaatttcttctctcctcaactttttagaattgtttgagaagaattggtgttctttggaagtttggtagaatttgacaatgaagccatttggccctaggcttttctttattgagaagttatttattaccaagtcaatctcattacttcttgttggtctgttcagcctttctatttcttcttgattaagtctaagtagattgcatgtgtctaggaatttatatatttcccctgggttttccagtttatttgtgtatagttgttcataatagtctctgatgaccttctccatttctgtggtatcagttgtaatataatgggcattctggaacatgctgtttcatttacatatatttgtacaatttccaaagtttctctagttactgagttttagtggtctgagcagatacttgttatgattttgatttttaaaagtctgttgagatttgttttatgtctttttttaaattatactttaagttctgggatacatgtgcagaacatgcagttttgttacgtaggtatacatggaaccatgttggtttgctgcacccatcaccccatcatccacattagctatttctcctaatgctatgcctccccttccctgccacaacccccggacaggcccgggtgtgatgttcccctccctgtgcccgtattttctcattgttcaactcctacctatgaatgagaacatgcagtgtttggttttctgtttcagtgttagtttgctgagaatgatggcttccagattcatgcatatccctgcaaaggacatgaactcattcttttttatggctgtatagtattccatggtttatatgtgccacattttctttatccagtctaacattgatcggcatttgggttggttccaagtctttgctattgtgaatagtgcatgtgcatacgtgtgcatgtgtctatatagcagaatgatttataatcctttgggtatatacccagtaatgggattgctaggtcaaatggtatttctagttctagatccttgaggaattgcctcattgtcttccacaatggttgaactaatttacactcccaccaacagtgtaaaaactttcctatttctccacatcctctccagcatctgttgtttcctgactttttaatgatcaccactttaactggcgtgagatggtatctcattgtggttttgatttgcatttctctaatgaccagtggatgagcttcttttcatatgttttttggccacataaatgtcttcttttcaaaagcatctgttcatatccttcccccacttttcaatgaggtttttttttcttgtaaatttgtttaagttccttgtagattctggatattagccctttgtcagatggatagatagcaaaaattttctcccattctgtaggttgcctgttcactctgatggtagtttattttgccgtgcagaaactctttagtttaattagatcccatttggaaattttggcttttgttgacattgcttttggtgttttggtcatgaagtctttgcccatgcctatgttctgaacggtattgcctaggttttcttctaggatttttagggttttaggtcttgtgtttaaatctttaatccatcttgagttaatctttgtataaggtgaaaggaaggggtccagtctcagttttctgcatatgactagccagttttccccataccatttattaaatagggaatccttttcccattgcttttttttctgtcaggttcatcaaagatcagatggttgtagatgtgtggcgttatttctgagggctctgttctgttccattggtctatatatctgttttggtaccagtaccatgctgttttggttattgtagccttgtaatatagtttgaagtgaagtagcatgatgcctccagctttgttctttttgcttaagattgtgttggctatatgggctcttttttggttccatatgaaatttaaagaagttttttccaattttatgaagaaagtcaatggtactttgatgagaatagcattgaatctatcaattactttgggcagtatggccattttcacaattttgatttttcctatccatgagcatggaatgtttttccatttgtttgtgtcctctcttattttcttgagcagtggtttgtagttctccttgaagaggtccttcacatcccctgtaagttgtatttctaggtatttttttctctttgtagcaattgtgaatgggaattcactcatggtttggctccctgtttgtctataattggtgtataggagtgcttgtgatttttgcagatcgattttttatcctgagactttgctgaagttacttatcagcttaaggagttcttgggctgagatcatggggttttctaaatatacaatcatgtcatctgaaaacagagataatttgacttcctctcttcctgtttgaataccctttatttcttcctcttgcctgattgccctgaccagaactttcaatactgtgttgaataggagtggtgagagaggacatccttgtcttgtgctggttttcaaagggaatggttccagcttatgcccattcagtgtgatattggctgtgggtttgtcatcaatagctcttattattttgaggtatgtttcattaatacctagtttattgagtgtttttagcctgaaggggtgttgaattttatcaaagaccttttctgcatctgttgagataatcatgtgagttttgtcattggttctgtttatatgatggattacatttactgatttgtgtatgttgaaacagccttgcatcccatggatgaagctgacttggtcgtggtggataagctttttaatgtgcttctagaatcggtttgccagtattttattgaggatttttcccttcgatgttcatcagggatattggcctgaaattttgtttttctgttgtgtctctttcaggttttggtatcaggatgatgctggcctcataaaatgagtcagggaggagtctttctttttctattgtttgaaatagttttaaaaggaatggtaccagctcctctttgtacctctggtagaattcagctgtgaatccatctgttcctgggctctttttaattgataggctattaattactgcctcaatttcagaacttgttattagtctgttcaggtatttgacttcttcctggtttagtcttggaaaggtgtatgtgtccaggaatctatccatttcttctagattttctagtttatttatgtaaaagtgtttctagtattctctgatagtagtttgtgtttctgtgggatcagtggtgatatcccctttatcattttttattgtgtctattcgattcttctccttttcttctttattagtctggctagcagtctatttttttaatctttccaataaaccagctcctgaattcattgatttttttttttttttgaagagtttgtgtctttatctccttcaattctgctctgatcttagttgtttcttgtcttctgctagcttttaaatgtgttaactcttgcttccctagttcttttaattgtgatgttagggtgtcaattttagatctttcccgccttctcctgtgggtatttagtgttacaaatttccctctaaacactgctttagctgtgtctaagagattcttgtacattgtgtctttgttctcattggtttcaaagaacttatttatttctgccttcattttgttgtttacccagtagtcactcaggagcaggttgttcagttttcatgtggttgtgagattttgagtgagtttcttaatcctgagttctaatttgattacactgtggtctgagagagtgtttgttatgatttctcttcttttgcatttgctgaggcatgttttacttccaattatgtggtcgattttagtataagtgctatgtagtgctgagaagcatgtatattgtgttgatttggggtggagagttctgttgatgtctattaggtcttcttggtccagagctgagttcaagtcccaaatatccttgttaattttctgtctcaatctaatattgacagtgtggtgttaaagtctcccactgttattgtgtgggagtcaaagtctctttgtagatctctaagaacttgctttatgaatctgggtgctcccgtattgggtgcatatatatttagaatagttagctcttcttgttgcattgattcctttagcattgtgtaatgcctttctttgtctcttttgatctttgttggtttaaagtctattttaagagagactaagattgcaactcctgttttttttgctttccatttgcttggtaaatcttcctccatccctttattttgagtctatgagtatctttaagtgtgagatgggtctcctgaatacaccacacagatgggttttgatctttatccaatttgccaatttgtgccttttaattggggcatttagcctgtttacatttaaggtttatattgttttgtgtgagactgatcctgtcattatgatgctatctggttattttgcccattagttgatgcactatcttcatagtgttgatggcctttacattttggtttatttttgcagtggctggtaccggtttttcctttccacatttagtgtttccttaaggagctcttgtaaggcaggcctggtggtgacaaaatccttcagcatttgcttgtctgtaaaggatttagttcttcttcacttatgaagcttagtttggctggatatgaaattctggattgaaaatttttttatttaagaatgttgaatattggcccccactctcttcttgcttgtagggtttctgaagagagatctgctgttagtctgataggcttccctttgtgggtaacctgacctttctctctgactgcccttaacatttttttccttcatttcaatcttggtgaatctgacgatgatgtgtcttggggttgctcttctcgaggagatactcttgaggagtatctttatggtgttctctgtatttcctgaatttgaatgttggcctgtcttgctgggtcagggaagttctcctggataatatcctgaagtgtgttttccaacttaattccattttcctcatcactttcagttataccaatcaaacgtgggtttggtcttttcacaaagtcctatatttcttggaggctttgttcatccctttccattcttttttctctaatcttgtcttcatgctttatttctttaagttgatcttcaatctctgatatcctgtcttatgcttgatcgatttggctattgatagttgtgtatgcttcacaaagttcttgtgctgtgtttttcagctccatcaggtcatgtatgttcttctctaaactagttattccagttagcagtacttctaacattttttcaaggttcttagcttccttgcattggattagaacatgctcctttagcacggaggagtttgttattacccatcttctgaagcctaattctgtcaatttgtcaaactcattctccatccagttttattcccttgctggcgaggagttgtgatcctttggaggagaagaggtattctggtttttggaattttccgcctttttgtgcttgtttttcctcaccttcttggatttacctacctttggtctttgctcttgatcttcggatggagtttttgcatggttgtcctttttgttgatattgttgctattcctttctgtttgttagttttccttctatcagtcaggccccttttctgcaggtctgctggagtttgctggggttccactccagatcctgtttgcctgggtatcaccagtggaggctgcagaagagcaaatattgctgtgtgctcctccctctggaagtttggtcccaaaggggtgcctgccagatgcccactagagctctcttctaagaggtgtctgttgaaccctgctgggaagtgtctccccatcaggaggcacagggtttggagacccacttgaggacgcagtctgtcccttagcagagctcaagccctgtgctgggagatccactgctctctttacagccagcaagcagaaacgtttaagtctgctggagctgcacccacagctgccccttccctcaggtgctctgtcccagggagaggggagtttcatctataagcccctgactagggctgctgcctttctttcagagatgccctgcccagagaggaggaatctagacaggcggtctggctacagcagctttgtggagctgcagtgggctccgcccagtcagaactagctgggagcttcatttacactgcgaggggaaaatcgcctactcatgcctcagtaatggcagatgcccttcccccaccaagcttgagcatcccaggtcgattttagagttctgtgctagcagcaagatattcaagccagtgggtcttagcttgctgggctctgtgggactgggatccactgagcatgaccactagtatcactgtcttcagccccttttccaggggaatgaactgttctgtcttgctggtgttccaggtgccactgggatacaaacaaaaactctggcatctggttcggtgtctgtccaaacggccacccagtttagtgcttgaaactcggggcccatgtggtgtaggcacacaagggaatctcctggtctgtgggttgtgaagaccctgggaaaagcctagtatctgggccaaatagctccatccctcatggcgtggtccctcacagattcccttgtcgaggggagggagttccctcaccccttgaacttcccaagtgaggcaatgccccaccctgcttctgctcatcctccatgggctgcacccactgtctaaccaatcccaatgacatgaaccaggtacctcagttggaaatgcagaaatcacccgccttctgcgttggcctggctgggagctgcagatgggagctgttcctatttggccatcttgcccgggaatcattttatgtcttaacatatctattctgaagaatgttccaagtactgattagagggaatgtgtatactgtagctgttgggtgaaatgttctgtaaattaatgttagatccattagtctaaagtgcagtttaaatctagtatttctttgttagttttctgtctagatgatctgcttaatgctgagagtggagtgttgaagtccccaactattattgtattggaattcctcttcctttaaatctaatatttgttttatgtatctggatgctctggtgtcggatgaatatatggttcaggatttttatttcctcttgctggactgatccttttatcatgatataatgactttttgtgtctctttgaactgtttttgattttaatgtctgttttatgaagtatagctactcctgctcatttgtggttttcatattcatccaatatcttttttcatccctttactttcaatctatatgtctttaaggtgaggtgagtttcttgtaagcagcatataggtggatcatgtttttaaaattcatttagccactctatcctttaagtgaaaagtttaatctgtttacattcaagattattattgatatgggagggcttactcctattattttattaattgagctattgttattttgaatattctttgtttctttctctcctgtttatcattgtgttttgttttctgtagttgtaaccattggaccctttcctttccttatggtgtgtttgctctaccagtgttttttatacttttgtgagttttcatgatggtagatagtatctttttgtttccaggtgtaggactcccttaaagcattttttacaggacaatactagtggtgatgaattccttcagcttttgcttgtttgagaaatactttatttgtcctccttttataaaggataattttgctggatccttggctggcaattttttctttcagtatttaaaatgtatcattctgttatctcctggcttgtaagatgtctactgcttatatgtctactgttagtctggttggggttcccttataagtcattagattctttatcttgctgttgtttgaattctctttgtctttcacttttgacagttgggctacactctgccatgaataagagttttttaattatatctttttgaaagtctttgagctttctgtatcttaatatctaaatttcttgctagacttaggaagttttcagctattattttgttaaataggttttctgtgtctttcattttctctttgcctgatgggacactggaaattcaaatatttggtcactttatggcatcctatacattatgtgggcattcttcattcttttttattcttttttaaaatttttatctggtttatttcagacaacctgtcttcaagttccgaaattcttttttctccttgatctagtctgttattaaagcttttgaatgtattttgtatggcatttggtgaatctttggtttcagaatttgtttggttctttattatgatatctgtctcttaataaatttcttacttatatccttgattatttttctgatttctttgtattgttcatttgtgttctcttatatcccactgaactttttaatatcattaatttgaattcgttttccagaatgtcataaatttattttgcattgaaatctgttgctggaaaattgttgtgatcctttggaggtttcatatatccctgctttttttgtttcttgtgtccttacattgatatctgtacctctgatataatagttgcttctttcaattttttttaatttgcttttgtagaggaggttttcctgaagaggtatccatgatgttggttgggtaggtcacttcagctttgattctgggtatgcagtagtgtagtctctgtatgatttttttttttttttttttttggctgtaaacaacatcagtagtgtctgtgatttcctttcttagttacatagggtatggttgttagtggaggctgtgatgaagtttttcagggatggggatgtcaggtaagtcaggtaagtcagtcctggggccccagtggtagcagcagcaggctgtgtgttcctgttttggggccccagggcggcatatgcttgcagcactattgccaggtcctgttgggccaattattgggtcaccaggtggctttctctggtgctgatagtaacagtggtgggctcggtgggtgggaagatcttcaggcccctgggcatcagaaattgcttgattaatggcagtagcagtggtaggacaaccctctgactcccagggagtccacactggtgctggtggtggctgtgacaggatgaacagatcagtactcaggcctgcaggtggcatgtacaggtggtgccagctgtagtagtaacagcaggttggatgggcttgttctcaggcccctgtgagggatgccaacaatggtggatggggcagggtgatccccaggcatgcttgtgcatggatgatgcagggccagcctgtgtgggtctatcctcaggctccatgtgatgtgtgcaggcactggctagggtagacagggatagggtaattcccaggaccccagatgaatgcttgggtgggggcagcagtggttgtgctgcagtcctactactgaggagggcaaagttgttttcagtggcagcaaccataaacaggcagctggggaatgaacacattggtctcagttggtggcttcgggcaggatagcatctcatggcacttgtagatgtgtggtgtccccactactggggattgtggggtcactgacagtggctcatgattcacgcctggtggcagcagccagaagtggcacctggctgtgggcaagggatgtcaattgggcttcagaaatgtggagatgaagaggctgttggaccccagggtaggatgcagtctggtaggggctgggctctcaaagtggcaccttgctatagctgcttaggacttggcggctgtatggaatccagtgtgaattcccttcctcaagcaatgctgtcatgtgatcttcaggcagctccctgtgttagtctcaggactcacaagggttaagagactccacagtggctaagactgcaggagtctgtggtgggaatctgtagcaattgggtgttgttcacttacccttttcccacagttgggaacctctacaggcttccagttgatcccagcagagcatgttaccttgcttttctccctttcattgccttaggtgtttcctgttacttctctactgaaagtgttctctgttaggtgttccattgtctgcttgctgtttaggttcttttttgtggaggagtgagtaccacattcctctattcagccaccttgaatatgcattcttgactggcttctttaacatatgtcaatatattcaaggtcatccatattgtagcatgcattactacttcattcattttattataatattatattttatagatatagaatgttatatgtatccattctttacaagatgggcatttggattgtttctactttttggcttttatgaataatgctgctataaatatttgtgtacaagttttttcatggacatatgttttcaattttcttgggtatatacccaagagtggaattgttgggccatatggtagctgtatgtttaactttttaaggtcctttcaaactattttccaaagtaataaattttacattcttgttagcagtgtgtgagcattctaatttctccatatcctctccaaaagttgtccattttgtaattatatccatcctagtgtgtgtgaaatgacattttattgtggttttggttggcattttcctaatgactaatgatgttggacaggttttcatgtgcctattggctatttgcatatcttctcttgagaaaagtctattcaaatacttagcccattttttaattggggtatttgtctttttgttgctgagttgtaagaattttttatacatcttgaatgaagaccttttatcagacgtatgattcgcaaatacttcttttcatcttttgggttgtctttttgttttcttggtgatgtcatttgaagtacaaatgttttcaattttgaaaaagtgcaatttatcaaatttgtctttgcttgtgtttttggtgccatatttaggaaatcattgcctaaccaaaagtcacagaaatttatgcctgtgtttttttctaacagttttctagttttagctcttatatttaagtctgaataggttttgagttaatttttgtatatgatgtgagataggggtctaatcttactcttttacatgtgaatacacagttgtcccagcaccatttgttaaaaagattattctttactaccattaaattttcttgccacccttgtcaaaatcatttgaacagaggtataagtgcttacttctggactacacatctatttctttgatctatatgtctattcttagcccactgtcttgattattatagctttatagtaaatttgaaattgagaagtgtgtgtcccccagctatgttcttctttttgaagattgttttggctatttggggacctttgcaattatatataaattttaggatcagcttgtcaatttctgtaaaaaaaccagctaggattttgataggggttgtattgaatctgtagatcaattaggtaaatattgtcatgtaatgatattgtcttccagtccatgaacatggtatatctttccatttatttaggtcttctttaacttctttcagtaatgttctgtagttttcagtgaacaagccttgcacttcttttgctaagcttattccgaactattttattgttttggttgctattacagtcaggattgtttcattttcttatattttcagatatttctttgccagtttatagaactacaattggcttttgtatattgatcttgtattctgccaccttgctgaacatatttattacttctaataaatttttttgtggaaggactgcttcaaatttatctatatccccttttaactcttctccaggagaacagtagcatccagtctaattgatgaaagcccaacacacaaagtgtgagtcatgacttatggatcttcttttatctggcaccgtggcttttactttcccttctcttcagcttctaggtcccatttgttgagcccaactgagcagagtctctatgaaggggagggtaatatgcactctctccctctctgtaccaatttatgtgtctgtgactaagtatgtaagttaagctgaactgtcttcataggcactaggattcacaaatcttgattacatgtgggaggtagatgatagaaggtttaattatcccatttgcctaatttttaatctgctttctagtcctgtcaactactagtactaccaaagagttctggatttgggtggaaaataggtacttgtaattgctaacaaagctgacactttgatacacatgtgtttttttattctattctctatcaaaacctgaaggaaaggagggctgagttgtacatccgtattttgcctatcttaaaagaatagttttacataaccagcatcaacaagaaaattttactattctgggaaattccatctactttacttaactttattttgaaatacatagagactctatggtgtgtctgcccacccaattaccctgaaggatctataaaatattcaaagaaatagttaatgtccacatactaggttttctagagcagcaaaccactttatgcactaggagggtccccagacataatttatatattgcctgggtatagataatactgaattttcaaaggtaatagaaaggaagagtagaggggagaaaatggacagatgaataaacaactcaagaaagaagaaaataaaattaatttctagaataaatacagcaggtcaggataatagtcaaaagctatagctcaccacaagagatgatttatctattcatttgtatatgagttatcagttgtcaataaggctataaaggttacattatttgaagcgtactaaaagacccctttcttttccatcgagccctagtggtccctcaaattgcttgtatttctggaaccgcacctttagcttaaaacgataacttgtgagaacctctaatagacacaaatgttagttagaagggctaggatatcggtagggaactgtgtcctaaaagaataaaaggatatcattgtagttcatgcataaggggttcatatacagtgctttctagtaattggctacaaaatctaggaaaagtaatattttgagattgaaaaatcaacccataataaatggacttaaccaatacagaccaatctgtctaagagaagagttgaaataaaatgtcaaccctttcaattgcttgacataacttcatgagacatgtaatacatcatggaataaggagtttaatattaaaaatttgtcagtgtttcctattatccgaaagagagctgtgtgttccttatggacttcaagattatttcctgtctttatttactttccatgtccccattattgagaaacagttgaaaaagatttacttctctacataggtagcttttcctcttaatttagtcttggagtttctgtattactaattgatttcttgaaagttgagtgaactttagtcacctagagcctcatcatctctaaatgaactaatagcattccactcttgcttttacatagctgaaaaatgcatcaagaataatggaactcacactgaaacaatatcattattgggacactaccttagcagccaaatggtttttctttctctgacagttttccttaacggtatcacttacagctggggggtcggggggtgctattgaaatcatgcctaaaatatttaaaatcaaggcaaggccttgtgggtgttgcagtgagaaggaaggagagggagggtgctggatgacttggtcggtcagagactgtatcacaaaaaactgggtccaaagggggagataaaagaaaatgaaataggataaagaagaagacagtgtgatgatatttggacggatataaaactgtctttgactctgccattaccttggacaacttacatgttgctatcatgcttggtgttcttgtgtttggattgagaatattattgaggcactaccttagcagccaactggtttttccttctctgacagtttggactttttagggataatccagcacagtacctgacacctacgacattctcaaaaaatattagcattcttgtattcctttctgtgtctaaactaggggctgctcccaatattggccaaacatcaggcttactgaccagtttaaatttggatttggctttagggtaacactcacacatttctttactaggcatgagcatcagatgaatgtctacttagttctctcatgcagtcttcccccaccttcacagacacagtagtagatcaacacaaatatgaattttttctggagatcagatcctggatatttaatctgtttttggaacataaagtgggtccttagatcacagccaccccagcagtgactagcggtaagtgatcacagtttgttctttttgatgaaaacaatttccctcataccttgaacatcattatgaattcatgaggctctgttattatctgctttgtgtcacttttgtgaatttcctcctctgccttctccatccctcagaaagggtacaattacaaattcagaaaacaattgagcttcgagtttgaagcatttcacccttggcaactagaatctttaatcattatgcacactgtaagtgaaaaaataaaagctaatactttatcttggtgaacaagagtcagtacttgccgtgtagatgtctcaaagtactgataatataggtgaaaaacaaactgtaattttagtctttgattgtagagagactttgcgttatattagagtggtttatgcagtacagttttgtggaccttttagtcgagttgctcaagtccaaagacaactggaacctcttctcccttaatgtataatttttgaaaacaatagttttaaaaaaatgatcatttttatacccttgagtcaagtgtgtatgcttgtgaatgtacttgttaattactttacgtctgtttatttatatttattaatatgaaatgctttaataatgtttatttcccacaggtttactgatttttcagtgagatttcttaaaagtgaccttttccctcttaactatgattatttgtaaccatctcttaatgtatcatatcatgtaaatgtctgtttgacaatatttctatgtaggaatgatgtcacacattgaacaaatctccaataccttaattacttcaacaggtgaatgaaaatatatgcccatttaaacaagctgtgttgctgctgctgttgttcaaaaatattcaacacctattgtatactcgtcattgcactgttatagaagcagatgaaccaatattccactgaaaagatacggccccttcctgccattaagaaaattttaatctccatcagagaaaggaattaaacatacatatgtgaagaatctgaagaacacactgttacctttacttatctcctttttctcatattgctccctcaatctagaaaatctatttacctttattctttcactcttgttgacataatgtcctagaatgcaagagaagcaataagggaaacatatataagcattaagaagtagttaaataaataagaagaaattgattgaagagagagatcctttaaaggatgtccatgttgttttaaaaattcttatgaaaacaaaaccctgtgctgcaaagtagcccataatcaaacgtataaccatgagttcagaatttttatttgagcaaatataagtagaaatgtatgaccaaaactcaaaggacagtcttgtcataaaggatggaagggtgtcataaatgaaattctacgtaatcagtggagcagaaaagataaaggaaactcaagaaaccaatttggctacatatagagttctttggcaaacgtgtataatgatgaaagatgttaaagtatggaaaaaaaaaataagaatatccaagaatgtgaagataagaggtggcacagcatattttttagaggtcgtgaaggatagtttatggagttctgtctcagcgtcttctcattgaacatcatcaagaacttggaagagaacattagctttgtgcttgacatgcttgcccaaaatatcatacgataaggactatcctaaaagctcctgacagcctcagaaaagggttagattttaccaagggaaatgtaagctcatcaatgtagagttatgcacacatttaaagaacatctgcccctgaatgaaatagggaatgaacttaccagcaacacatatgatggttgacagtaagttcagcatgactcagtaatgtggtatgtctgcttggtgacttaatttgatgcttgaatgcagatcaaagattgtgctgatgaaccacacttggaggagtgtgctccattccgggtaccacatcttaaggggcatgttggccaactggactgtgtccagcacagaggagtgagagtagaatgaaaagggaattgcaaacagccttgcagaaaaacacgtatgaacagggcatttagcctagagaagaggagatactcatagagatgtaataattgtcttcagattctggaagggctgatctctggaaaagtgattatgattgatctctgtgtctaggagaagaaaaccaggacagaagagttggaactagggtggggcaggttttggatgaataatgagatataacatctaaaatagtccagatatggagtcagtttcatcaggagatctgtcttgttaatgatgtttaaatggaaagccctgtgtccaagttcgtccaagtcctgcggtctacctgatgcctccgctccttcctaggctctatctgctctctatttacagagtcttccaagacctcccttttccactcaacttctcttcatctattttattccccttctatctcttccaggctccttatttcttcccaaaccttctaagccctctttgttacctagtcctttaaaacaccccaaataccatccgacattctcagcctgaaaaactcaacctttctcatcaaagcacaaatcatgtgtctactcatgaagttagttgagccccttcatcatttgtatttccacagcactctcttcctgccatagcaatggcatttactgacttacgttgtaatgatccatttgtgtacatctcccttataatgaagttaggaatcctgacttcatcattgtgttgtcctcagctttaaggcagtgccacagaatacatgaataaaggttgacgaatagctggcagaggcatggtagaaaggattggggcatcagattgaacttaggactgaggaacctctgaggttcccttgaactcagtaattccatgtttctatgtggcactacctctaaagatgatttccatatggggagctccaaaaacatttaaaggaatggtaaacttattacacaagtagctaatcaccccaaagtgatgattttgaatggtcagcactcttctgtgatagttgtatgttgttttatggtcgcaattgatattgtaaagtaggcagaatgcaggattcctcagggaaatgttaatcagaatagaagctgctgggaggtttgcttgatgaaatgattctgataacatgatctagcaagggtaaagaattagtcaacaccttgaaattctgactgtttgtggtcctcagcccaggggagtaccaaccctgaagtgggcatttggaatgtatagtggttttggttgtcatggtgtcttggtctgttttctgttgctgtaataaaatacttaagactgaataatttataaaggaaagaggttgatttagttcatggttctggaggctgggaagtctaagatgagcagctgcatctcctggcttctggagagggctttatgctacctcataacacaggagaagcagaaggttaagcagcaggcacctgcaaaagacaccaaacaggagcggcagcctcactttaacacaactctctcttgcaataattaattcagtcttaatagaggtccctgaatgtattctcaagagaaaggcataaacctctcttaaggacccaaattcctctcaaaggcactaactttcaacaccaccacactggggaccaaacctcagcctgagttttgctggggacaaaccatagtatatggtgtctgagactgcttctgatattagtaggcaggaaccaggaatgtgaacatacttcagtatgagaaacagtacagcaaccaaagaactgtctcattcaaaatgacaataacacacctctcaagaaacactatttaataatatagtaaatagatatggtaaagtagagcaaatccactgtggaagagacatctcgtttccaccaatgattagcattccctttccataatagggagtttttgctgtgaagtggctgctcagacagagactggatctcccagcattcttcatatttggatgtagccatgtgtctgagttctatctggccaatgatatgtaggcaaaagtatttatgtacttttgtaaatgtaaaaaatgtaagaaaaatatttattgggtctcatgtatcacttgttgacctggtgaataaaaatcttctgtataattctccattctctcttccctttatactagctggatgtcaatgtccaaggtaacctaggaacctacctttagcctaggtccctgaatgactgcctacagcagagcattgcagttcttcctcccatctactgactggacttcacatgagcaaaaagtaaacttccattgtgtgaagctaatgaagtttcgggtttatccgttacagcagctagtatgagtataactaattcatacatttttaaataaatgcatcagttaggcaaatttctacatataaataatattgaaaatgttaaagcatttctgagtttttcttcagcaaaacccattttattttatgcatgacccaaagtcatcttcttcctcagtaaagtcagagctcttggtatctgtcattgcttcccaaataagtcaagagatttgagcttctttcctggacaagattagggaaggttttctttctcaggctttgtctctttggcattcatggaggggaggggggcagtcagtgtggagccaacttctcagccagccttttactctcctcagtttgtttttgaaacgtttttcccctttctccttcccccatggtgtgagttcgtgtgtggctggttttcttgggcacaaggcccagatgagtttcagctttgtttgttgtttgtactgactctgttctgagatcagcctctgatacccggtgggcagtgttccctggaatagggcaccctggttgtattcctttaagcctggttggaagacagtgagtgcaagaacaccagggttttgcaaggctttgttcatagacaagaaagctgcagtattttgtatagaataagaaatacatatatatgtggttttggaacctccatgttctgttttaagccaataaagaattcctaaaagagaactgtcccagattgtgttagcctaccatgcatacaaaaaccaagcaactgaagagtttaattagttgggatttgttcatactccttattagtgagagaagacattaacaaacctccaaagggcagaagaaaatctcacacaagacagggacccactgagttcttaatcaaaaatccgagaagccatatccaaggagtagaaacaaatcagaattgagccaagtcttataaactgcaacccaaccccaacccagctcttcatcttacctgcccactagaggaaaaggggtcccatctcttttcctctagtgctcagatgagagatgtcatctgcagccgcctgtgttcagttgaagattaactttgctaatctcaatattcataccacttaattcagcctgatgtcacccattcagcctgtcactggggctgggtgaccttaggcaagttgattaactttgctgattcttgttttatctgtttaattagtatggtggcagaacgtactcattggctcacgtatggagaaaattaaataaaataggacatgagacagcaaagcttagtagttaggaaaatagcctctggagaatgttggccctaatactcactgagtaattttggacaagtcacttaacctatgtttctatttctttatctgtaaaatgaggctaagagtagtatctacctcctagggttgttgtgggaattaaatgagttaaacctttaaaaacactgggtttctggtagggagtacatgttctacatgtgttacttaaataaattgtaatatttagcacataatgaatactcaagaagtgctagttgctattgtcatcattattgtagttagatgatggtcatcatgatcaccaccataattgtcatcacatcatctaattattctctttctggaccctgctacatttgaccctatttatccttcccttcttcttgaaactctctattcccttggctcctagaacaccatacttactagttctccaggctgttttctgctcatttctcacccacctttttcatgagcatctcttttctgtagtacctgtaacatgctactgtcccctgaggttctattttcagcctatcactcttctcattctggagtgatataattcagtctatcaaatagtctatagtatcaacattatctctcatctgctggtagaggttgctcatttcagatgtcaaatccacctcatcagttcaggcttccactaattcaggttacagatgctgctatttggctggcagctgcatgtgtccatctggtcatcccagatcatcccaaaggaaagttatctttcgcctaaatgaattcttgttcctccattctgtatctcactcgagggcaccttcatctccctggtcacctactctagaaatgcagaggtcattctggattctttctttaccttcatgccttacatcccagccatcactaatgcctgcttgtcttatggggcactattcccaaaattcggtgcttcctttctcttctgactctcactaattcaatctccaccatctcccatctcaacctcttacatggacttctttctctcattctgccctctccaaacccatcctatatcctctaacatgcaatgatgttttcaaaacataaacctgacactgttactctctggattaaaggccctctggggcttccttttttaatagactaaaggccaaagaccagactccctactatgggaagctctctatgactaaacctctgcctgtctatgcagtctcatttttaaccatttcatttctcaaactgtgttcactggaccagatcaatggaacttcaccaaaaggtctttttccaaaccagaacctgtgcccagagtgagtgccctcactacacgtaatgactattctccctctaacgttcagccatgatccctcccagaagatgcgctcctccccatcactcctctcctttttcacctgcaagttaggctctatcctgtgtcgatttttcgtgtctgctataacaaattcccacaaatttagtgtctgaaaacaacacaaatttattacagttctgcatgtctgaaatctaatatggatctcattgggctaacgtcaaagcatcagcagggctcgttcctttctgttgactttggacatgatccttgtccttaaccttttccaggctctagaggccatctgcattccacgttcatggtccccttccttcatcttcaagtccagcaatggctggttgactccttctcacactatatcaatctgatctattgttctgctttcctctttcacttttgaagacgcttgtgtttaccttgtgcccacctgggaaatccaggagaatcttcctatcttaaggtcagccggttagcaagcttaattcctatatcctataatgaagcatgtttatagtttttaggaggtaggacttggacatctttggagaggatgtcattctgcctgtcacaatatctctcagtgttcctataacattctgtgcttacctctatcattccacattagtaaatattgtcataagcatttgtatgttctctctctgacttaattttgactgtcttaaggtctttctcatttttgaatccctgccttaagagtaaatagtagactttctataatataggtaattcaaatgtctagtgataacctgggacccctctagggatcagcacagaagggggattaacctgtgcccagtaatttgagttatgcatgttaatgattccatttctatgaacgtttgtcatccaatgtgatggtagtcatgtaagttgcactggtctgcttgctctagccgataataaaattatatattgtaataaaattacatattgtatatcacttatcagacctttttcttggtaccttcatgtgttaattcatttagtctttacaacagtcttctgctgtaagaacaattagtattgcccattttatgaatatggaaactgtggcatcgggcattaaataacttgcctagtgtcagacagcttagtatacagtaactctgagttaactagtctattttgccaacccaaacaatcccttctgtgaccagtctacttaaatgagaggccactatagttaatttgaaatgttgtttatttctcatgaaactcaatagtctttagcctcatgggtttaagaagagaactgagtgaattagctgactccatctgagatttttcagccagccaacctctaacacacacaggctatgggcctcaagtgtaaaaaatgagccatgtattgtctttcaaagccaccttggtctttgggaaaatccttggtcctaaccatgagtccatggatgatcattttgtcagtttgatgagagtcagtgctaggggaaggccagtgtgccagggaggaaagatggagggacgaagcacattaaatctgcagttgcttacagcatctgcctttgatgctgtctctgggggacacactgatcgcctcctcccagtcaacaaattctgtgtcttctcagcagttctgaagggggagagccctttaaggcattttgtactgacaagcgtatttctcttagagctctagaatgtaatagaagccatcaaaggcaagggatatcaggaggttgttttgcacaatggcaacagaattcatacgttttcagacgactcccatgctcatatcagcagttcaattagtggcagggtaaactaataatatatatttcccacttggggcattgttgatttttttttttaaaaaaaggttgattctgttttatcacaaacaactttgtttagaaagccaatgatatttttcactgaattcaaagctcttgctaaactgtaacctgaatggtttgtaatctaaggaggagaggaagaaagtgtgaacaacgttaaatggataccgtcatcccagtatgccttcaagaaccctggggtgaaaagggaaactggtttttctccacttaatagacatgatgggcaagatctactatttttttttatataaggcaaaggctaagacccagtctccagcaaaaccttgaacaatgccacttgaattcagtgaatttggtctttctctgttttctgttgttggatcttcaagtagcctgagaaaggtaaattgaatagctttcttaagattaacttattcttaattacttcgaagccaaaattgcatattgctttattttcagtacaattttatacaaatacctttactttttaaatatcagacactaacatttattaatttttataaagtttaaacaatataaaaacatataattatggtagaaattggcatttttcctaaactcttacccataagaatcctactaataatatgggaatataacttttcagatggtttttccttctgcatgggtgtatacacacttttctccttcttcaaaactgaaatcactgggaacatacttgtctgtaattatattcagtgaagaatttgtactccttgaagacatattgccctttttttattcttagtgctatacactgaatgtatacccagaaattcatatgtaaaaacattcccaatgtgatagtatttggaggtgaggcctttgggaggtacttatgtcacacagataaagctctcagaaatagtattagcacccttacaaaacgggctctgtgaaacaggaaatgcgcccttctcagacacaaaatctgccaatgccttgatcttggactgcccagaaaactgtgagaaataaatttctgttgtttgtaagttacccagtttatggcattttgttatagcagcccaaatggactaagagtaatagctttgtattctgtggttacaatagaggccactcaagcttatattccgttttctactacttgaaggaaaaacagaagaccaattgcttaattattttcatggaatgagtttataaaagttacaatttttcggtacaagaatatttgtattttagatgttgataaatacatacataattgccctccaaaaatatttgtatcaattgacatctcagcaagttttcccacttcctcactgtttcccttgctactacaaaaaaacaaccacaaatttggcagcttaaaccacatatttttgttgtcattgttttgagacagagtcttgctctgtcacccaggctgcagtgcagtggtgcaacctcagctcactgcaacctccacctcccaggctcaagtaatcctcccacttcagcctcttaagtagctgagactacaggcatgcacccccatgcctgtctaatttttgtatttttgtagacacagggtttctccttgttgcccagactggtcttgaactcctgggctcaagtgatccacacgcctccgcctcccaaagtgctagggttacagccgtgaaccaccatggctgtccaacaaatttttaatcttacaattctgaaggtcggaaatccaaaatgggcttcactggctaaaatgaaggtgtcagcagggctgggttccctttgaaagctctaggggagaattcattcccttgctttgcttggtacaagctctagaagccacccacattcattggctcatggccccaattccttcacctcaaagctggcaactctcaacctagtcatccttacactgccatttctatagttctcccttctcattcctcttccagctttaaggactcttgtaatcacattgggtccatctgcataatccaggatcaattcactcttaagttcagctgattataactgtatctacaacctaatatgttaaatatcatataacctaacatattcacagatcctgggtgttaggacataaatatctttgggggctaatattctgcctaacacaatattaggcttttaggggctaatattttgcttaatacaacaataggggttctagcccttcggaatccaaaatggaaattttttctatcacttaaatttaaaattatgattatactatgcaggcatcctttctaatgtttttctgtcctttttcaatgattgaattattcacaccttttccccttatctttgttgacctcaattatttattggagttttttatatattaagaatattatatgtatgttgcaaatattttttcttaattttacatattttaaaatttatggtctctgtacagaagtttaaaatttttatgcccacattccttgatcctttttatcagactttgttgtcgtatctttgaatttaaaccatcatggctatggattcaaccgtgtccctgcaaaattcctgtgttgaagccctgacacccctgtgactgaattggaaatacggactttaagaaggtgattaaggttgagtgaggtcataaggctggagacttatctgatagaactggtgtccttttaaaagagacagagacaccagaacttgctttctctccctgccatataaggaaacagtgagcaggcagccctctgcaagccaggagaagagcctcaccagaatctgaccatgctggtctccgattgcagaattctagcctcctgaaaaatgagaaatacatttctattgtttaagcccccaggctatgctatcttgatgtggcagcccaagcagactaacacaatcaccaacttggaaatactgagcaaccacaaagctgcctgtagttcaattttccccctttctaaatgctctgtgattctgaccccttccctgaagctctttaggcataaatatgtaagaaaacttcccacaagtgatctgatacaacagaggccttagctagctacagcagattgtaccgagtgttctacagggagatattctgaagacagaagactaagtggactttgcttctgtgtttactaagcaccttcattttaaccagactttatttagagagtatatcattttgagcagctagtatacaaggcattgtaaggaaatggtgggaacacagcagacaatggaaagcctttaaatgttaaagcagtgaaggcctctcttagaggccaaataatgcccccagctccactctggccttccgcaacccccgtctttcacctcacattaccgctgcctattccttatccagatgtcctgaagtctctattttttagtcttttctgagtttaaattgttttcctaactctaccacttacttctttgatctgtctttatcacctcttgttcagtgtcctcttgtttttagaataactttctggcttgagagtggtgtttggatgctggaatcctacagaaccttctcttccccatgcttgagtgaggttatttttattctgtagcaaatgtgccaagtatttttagtgtttggatattattctgaaatagtcatttaagttactcaaatttgggagctatctggaagttcattttatgtgactggagggctataatttatggttactccagtatttggttaaatatacagtgaaaatcagaacattatatatgataatgtcacagaattaagtacttttattttccactgtttctgggttgagctactcaggaatgagcatagaaatctaatatggaaaattggcaaatgtgtacgcataatgttgaaactatattcttaatttggataatctctctcaaggtattttcaaatgctaggaggagagttatatatttcttaagtcatcagtggttatagtgtcaaatttcttggaacgtagaatagtagagatttgtaaataaaattttataatcttcccaaacaaaaaaagtgcttgaggtcacagtctaacatgaacgacatcaaccttcctcttttaatcttttaacagctctcagcggtagatttctccatctccattagagagcatttggtgactaccactgatactttttttctttttttaggaccaggtagatccaccattgaagggctggttcattatttgatgtagaagaaatgaatgttaatgttggacctattcaggtgtggctaaatgcacatctgtaatctattttgtgttcatggcacttctgattcacagtcccccagaaaatagaaaaaaaaaaaaagtcaagatgccatgtggcctacaaaagtggatctgtgtttttcatattattttctccaactcagattttagatatggtgtatttcgaccctggtcctcaccagagtttagcatttgatacattccattgttatcatggagaattcaaggaatggaagaatttattaatgttagcccctcttttactctgttccactcactctgccttccttgttgtacaaacattcctgggaggctcctgcctcagcacctttgcactggttgttcccttagtctgagatccacttttacccattgttcactttctcatttcattttggtttctctcaaacattgtctcattatagaaaccttgcctgacaactctaacatgtcagcctctctgcgcttcttaggacctttctctcctcttacctgctttttcttcttccccactatgatttggtatcaaaatatttgtgcattttgcaattcagtgtttacagcctgtcaaaccacccaacaccataacccattagagcagagatttatccatttgtatttccagaaactcaaatagtatctagcacatgatatgcactcaataaagatttgagcaataaatggataaagtataaatattctcttccaatagtatataaagaatgttgaataccaaaagtaattatgaccttatcttttaccctccaataaactgtcaaaccaatatggcatggtacagtagaatataatttttcaagtatgtgccaaaatatgtctcaactttgggctgttaaataatagcaaacaaatagtcatattgctggctcattttagaagtcccttgaatagtcatagaaatgagtccatgaatctccttaagtattctgaaatgaaagatcatgagcaataacctattatttattattctttaacgtatatgccccacaaagcttatcagtggatcattcagcaccatccatcattgagaggtaggaacgtgtgacagctgagaacaaaaactctggagtccaactacctgggttcaaatcccacttcttccacttactagctgcatgaccttgggcaagttactttagcttgtttatacttcaatttcttcggctgttcaatgtggatactaacaggaagagctgcttcttcattgaataggtgtgaagatccagtaagttaatacatgtgtactgctcttcacagtacctagaaaatagctagtcttcaatcatgttagataaaatggcagtagtaattataaatgatacaaatagcaacaataatagtaaactcacttaacagctaattttaagggctttatgactttgctgttatatcctaaaacatcttttttaacaaaatgtgtatatttatagcctaaaacatctttgttaacaaaatttgtatatactcattttatgctaaaaatgtcatgtttaagtggccaaagaacttaaatagacatgtatctaaagaagacatacaaatggtcattaagcatacgaaaagatgttcagcatcactaacaattagggaaaggcaaaatagaactacagtgagataccaccgcgtaccatttagtatggctattatttggggggcaaaaagaaaatcatattggcaaggatgtggataaattggaaccttgtgtctagctggtgggaacagaaaatgcagcatcttctatgagaatagtatggcagttcttcaaaatattaaaaatagaatcacatatcatccattaatttcacttatgggtgttaactagagactcaaacagatatttttacaccaatgttcatagcaacttaatagccaaaagttggagtaatccaaatctccattggtgcatgaatagataagccaaatgcggtctgtatgtacaacagaatattattttgctttaaaaaggaatgaaattcagcgacatactacaatatggttgaaccttaaggacattaagtgaaattaagccagacacaaaaagacaaatagtatgtaattccacttatatgaggtacctaaagtagtcaaattcatagagatctgtacacctaaaaattgttaaaatggtaaaaatgttatgcatattttaccacaataaaaaagatatatttttaaaacctgtcacattcgaagcaaatggaatgtgtacatgtttgtttaaattccctgtagacctaaaaaagaaggtttatatgcaaaacttaatggggagagaataagccgtgttatcccagcctatcactgataattaatacctgggtaatattatttgtttacaaagcacacatatcaccttatgatgttctcacggtatcccttgaagtagtgctatttttatccctctagtgcagatgaggaaaatggatctcagaaaaattaagtggtgtggtgtttaaggttgtaacaggttggtgcaaaggtaattgcggtttttgccattaaaagcaatgggcattacaagcaatggcaaaaaccgcaaatactttcgccccaatctaatattactggtaagttttgtgtcggggcttaagcccccagtcttcaggcatttattcctgtgttctctccttgaaatcataccatcccttgaccagatcttcttttattccataagtacatcactcattccagcttctagtgaaatacaaatgatattcactggcattagcattggcaattagaacataagtctcttgtaacctctaattttagcatcaaaatgaggttggtcagagatattacaccaaccaattacgatggaatatggctttaatttttctcccctcaatttttattagtataaatcaagaaatactgtcaggtatttaagaatgagataaaattgtaagatggggtggctgcaggcttgcatttgcacaggcatgctatggtttttcatataaataatagtgtgctaaccaaaaataactagctcttgaaatgccatataggataagcataccaatgtctcaagaatcgcgtctcaaatgcaaggcctacacaagagtatttgtttcttgagctgaaagaagtgaccagaaaatttagtcacgttccttggccaaaggcatctacattaggaaaattaggtgctttctgcgtttctgggagaatgagttgatattggcatacaactaactttcttttggaagagtttccatggaaaggtggtcattagatgaaatggtagttccgtctttcctgcaacataactcttgggagcatctgagaggaaggttaggagatacttgctattcccaaaactcattctcatcagaaactttaatattccaaggtaagaattttcttattcagtaatcttgtttataaaagaaaaccaaatacactaaagcactttaaaaaaatcaatgctatctgtacctttattgtcaaaaaccattttctagtaaggcttttttaaaatgttcaatcttgctgaataagctaaaggcatgtatagagtaagtaggcaacagcatagtttaaaattaaaatacttatctttgtcctttacaaattctttgtctcctgcctggttgggagagttctgagaacttccttgcattgtgtgatacagcggtcagtaatcacatgtggttatttaagtttaaagataaaataattaaaatgaaataaaatttaaaatttattttcttagtcaagctggcaatattgagtactcagcagccatgtgctagtggtaaccatattagaaagtatagatataaaacatttccattgattgcagaaaattctatggacagtgttacacctttaaaaactgaatatgcttcctttaaaaagttgttcatctccggttgtgtactgtgctggccacatgacactgatgtgagggaagccacttttacaccaacaaagccatcggctggtcagggctggtagatatgccatgatctcctttggacaacattaaggtgactttgcaactcaccattgtctgcctgccaaacaaagtcttgtggtctagataatactgctaatttgatctctgcctcctctataacagaggcctctggatggacccggacatggtagtcatctgaggcaggtgatgccctgcctttgaaagctggatccgttcctacatcactcaggtatccccttaggcagtaattctcaactacatattagaataacctgtagagcttttaaaaatacagtattctgggtcctgtctccataaattctttattaattgctctggtgtgtggccagagcaatttcttcagatattctgaagttcagccagggttgagaaccactgccctaaggcctgttctcaacgccttaagtagttttactgcaaaggcttctgtgtccctgggtcagccacaagtatcaagtcacataagaggactgaacagtgatacaggagactccggtttgatttccagccctcttgctgactagttgtgtaactttggatacattcgtcccacctgagcctcagtatcttcccctgttaaactacagggctgcttattacacacctccaaattctatcagtttttgaaatacccattcctatctaagccagtacaactgttcatgtcaaactgtggagggaaatctttttttctgttcacatcctaactcattcatttgcattttacattccccataagctgatagtctgcaagcacatagatagccctgagcctacacaaatagccccaagcttcctcaatgtattgggggaacaggatgacaaattctaaacactgagtttagagtccagcggaatatttagctgcttctatgtggatctacatgtcatattaagtgcagaatcattgctgatatttctgtgtctaacaaaggactcgaactggcctcagctatcgtgcatgagaagctcatgctttcttttacatctcaagtcttttgagctgctcacttaatcattatattgcctacttcagaaatgtttacaagtaacctttaaaatcatcacctaatggaaactaaggtgaaagttatatttatcatgacattctaatccggttatgacgagtttctacccttttgccttttcccaaagcaggctggctttcttagaggctgcctaatatgtctccaaatgggcccatacttcaaggtgctgttagaagtgacatctccctgctcagctagtcagagacagtgataggatagcacctttcaaggtgacagtgtttgtgacagcaggcagaagggaaagtctgctcactggcaaagataaggaatgcgatatcatttggtttgcatgtttcatcaccaaaactgcttatggtttcatattgcccatgaatcaacctgtaagtgccttagaataggaaagcagttgctagctggcacttgactccactgtgacagatatttcacttcctcagtgtctgccagtcttctcttataacccaccacctaacatcaaggcatcctgcttttagcaacatccttttcaggcacctccaggttatgggtgcaggccccaacttggtgttcagacctcgtagcccattctctatgactcccactggcctgccacccctgcactgtgcaccctgactattgctgcatgcggcagcctgtccccaccctgggatggttctcactctcaactttgcttatggcctggaagtccttctagcccagagctgcctagtagatgtatcctctgagacatatatataatttaaaaccttttgatcaccacattaagaaaaagtaaaaagaaaccagtgaaattaatttcaacaatatgtttcatttaacccagcatatttaaaatatgatttaaacacgaagcctgcataaaaattaactagtatacattttgtttttcatactaagtgttcaaaatccagtgtgtatttatactaacaacacctctcaatttggatgggaccgttcaagtgctcagcagccacacgcaactaatggccataggctaccatacagggtggtgcccttccagtcccttcacaagcacctcacatgcttatcccgattcagcctgaagactcagatcaggtgttacctttatgaagctgccaatttatacagggtgatcaggaaggcctctcctactcgggactgctgagtaaaaagatgggaaaactagtacaaatttctggagcctggctccctggaaaggggacctaagacacatctcatgtgtatttgctgtaataatgctgtgaaacaacccccaaatctcattagtttataataacaactattttttttgtaggtcagcctggctctgcagggctttggagggcttagtgggaatcagctggacttgactttcttccgcatgtccccttattctgggaccagcagctgcctctttatatagtcttttcattatagcggcaaaaatacaggaaggggagaggaaatacataaggcatcttagggctcagggtcgggactggcagactgacatttctacccatgttcctttggccaaaggaagtcacatcaccaagctcaacagcaatggggtagggaaatatccttgcccacagtggagggaaggaaatggtgtgagccagtaatcaactgtttatgctatgtaaggatacttagctgatcagcatttgcttggaagctcaaaaatactgttttttaaaaaagatcttcgtcttctcttggccccatgctcttatgtgctgccccatcatgctatcagaggtcactgcacagtctcagtcatagtggtgaccacatcatacccacagactctccgtgagcacctcttaacccaagtctggctaggcgcggtggctcacgcctttaatcccaacactttgggaggtcaaggcagaaggattgcttgagcccaggagttcaagaccagcctgggcacatggcaaaaccctgtctctacaaaagatacaaaaattagctaggcatagtggtgtgtgcctgtagtcccagctactcgggaggctgaggtgggaggatcgagtgagcctgggaggtggaagctgcagtgagccgtgattgggccactgcactccagcctaggtgacagagcaagacctggtctcaaaaaacaaaacaaactcaggtctgtatttttagcacctggcttactgcctgcaccatccggaagctacccctttgtactgttagccatacggcaaccctttgataatatgtatcaccttagaatcctgcatattcaagaactatctgtcctatagccgagaagccctgtaagggaagtaactaagcccatcttggtcatagctgaatctctaatgccaggttcagtgatggacatcattgcccttaataaagacttgttcaaatgagaacacttggacacaggaaggggaccatcacacaccgggcttgtcgtggggtggagggaggggggagggatagcattaggagatatacctaatgtaaatgacaagttaatgggtgcagcacaccaacatggtacatgtatacatatgtaacaaaggtgcacgttgtgcacatgtaccctagaacttaaagtataattaaaataaataaaagatttgttcagttgaaggaaattatcttagaatgagcagcaaggtaagagccaaatacagggtttacatgaagctaggatatccctaggtcacttaacctctctgaggctcagcttccccttctgtaaaatgaggtttataatgtgatgtttacatcatggggatagtgtaagaattaaatgaggcaattcatgtaaaagccttagaatatgtgtgaatcataaaaaatacttttttgtctttttgataatagctattctaactggggtagtgtgttatctctgtggttttgatttgcatttccctgatgtttagtagtgatcttgagcatttcatcatatttttggccatttgtgtgttttcttttgagaaatgtctgtacaggtctttagcccgttatgtaagctaactaccctgatttgatcattatacaatgtatacctgtgttgaagcatcacacgatactcaataaatatgtacaattgttgtgttcattacaaacaaaatactcaataaacctaatttgtagaataggaacataggaaaccaaaatgaagcaaaatataacggaaggaatttaattccgtatttcattttctctcccttagtaactaggaaactactcaaagaaattctcagaccatcaactgtgacttgtaaaagttttgaaagaaagaaaggatgttaaaagacattatgcctctaattttacagagtgattatagacataatgggctgaacacttagcataggaaaggcctaaagaaaagaaaagccaacttgtattccatttgcaaatacctagaaaagagcacagtccttggtagtaaacccaatggctgtgtgaagaccaagttttgtcaaaccaatcgcttcataagactggttgacaggtctcgggatcaaaagcacttgactaatacggtatatattggcagtaatctgtataacagctcataaaatttaaacttaaattctagatctaggactggtcatcttatctcattgatgaaagttgagacaggaaaggaagaaagagtgaaaataagtgaatgcatggatagatgaatgaatacttggatgattaaaagaaataggaatgaggagtatctctcttcaaggttaataataacaacagcaaagcctatacccacgtattactggaaaagttagctaactatttatccaaggagtagaaaagaagctcaaaccttcaaggcatgatttaaaatgttactggtaaggaagaactctaggtaggtgtcaaataattggtagatttgcgttgtggaggccaatatagggggagggcagataggccaacaagagccaatgaagccacctagcagcgtagcctgggacatggagtccagaaccttctcagtcacccaaaagtcatcctaatccactccaggagctccaaagaactccagtgaatcactattaaaataagctgctcacttgcagaagtggaaagacacaagtgaaatcgcctatggatcataaataaaaaggggagtttttatctacatcccaaagtagtggttctcagagaacagtttgcaaattgatttgtcctcagaagactctcatgggcctagagtaaaatgagcaaaataaggctaacacacaaattgtttttcataaacttaacttatgcaatgttatagttgtgtgtccttcctatatttagtgcaattctattgtcttaaaatgtttagattatgataacagatggcaaatagagtttggtttactttttgcttacttagcaaaatagaagttggccattctgtgtgggtccctctgcttttttaaagtaaatttgtattgaagtatagcacataagtgcactttttacaaagtgaacacacaagtaactcaaacctaggtcaagaaacacaacatgtcttgtacctcagaagaccatatacctctttatagtcactactctcccataaacatgacaactcctgacttctgacaggctgcttttctgcttacataaatgatgccacacaatattttctctcttgtgtcttctttcattcgatgtaatgtttgagagactcatcctttcatgcagatagttgtggttggcttttctcattgctagacgatatagtgctcagttcatgtgtatttttttgtcatactgagaatgagcatttgcaacttttccacttcacggccattatgagcattgtagctacaggttttcttgtacattttggtgtggtgtggtggttggcggtacatgtgtacatcttctgtggcttacctctaagtatctgcttctagagctgggaaatgaatgaatctcactgttttgtcgtaaagattaaatgaaataatgtatgtgaaacttttgtgagctttaaatatgatgcaaatatgagagttgccccttggaagaccctcttctgtttcactctctacccattggacagtccaacagcgttcttgaaataaatattctctagccactttcaggccttccaaatccttatagaacatgtggtctataacagtggttcttcactctaggtcaaggtacataggtacaacagtgtctctatacaggggtactgccaaatatctatggatgtgtagattttatttgtgccacagctaagaattcactagctgtatcaattgatttatggattcttagctttgatagataccttgaactggtcatctaaatgggtagaaacccagatatagcttcttgaaagtaagcagaaagagatagcaaaatagcagccccgttacaaggcaaatttgcatgtgtaccatattatgtgagaatttggccttgtgagcatatgaaagaacatagctgggccagcacattctactcagtaacactactaaaggataacacaaatgggagctaagaaggcttttgtagatttggggagctcttgaggtaggtggctgtggtttcattgtaatgattctcaacttatttggtgtttagtttctttagtccctgtaagcacagcaccaacatatttagcatttaaaccctaaaagattgtgcagcagtggggatttgcactcatagccagttactgtgtgttacttttcaagtggtgatcacagaaataccatacactcatgcagggctttatgatttttataacccatccacacacatcgttgccttctatcctctcagaagccccagaaacggtgcaagtaatggaatattcacaacatcaaaatgcagaaggttacttgtcttgtccagggacatattattgtaaaatcaacactgaaacttggatcttctgccttcaaacttccttctactcaccacacagcttcttgggtgcatggccacttcccccactgcatcataaatgccttgagaacaaaggatacctcttgtcctgttttctttttctctcttgcacccactgctgcatcttaagcataatgggtgcttaatgtagttgagataattgtgtttctttatcatttggttacaattttaataggttgttctaggagttcagatgcttctagggaaagaaagggactcttgattgagaaaagttcttaagggatcttttaattgtacaaaaatagattccaaagcaaatctagggaagagatagttactactgatctattaaaaaaaaaaaaagttaaatgtttttctctgacagcttgggagaaagattgggaccaaaagggagaaaatggtaaagaaagttagagtggttttgagaaatatggtggatggccagagccaatgaagaatgagaaggtcttggtggtgaggatggttgaggactagtgatatattagcttttaggcatttcctcctctgctctgtgttgtaatatcactgtgggtaattttgtcccaaactttggtaatattatattatacatcctgtgtcagtggtactttaggaaagagaggttaagtcagtctttggtctaaagggagaggtcaagtgcctcaggaggcaagacaggaagagaggattgagaggtggagttgtaggggagggaagatttcttctcctcacacattgctagatttgcggctgaggcttccataacaaaaggcagattaactagagaaaagcatacaaattcatttaatataaatgttttatgtgacacaggagccttcataaggaaatgaagacccaaagaaacaggtacagttgtgtaatgttgtgcttaggtttgacaaagagtaggcagtcatggagaaatatgattggaggacaagagggtataatctaatgctaataaactggggggaacttagcaaggcctgtttgttcagattcttttctctgaccctgtgtctccagaaataagaatattccttttctctgagtatagggagggcaactctcaaatgagggttttttaacctgcttcaggggagaaggatgaggagaaggtgagagtgactttgctgcttctgctgttttctcaaatgccaaggtgccataatttggggtagcatgtcctgaaccccatcagagtgaagagctgaaacgctgagtgaaatgacctggacataaacctccttaggaatgcttagaaatgttggaaaggtcactagacttttcacagaacatggggtattgggtgtcaaataattttagttggatattgaaaaaacagtgcctcccacccacccccacaaagatggagggtacagagacacagatgttacgtcaacgtttattgagttcttcaaattaggatccaggtccctcattctttgaaaagttaatggagttttgttttagcattttttcaccttccgttgtattcttgccattatcccatatcctactaaaatgtgacttgatttgccattttttgcttccttgcttaatcaaccaaggacatgtgcaaagccagaattccagtagcatggggtctttttgtcctctgccccatcttggtctcggagtgggtttatggggaagggtgtgtctgtgtataagggcaggaacaagcagggtcacaaaaagaaggaagatcacttaccagcttaagaacaaacttgtttactcttaaacacatacttttgtcaaagtcagcaaaagccagagccattgtgcctatgaaactgcatttgcatttatagtacaaataagaaaaatgaatcctcactacagaatgctcttaaagagattataaatccactctcttgactggaatcctgggcagtattttgattggtatgtgaggatgtgtgttgcacttgaaagttaaggcaagcaagaaatttgggaatggagccagtggggacatttcaccctgggaacagtttagtcacaaagggccatctcgtctattgaaactgcctacaccttgctaactttgtagactttcattccacaatgaagcctggcttatgatgggttaataattagatactccttgtgtatagttcaagtgaaggccactagctatgacttcactttggctggggtttccctgtaatccatttagcaaattaaggagattactttgattggtgccattatctcctattctcttacgggtgaaccacttaacctgtgcttaattgaaagagatagagagggtacagtaacaaatacaatcaaaaggaaggggcaataggatctgtaggccaaacaaatgatcagcactgggctaacaatagcagattagaggtgagatcaattaattagaagctattgtaggcgttgggtggttgccagggtttctagtagcctaagcgtcatgccagctctgttgaggaggattttaatgactgggagttgatgtggctatttcaataattacttacttttataattacttcattagaatactaaatgtattacttcaaccaggaaggtctttatcccccgacatatccagccattttggaagctgcatcctcctacagggatatctcctgtttggaaggggcagtagtttggaaatagctgtgctcatgttgtgttactaatcatatatttaagtgcctgctctgcaaggccctgggctaggggttcagagtacagagattaatgaggcactgtctttgggtgggtgcaaatacaaaagcataatttcaatgcaattagataagagcgagtataaaattatgcaaaggcaatatatcagccctagtttagtaaaggaaagagagaacattgtagttgtttcatgcaggaagagatttaatcttaggaattaggtgccagatatggccctgtattaccctactgactatatcttctaccacctcttccctccgttgccttgcttcaacctcactggactgcttcctcttcttcaaattccccagtcacactcccagtgaggggcctttgcactgaccattccctctgtctgcagtattcttccctcagataccacatggcttactcttgaatgtttaaatcattcttcaaatgtcaccttttcggtaagccctgcctctactaccctatttaaaattgttacccactctcacttctaacacttttgatgccccttatactttttctacttttcatagcactttttatgatacaaaatacttaatatatatatcatgtattcccacacatagtagaatctaagctccataggtaggattttgtgtctcttgttcactgataagtcctaaattagtccctggaatatagatggtgcttgataaatatttgctgagtggatcacgcgctcacagcatcaccagaagagctggcagagaggaagccagggcattgctgctaggcttgtgagttcaaggtcacaccaccataactgtgatccatcatttagaaactgttgctgatgtgtttgtcagtgcacccactgggactgctcaccaccaccaccacccacatctttggaagctttctcgtaagccttggatacccgatggcttctgcttcacttccaccttccaaatctcaaggaagacagcctggtaaatgtagtgtttatattttcaactcctccaaatagaaggggagggtaaaatgaaagctgtggaaaccaacccaactctttgtcactggacattgtaagaacacggaggagcgacactgtctcttcccttttcggatgagcaactggccacgcagagtggttatgtagctggctgtaggtctcacaagtaaatctctaagtcacatttacccatctgagtctcctgattccaaagcccttgttttactccagatcattccttttggctgctcacaggatagtattaataaggccaaaatcaaaagtttaagtccttgggaagctctgtcctctcttagaatgatggcaatgacctctcacttttgccagcctgaaccaggcaaaagagcagagctgggcttgtggaaaccagtcagagctctgagaatagcaactcaacgtgtgggcctcttccatggcaggtcatttttgctttctttcatacccagtccacttaggttgcagaacattaaatgacttccttctctatctcgggcctgaccccaagtggaaattcttcagttcctctgtatctcaacaccagtgccacatcaatctgacaggaggccacgtaattgctgaaattaaaacataatacctgacaccttagaggtggctcattggagtctatgaatatttatttaatggaaatggagtaactgtgaccttgctgggtcagactgactgtttctctccctgacacaccttgtgaagaaacagagaaattttaagctgcagatcaatacggtcatctgctgtggggctgctgtactgagctggattattccatcatcaggaacagccacaggcccttctaagggggcagtttgtgaatggcattcagttagggcccagacaggattacagacatgtcgctaagcaactctacttttgggcatttggatgagtggggcaggcagccttctctagtagcgctcagtgatccccacctcctggcattcactcccttgaataatctcttccctttgtacacatggagtggacctagtgactttctcctaacaaatagcataaggcaaaagtgatggtaggtcatttccaagcataggttataaaagactatgacttttctcctgctggcaatctctctccttcccttcattcctccctccttctcattttgctgcattgatgaagtaaactgccatgctggagaagcccacatggaaatgagtttggcctttggccaacaccagtagaggaactaagaccctccatctaacagctcatgaggaactgaatcctgcaaagaaacagcttggacttgaaagtggaccttccccactcaggcctgtagatgactaaacctaatcaatacctgactacaacctgtaagagaccctgaaggtaagggccagttaagctaagcccagattcctgacctgaagaaactatgaaataataaatgctgttgtttgaagccattcagctttgagtaataaaaatatttgagcaataaaaatatttgagcaatatttttatttgagtagtattactcaagtgtatttttatttgagtagtattactcaaggaaaatattactcaaatatttttattactcaaagctgagtggcctcaaacaacagcatttagcagtagctaactaatatagtgagggaagcagcattctaaaatataggttgtcagcaacccataaatccctgcaaggtgaaaggtagggaaagttctcaagataaaaccatttggatgtgcactcaggattaaaagtcagaacctcgactcacatttaaataacaattgcagttgactttttaacaacatgagtttgaactgcgcaagtccgcttatatatggattttatcaagcaaacacaaatcaaaaacacagtattcacgggatgccaaagctaggtacacagaaggctaacattttgtatatgtgggttccacagggctcgctgcagacttgagtctgcacagactttggtatatgtgagagtcctggaagcaacaagggatgactctgcagttaccaaatgtccttatagcagctctgtgagataggtgccctgatattgtttcattcttgtgtttgttcatctattcactcatttattccctctcttactcacttttgcatttccaggtactgtgttagatagagggagccctcatggggcttccagtttaatagctgagagcatcattacctcaatgatcacaacagtgaatatataattaaaacctgagatgagttttctgaagtaaagaaattgtcctagcaaaggagtttgacccatactgaggtagagttagacaaagctccactgagaaagtgatatgatgaattctgaagaacaaattaagtgaattggaaaaggaaaggctttccagtcaaaagtagtgtattcaaaggccctttgttgggaaggctcattgtttgatgctctaggaagagaggagagagagagatgggacatgtggattttgggcaggctgtgcaggggtttgtagggcacatgacaataggaagacatttaagggggctgttggtagtgacatgatcacttcagaaaggtaactttggctgcagtgtggagaaacagttggagttgaacttgaattgaacctgacagaccaattaagatggtcttggaataacctaggtgagaggggagggtgccttatactactaaggtgatgaccaagggttggagagaggggagtatttcagaaacttttcaggtgaaatagacagactgggtaacgaattggagggaatgcagaggacgcagtgtgactatgcccattttaccaatgagagggttcttagagaaggtgacaacttgtccagagttgatggcaaagccaaaggaagaaagaagattatgtacaatatgttccattttagacaattgagcatgctacttggctttctctttctctgtctccatctggttggtgtaaccaccaatatacacatacaaatacatctacacatgctcagtaacaagggtgtacacataaacacaaactcaaaaaattgttaaaccccatcactttttctgcctccctattcttattttccttaaaccatttgtgtcagtcggaggctgttatctagccacccacccccattcaattaattgctagtcttgatctttctctttttttttttttttttttttttttttgagacggagtctctgtcaccaaggctggagtgcagtggcatgatctcagctcactgcaagctccatctcccgggttcacgccattctcctgcctcggcctcccaagtagctgggactacaggcgcccgccaccatgcccagctaattttttgtattttgagcagagacggggtttcaccgtgttagccaggatggtctcgatctcctgacctcgtgatccacccgccttggcctcccaaagtgctgggattacaggcgtgagacactgtgcccagcccaacttgatccttctcttacaacctctcttgaatatgttattttccttccctctctactataatccctctagcctactgagaagccctctgatgtttctcctcctctccagactttcttcttcagtgtgtcctatacaacattgttgaattgacttcattcatcattatacaccctgttcaaaaatgtcagttgcttctcactacctaaagtctcacctccttactcctccattcaggccctttggaggaaactccaaaattatttttctttataatccttccccccaattgatttaatctttattcattcttaccttcccatttgaacattttaattgtactttgagagttgacaaagtcatgtgtaatatttacaacaaccttgcgaggttggtatttttatttttacatttcacagaggaatgaatagatccattatcaaggagaaaaagtccacagcagagtactatcactctcaactgtttaaataaacctgtacttttacttcaagatatctattttacaagaaaatttatgtatcatggccagaaatgaaaaactcccgatcactcatgatgcgctctgtctttgttaagggaagatcagagtagtaaagacacaaagatgaaggctttctcctgcctgttattacgaacaatggaagaggcagtttgtttctatgtgactcaattttgtcatttatacaccacataaactaattcacattctagtgatacaggttttataacttggggatgaatgcattgttgaaatgcataacatcttgaacaaagttaacaacctatggtgcttgtcttgaactctggtgtcgctccctttccagcagacactactgcacttatccttcttttttcatccaaaattcatttctgacgtggttttatttttcccttacactctgcattccagaccacatttcttcctatgtttccatatacaagggagagaaagaagctaaatttttggaataagcaatttctctacagggagtctcaaggctgtactcatatcaaaactaaataacctctcattctaagggatgttggtccctcaggccagagcttaggtcattaggagggcaggagggggaagcatagaaactgcttccatccatcctatcctggtccacacacagacagacactctcggcctcctttagtattgggccaagcaggcttctccagcttcaagagtcacctcacaaattctgacttcctttgtatgggtttcaaagaatttaaggatcttcccctttgtcaactgatgcaatgcatggaaaaccctttgtcaatgggaaagtggcctaatcaaatatgatgtcttatgtattgcatattttccactgttcagtttttataaaactgtatccaggaaggatccaaatagacatcttgagaaatgattgcagcttgtgatagatacatttctcttctgcttgttgtcagccatattcacttagagcttgataaaagtagatcgactgtgatcttaaacattcagacgctctatgtaagatcacaaacttaattcaatatgcattataaaggggaggagtggaagaaacttttcacttattagattttccacaaagctggtagatttttaaaaataaagttcatatttaatagaaattaaatatctagcatgttcatacaatttaaagtatcaagcttagtattaaaagtaagtaccaaatatagcaagatattgtcaaagaaattcaagctgcaaatactataaagaagctacagggaattgtccagggtaggttataggtgataccacatttagcagtaaattttgtttgcactgtagccttagtctggagagaaaggaggaaaatggctaagacattctggatattaaaaataaaaacagcagcaaaagaaatcatctagtgaaactttggaactgagttcaaaagcagaccatgaagcagttaatcgcttcttctctccctagtcacgctagactgtagtgagaattactgtaagatttttgcagctaattgaagcaaaggggacacagtcaatgtgctgttttctttggtgcagaacgttcttggtatttttgctgccacttgaaatcaaatcccagctgcattcatttaaataacccatgagcccaggacactatttgggccaatttgcatgtgtgagtgattctaccccaggtggtatccatttggtgaatgattacctggccacagactggctttcaccactggagatgcttccattcttgatcatccattgtactccctgtaccagaaacaataacagaagagagccaagcagaactgtctcagagctgtcaccttctaagagaaattatcttttggaactttcctcttctgttctttttttttcttctcccctacagattgaaatttctgctttgaattgtccctgtagaaatttgagacattgatcttcattccacttgttctcttcttcttagccctcccttttatgcaagtttcaaccaacaactattttccaaaaggcagaagacctctactatttcccagccctcatacttcacctatatttggagaccttaatttctggaacagtactcccatgaaccaatgatgataactcattcatactgttccgccactgaggcaacgcttcataatgtcaaagggcatgcagttgcctggaccagcagagaagccttttcagctgtttcacgtagtggattagagctcagatttagagccaacttcaatttcaaatatcagcttcacccactgtaggctgtggtatcccattcaggttccttagagtgtctcaccctgttttttcattcaccaaaatggttagtaagacctccctcacggggatgctgtgaggttgaaatgagatctgtgtgtaaagcactgagcacaatggtggacacttggcaaatgctcagtgaagctggctttattaacaaggggctatccaagagacagagtatcctttttccctgttaccatcagtcacctctcaatcacaaagagttcccttttccaaaaggccaggtctgtccacagatgtctttattgtgttcttgtatatgttgtctgacaaaaccaagctgcaaggaggtttggctcaacaaaatggcatgccatcatttattaaactttggcaaaagaggattctgttctccataattcacatccacttgaaataatttcacttgacttcattaagcttgaaggattgcacttttccttcacccctttcttcctcgtagttacttagcctttacaactcaaaagataattgctgtattaacaaatgtttatagcataataaaggagtgggaggaaggcgaaggattttttttctatctgggctattccctttggtttcttggaagtactggatagcaatggaataagtcatagataatttttggaaatcaaccaaaggattaattttccagccaccagtaaacagttcttaaccggagaccctaagactttgtggggaatgaggctaccaggaattcctagtggctaaaaggatgtcaccacaactctgagctgggaagaaatcctgactttactggaaatcaggaaaagactctggaaggtactggtagggcctgtggaaatccccctctcagtccttgggttgggggatttaagagaaccttctagagaatgctccccttttctttaggctaatgaagcattgagctatttacatagaaatctcatttaactgtgtgttacaggctgtaatgtcccccttgccccaaatttatatgttgaagacctatcccccaggacttatgaacataactacgtttggaaatatggtctttaaagaagcaatctagctaaaatgaaatcattaatccaataggactaacatccttatgagaagacaagattaggacacaggcatgaactgggggaagaccatgtaaagacactcaaagaactgaccctaccaccccctcgagagaggcctcagaagaagcaaccctcctggcaccttgatttcacactgctagcctccagaaccatgagaaaatggatttctgttgtttaaaccacccagtctatggtgttttgttatggcagccctagcaaactaatccactgtgtggagggacacaggaaacacgccttcatgactggggaagatgattccttcatggtccctttaaaacgttcaaaaggctttacaaggagtatctctgatactaggaaactcaaagtgggtacatggtaaaaaaggttcaggagtcagaagtgatcctgctcatgcaattcacctccttgcagtgactttgctctattggttgataactggagtcctgggctgtctttcctctctctgtatatataagggccattgacagtgagggatgcacttagcgctctgctcagtccttggcttttccctctctctcccctcttctcttgctttccccagaacataaactttgattagtctttgacccagccataatgttttccttgtgaattataagtgaaattatatcatcgccagtgttcgagccctctcctcacctctctgaccctgaagttttctatgagcttgctcacatgatagggaaatgatggcaagagctttggtaaagagacaaattttgccctacaacagatcacttatgtcatacttgggcaaatctttctgaaatccctcagtttccccttctgaaaaatatagagttgaggcaaaactatctttaatatccctccagcattaccatgcaatgattataatccatctgcttcacaaaaatgtacacaaatatactcatagatacacacatatatatcttccctcaggtcatgaatgcatagctcattcttgaagatcagttcgagttcaagcatggaacgctgtgcattctgtaaaataatgtaagcaataaactgcacttgcagaaaccagtcattaatggtcccaaatagaaaaataaacttttctttgtactcatgttttcaagtgctgtaaaaatgcttgccctaagtctcagatataataagtcataatttaagagatatgggtaaaaatgcttgagccagatgtttgcttttttttttttttttttgaacacacacggcttgtttgccttttacccactgcagcagttcagcctcagaggataactaagaaaaacctctgagattgttagaggggagcttcacctgccagtctgggctgcaggatctctatagcaaccaaacataaatcaaggaaatggccccttttgtaagttggttaataggcacaacatgcttctttagaaaatccaaccattctttcaatagactttgattgaaagtcagccttttcttcagacacattcacattcacatctagtagcagcttgtatggctgtccacgggctaatttattaccctttaaagatctggcaaagaaaaaatggctctcagaacaatgtttacattcagaggcataagcacagaggcacaaaagaacatccttttgttctgaacttggaatattaatctttaacccaggactttaactttccctctcttatggggattgacagaaccactcctctcactaaaattttaccaatttaatacaacgttgtttctaacatgtgagaagggggtagtgagtcttcctcccactttttttttttgccaaaccttgatagagattaattgtttctcaaactccccatccttttcttgaagaataccctgcttcaggggttgctgatgagcagagttggctctcttgtccccagtaggagaatttgacaaattaacaaaaatacaaagactgttcttcactgctggcgatgcagcgagtttagggccattggatggtgagatagccccttcccaccctcaccccaccaaaatgtaatttggaaatgtgtccaagaaatgtcccacattgagcaagtcctccccgatgtcacagagtctaaaggcaaagtggggcacacacagcattttctttcatgtgggcagggacatgtcactaagtgaatggtgagctttctctcaaagaggggagccaaatgctatgccccgtcttcctttgaggtgggaagaagagatggggaaaagcctatagaaacaaacctttgtagtttttgttaaagtagattataagatgaaaaagttcttctaaaacaagagagagcttgcgttgctctatgtagcttcatatccctgacagagttaggcaaagaaagatttatattaatgccttcctctttagctttcttaatcctcagaaaccaaagtctccagaagctagactcctcaggagctcctttccctttgatatggtcagctgtccccactggcaagtggggaagaaagagccctgcgttggtttcaaaatgggcatgtttaaacgtgcccttgattttagctgcaggcctgtgttatgagaaaacatggtcctgccctattcgaggctggtcacttagaaatagcttttgccttagtgtcagcctgaaaatacctttggggtctgtgaaactgaagacgctcccaaaatttaatgcaaactaagcatgatgtgttctccgcgagagccaaaaagatcctagacactcagtaaaggaggttggttttgttttttgtgtgttatttttaatttttttcctgtggctgagaatccaatgcagacaaaagattagctctcctagttattcacagcctggctgtgcagtcacgcaaccagatcagacacgttatgtagaatttttcgccgtatacctgtatctgtattctgatacgttacggagaagcagtacagtactgtagttaaaaatgtgggcaaaggctctgaattttcagtgttcaaatgccagttatgccacttactggccgtgtcagtctgggcagtgagcacctatctgtactcagttttgtcatttgtaagatgaggctataataatacctacttcataaagtccttaagagttgatgttttataatgaaccacttagaccagtgcctggcatatcacaagccctcaaacgttcattgttattaacatttttaatgcttctttttgtagttgatgctattgtattgttgacgatgggaagaatgcctattacccaacatacaacacagcattttccaatttcagatgatattttgcagaacactggacaagagaaaaagaatttcccgaggctagagttactccatttaaaaaaaaaaaaaaaaaaaaagttcagagataggaagcagctgtctatgacaataactaatcccattttcctaaaaccatcatcacctagtatctctatctttgctttcgtctgattaaatggaaatgtctcaggtttaggagttctggctaaaaaggtggtatgtgtttgtcttctgcctgttctctgccaccaaaatgaagaactggttctgctcacctaccctagccagcctcacagggtcacaacctagttgcatttttgaaattcaagccaagaatgctggagctcaatttcacatgtgtcgtaactgggagtggctactcatggctcatcggttgtctgcacccttctcatttgttctaagggctttgttactttgaataagccttcttagcttcagcccaagtatcacagagacaataacttcggaggaggtaaggaggggatgttcaccgaaggattcaccgaggaaaatgcagcctgtttcccaggaaagagctccacatctgtaagaattccatgaacaagtcagaacttgccaaaaggatcagcataatcaaaaaaccaaagaggactgagataaaccaaaaaacaccatatgttgattatgttgtcattcgttaagaattaagtttataaaccttgggtactcactgagaagcagcatattctagtaggaaaagtccaggttttgaagagagacatttgaaccacaggaacttaactttagtacttaccgcatggccttaggcaagtcctggtagtgaattcattctctctaccagtcagcatccaataaggaaaaataaatgccattccagctatttctagcagaaggaattgaatatggggagttggtcatacagttgatgtaagagctaaaagaggaaactgcagaatggggccacccagacattagctacaacagaaagccactacccctctcccaacccaggctgaagggactacaggaagagatggtgctgttggaggttaagatctggggcagacagtgggagctaaaaccacagaggaaattcagtcactgtgggagaagccacctaaggcagagggagagaggagagagaccatagcttctctccttccaacggcccgttggcggaagcttcctagaagtcatttggcaatgtattcgtggcctcccagtcttttctcctactgtttctgtaaaagaagagagaggaggaagagggagtggaggggggaaggaagaggaaaaatcaccagctttgcagatttgctctcagattcattccctgcctttaccctgctctggtctttatcacagggtatcgaggtgtatacacagataatagtgccccagttagccctttactatgtgattagtcctgctgtgtctcatggaaaaagtatttctgcttttttctcgaaagacaatctgtccattttcccaaaagagtaatatgttacccaaattatatagactatgtgttaccacttaccgtgtaactctcatatgctagaggggcaacatggtacagtagttaagagcaagagctcttaagtacttgtgttcaaatcctggttgtgcttgctttgtgactgttgggcattttaactgctatggtcagaatatttgtgtgcctcagaaatccacatgttgaaatccagtccccaatgtgttggtattaagaggtggagctttggggaggtgatgaggttctgccttcatcaatggcattagtgcccctataaaagaggtttgagggagacccctttgtccttccactatgtgaggatgcagtgagaagataccatctatgaagaacagaactttaccagacatcaaatctgctggtaccttgatcttggacttcccaggctccacgactgtgagcaataattttccattgtttatgtattacccagtctaaggtattttgttatagcaacctggacaaactaagacattaacctctctggtctcttgtttgtatgatgggattaaaaagagtcccagcctcatgacacttttattttatttgcctaatatgtagggctgtgttcttttaagtattaaatgaaaattctcccaggcctaagattcgatatgtcagtggcccacttttattgctgtgatatgtggacaagatgggactatttctcctttggttttgactaagacactcacatgctagataatgaataccaatctaaatgtaaggcagatcaccaacagcagaaaataatatgttgagaacaagttccatgacccttaggccctttaccacagcagctagacggagaattctgaagtatcaggacgggaacaaggatatatggagatggaggatttatttagagaaaagggagctttgcctcacacaccaaatgtgtttctcaaaagtgcatcttgttggctcagtaaattttcatggttttctatattagagacttaggatctagttgaatcaactgtctaagcaaagtatgttcaaggatgcctaatcttacataatagaatgagccctagggacatccaccaaaagaggcaaaacttgagatgagccttgaaagaagaaacttagaagagggtaagaagacacatacatcatgaagtattccagaaacaaggaaagatcctctcaaacccacagtagaaaattcaaagggcaaggcagcctggagtctgccaaaaaggcttttttttcccccaaagaagctggtaactagggttttgctggaagttcctacttagaggaaaattaagctatctatgtccatgggaaatgaaaggtgggaagtaacttcactatttcctagctttctgggaactcgggcaaattatctctgtgcttctgtttcatcatctgtaacatgttgattttaattgtacctacctcttgaagtcgacatgaggttgaaatgagttcatacatgaatatatttagcatggtagccagcaggtagtaaacattcaaaaattcttagtttaattattgtaattattcagtggtaaaggtctggcagagaaagaatgaaattatctggattactggagggggaaaaaaaccctcactctaactgggagggtcaacttattccctgtccaaattgtttactgtttaattcagttctcagaatggatctctaactctgacccatgaaccggtccatgtattactagttagaatttggaagtcccattgcttttgttcacctgcctgaatccataatatatttaagtgagccagacatctcacttgcatgctatcctagcagtgctttacttctaaactgccctggacaagatattttgcaggagtgagaagatatgccttcagtgtcatgggcagtccgtgaggctcgtggactgagaagattcctagagactttgagttttgtgtagggctctcatttcctacctagatagtgtctgtgaaagagctaaatggattctacaatggctaaagaccgaagtcttttatctggcctgtgtagacttataagagttccatgtatataaacttcaggaaatccatgaactctgtgatggtatgcaaaatggtatgttcccacacaagtgtacatcttaggagaggattaattgctttcatcatattctcaaatggttaacaaataactcaggataaagtaagggaattaaggtctagatattttaccagcagaataattagacctataactgaaacatagaattagaggacaaaaggagcttacaatcagttcacttagccctacaacctttccctccctattcctgatgttgcttgaaaaactgagtactcagaaggtattcttttttttttttttttttttttttttttgacttacagcttacttttaattttgtcttggatttagactggtcaaaggtattcctgcttcctccacagagatgtaacattatatgaattcataagaatcatggtttgtttgttttcttgtaatctgaaacagcttttatcaaaaacctaattcataaagaaaagctaatcatgtacagggaaaagcagatcttcgtggggatttttttcctttatcagcgtaattatagtcttattttttctttttgttttctcccctgttaaaagcaagagatggtcccattttttcccctcattccccagtctagtctcatgcatgggactaatttgacaagacaaatcattggaagaacatttatctttatccaggaggttgttttcagaaattttttgatgttgtcctagatttctacttttttagaggctttttgaaatgacagatgggctcaactgcttttaatgcctggtggggtgaggaagaattgcattcacttatgtgtgtgtgtatacatatgagaaacattaatttttaatttactctgtttaccttgagaaactgccagtgaatgattcagatattccacagaaagggactttcttttgtaatataggacaaaagacagctaagcatgtgttctttcttcaaagcagaggttcagggtagggggaatagtatttatttgtgcagcttacaaaaggactactttgactatgtaaacactcacgtaattttattaagagttgctaccaaatcttttttttttttttttgagacggaatctcgctctgtcacccaggctgaagtgcagtggtgcgatcttggctcactgcaacccttgcctcccggtttcatgcaattctcctgcctcagcctcctaagtagctggggttacagccacgtgccaccacgcctggctaattttttatttttagtagagatggggtttcactgtgttggtcaggctggtctccaactcctgacctcgtgacccacctgccttggcctctagtacatgcttaaaaactcagcttagatacagagatagagagccagagcaggctgtgccgacattcctttaattcaacaattctttgtgtgtctgtgtttcagaatcaaaccccaggatggtgatttgcatagtggtgagttaagctggcctctaatttttagtcccgggtatgacactagctttggggattccagcaatcttcctcctctgtcttgtacttgggtgtctcaggaggtcagatgcttggggcctactgattccaaggaggagaaaaacttctcagcttccctgagggggttgaggatgagaattggagcattctaaagggatttctaataacttacgtttacaacctgattcatggacatggaggcttaactctgcccaattgtccaagaacccctcaaggattccctcagagtgaaggtggggttgggagccagatgtgattccaaattcctggagagacctggaatacctgaaatacccatattaagactcccttgtatgattatgctaacgtgcattccacatctaaggggtcactgttcacatcacagatatcatagacttgcatagttatttaaacagctttctggcaatggcattaaggtgacttgttcttacaaggtcagtgtattagcccaggtttacataatgtaaaaactgtttattattagtttgggggttttataataaataagtaacgtttagtgagtatttactggagaatggtggttgacctctcccctcaggacagacttcttaacctcaattcagagaatccctcaactttaatagcaaaaaaagaaagatccatcttcattctcactgcagcctcgacattttcaggcccaggtgatcctcctacctcagcctcccaagtacctgggactacaggcatgcaccaccatgcgtggctaatttttgtatttattttgtagagaaagagtctcaccatgttgcccaggctggtctcaaactcttgcactcaagcaatcctcccaccttggcctcccaaattgctgggattacagacatgagccaccacacctggcccacctcactcgtaaatgaaatttgaaattatgaatggaagtaaccacagtattacaagcagtgcctggtatgattttcttcatatcacatttaattgttgcaatatttcaattttttaaaaagacggttatttttaaaagtttttaaaagaccatacaattggttttctttataatccaatatgttttattttaggaacattattctgagaagaagtttacaaccctcagcagcctactaaaaggtctgtggcaccaaaaaaaataaataaataaataaataagttcagagattctgctgtaggaagttaaagactagaaaatagtaatttctttatctttcctgttcaagagtaatttgcttttgcccccttgcaactgactgtggaaaagtcaaataattgcataagaatctacctgaacagtttgcttcctatgtctaattgccaggcagtataattacaactgtgcatagcattaaatatgtgttaaattgatttttttaattcatttgattcgatttcaacactaagctctgttcatttaagcatagtcttcgtagtttatacctttgtaagatatggttgaggagtagatgatatcacatgaaataatttgagaaccactgctctaaatttaacctgtgtttctgttatcgctgctgccatgtgtctgataaacactgtcttatatgacaaaacatgacactgctttctacaaaatgtccttgcattataatttgttcagcactgatgcataactcctcaatgtggaaaaatgagtaagatgctgtaaaatgtggcacactgtctagatcatgtctttgtggaggaaggagagtatgtgctgaacaatagtttttcacaatgtgcaagactcttggtctaaccattaatagagacaatctagtctctgaatcattaactccaaattctagaagaaagaatatgactgtctacttctgatatcctttttgatccattgaagaggcacagggacagggtctcacagtacaaacagttctgcagggacctttgcaggcagagggcagttttctgagaagaacagaaggaaccaaagctttctgtaacaggatcataaagcctttaaaaggagaaaccataatggttactcagggaagctaggactgtatgtatccccaccgtttgagtcacttttggctgctgctgtaataaaatacaaaccactggtcaggagtggtggctcacacctgtaatctcagcactttgggaggccgaggcgggcggattgcctgagctcaggagtttgcgaccagcctgggcaacatggtgaaaccctatctctactaaaataaaataaaaaaaaaattagctgggcatggtggcgggtgcctgtaatcccagctactcaggaggctgatgcaggagaattgcttgaacctgggaagcagaggttgcagtgagccaagatcacaccactgcactccagcctgagctacaaagcgagactctgtctcaaaacaaaaatctctgatttataatggttcaacttagatttttcgactatacaatgagtttgttgggatgtaacctcattgtcagttgagaaacattcggatttatggcagtttgacttaatttttttttactttatgatggggttatcagggtattaaatgcagttttcacttctgttttatttatggtagtttttactcactatgggtttatcaggacataacctcattataagtggaggtgcatctgtactacagtgtgaataccaatggggttagtctccctcagctacctggggactctccattttgtgcatatcttctgtaggaggatcctcccttgcatgtcttgggctgttacagactgatgttgaggcagccctagggcactgttggcttcaagcttttacaggaggtatggagttactcacagctctgtgctggtgatataaccatggctaccttctcgttataaccataaggtcctgtatgttcctccatttctatttagtgcattcatattgtgttgtagagcatggatatgtacttgttaattatatctcttatttctgcattttgtatggaggtgggcctgggtgttgattctggcaggtgttccatctaccatcttaaactggaaatctagcagagctttagaacactgaggattctagaagcaggacttaaagtgctagtcttgacaagaacaaagaccctgtgctcctgtccctaacatctgaggctcttgcggtggcagtttccattatttatggcttcagccacagtggaaagtggcactaatatcacatctgagaaagtatctttggcatagatgccagaccattggtgtcagcactggggtcatagtgctagagacacaccagtagccccacaaatagcagaggcccaagtaattgccactactaaaggggacctagcaggagaaaaggacagtggcccacaggagtgaaatcaattgatacagatgagaaactaacagcaaaaccatggcaagtcctcacactaagttcacgttaatgccaagaagaataaataaaagtgagtcataatcacagtgagatactactttatactcactaccatgactaaaaccaaaaagtcagacagtaacaggtgttagcaaggatgaggagaatttggaagcctcctacattgctagtgaaattataaaatgctgcaatagctttggaaaacagtctggcatttctcaaaaggttaaacaaagattaagcatataaactagcaagtccactcctaggatatactcaaaggaatgaaaacatgttcacacaaaacctagaatgtgaaagttcttgcagcattattcatgattgtaaataacccaaatattcaactgatgaatggataaacaaatgtgttatatccacaaaatggaatattattcagccataaaaaaaatgaagtgccgatacatgttacaacatggataaaccctgaatacattatgctgagtaaaagaaaccagtcacaaaggccctatattgtatgatcccatttagatgcaatattcagaataggctaatgtaacagaaagtagattagcagcttccaggggctggggacaagcgacaatggggagtggctgttaatgggcatggggtttctttgggagataatgaaaatgtttcaagattagatagtggtgatatttgcccacctttgtgaatagacttaaaaccaccaagttgtatactatgaaagggtgaattttatgttattgtgaattgtatctcaagccattttttaaaaagcctccaccaaagctgggctgtgcccccatggaaatcaaacaaggccctgtgagtaaggttccacttatccacacttttgtggtttggatgttaaagtgctattccccatttgtcacagaatttgtgtgtatgtaagagaaagggagataaattgcttctttagtatttttctttacatatgagcttctttatttctaagggggctagactagacaataatctgaatgacaagctcaatgctctctttagaatgttctgacccttgatggccatcagagcctgtatttattctcttatttccttgagttctttctcagtaggctccttggtcctttatacagacaacctcttgacatgctcagcagttccagccccaaagcctatattatattctgaagaactttgggaggtattattgtctccattcgcaggtgagaaaacccaagtcagagagattgtgacccaagaagcaaagaaaattgatgctgattttatcctcccaagtttgccaagcccctttaatctgattcttcaagtgcttttaacagtgaactcctgttgactgcatttgtcacaggactttctgtttagtaatgactgcaattaagctagaacataatatttgacaacaatagcagagctgagctcccattaatttttttgagctggtgcaaggagtaagtgaagcaaaaggccatgaccgactgagtgccaaaatgaagacccgtgtcccctctgacgttagctgaatgtctctctaatctcctgtgatcttttgctgggcagataccagcagacatttgccacatggttgaatcttcattgagtaaaaatgaattcttttctgcatggtgctgttcatcagctctcttccctcaataaatgtgttatttagttgctcaggtttccttctttgtgaaactgggggacaataaaaacttaccacaatcactggaggcatttcagtaaagctgctttgagcaccgtagagccacagccagccgggcagaatgtttttattttattttgcttggtctgggtttgtttcttaattgcaaattgcagagtccagggttcaaagatgaaatgcaactgtgggtggcccacaggtttaatgaggcttgtgaatatggccagatcatatccaatatactcctgaggcttggtgatgcctgctatgaaaaagaacactgaacggccccaaagctccagaaaaaatggaaaacatggtagatcctcctagacccatcttgacttcagtagtatgagtacatgtacaccttttctttgctaaccttaaaaataaaacatatatgcacagattatagctgaacccaaaacccaagcatccacactcccattccatccctaaacagaactgtctggcagatagtcaaggccttccgaatcccagctgtactgggctcctctaaccttattttcagtgctttctaagaaggcttctttattcagttctgctaatctcctctttctttggcattaaacatttgctccatttccacatctttgcccaagcttttccttctgcttagaatgccctgtaagatcccctccacttgctgatgatcccaaatcttcccacctctatgacatgtctgccgtaactgctatgcctagtattgccctcttagatggtctgtttcttcactattcaacttgtctctatcttcactctttcagactttttcatcggccttgatcaattctagttggtgatcccacatttggaataatctttgactcttctttcatgcccgagatctaatccttccacaactctgtgggctttatctttaaagtcatccagaatctaaccactgattccgacttccaccactaccgcgctagtccacgtaccatttgatttcacctgggttattataatagttaattagtttccttgctcccactcttgtccttatagactgacctctgcacagtagctatagtgatccttttacaatgcaagtcaagtcatgtccctccctattcaaagctctctaatggcctccatctcctttagaagagcacctaatctcaccaggttctgccaagacacaataacaattcaaacttactccagtggtatttttatttataataataacagcatttaacaagtgtttaccctacaagagacattgttctaagcctttgacatgttcagggttgctgtaccctacaggtgccattacagttcagaaactgagatacaaagaggccaggagattttcacagtgtgcacaaccagaactaggatttgaaccacgagagagcccatcctctacaccactgccccctcctgcctctggacgtaggatacactaggatgtgctgcaacctgcataattagaccttcattttaatttaaaacacttcagtaaggagcccagtactctatttgttttcttctgtttgcaaatgtatcagtgtgtgagtttaactgtaggaggagaggttttaaggaaaaagagaaaaaggctggagcctgcattaattaggtaaacccatgtcctcagacagcaatgccccagagccaagatggaagccaagaaatttgttttaaaaatatgatatctcccaagctgaagattacgtcaaatatatagtgatataccacccaaaaggcaaaaaccacagtttgcttgtttaaaggcttattttaaattggtttggctgtttctcagagctgtaccacaagcaacaggctgtagtttctgtgcaagggttgaaaagttgtcttgagaaaatgaattgtggtcttgcccagaggctctgaacctttagtagaatcacccctgccccacagatatcaggcaggccagccaggcagctggctgtcatatctgtcacacctgagccatggtgtccacgacactcctacctagtgggggagaaattccatttgttgaagagcagaaagagcttgggcctcaacaaaaatttcttcaaaaagggcaaaatgtcacacagtggtataaaaaataaggaaaagggactttgggtgttatattagtggtataactcaagattgaagagtaaaatgtaagggattggttatttgaaacatataaacattcaggtgatgaatgtttgcagcctgtctggtacccatcttgtcccaagtgccaagctcttcagttgtttctgctacttaagaaagacaccatctaatctgccatatagagagcttaaatggagctgtaaatatttgggggaaagagtttggtagtgttagcctggcctgtcctccgctgtattataagtagctgttatctgaaacaattgagaacacagggggaaaaaagacccaattatgcaccaggaagtccagtgccccatttttggagaaggaaagtgagagggcattgagtttcattgattgggtctccgtggcaggccagctgccccccaggaaggcctggtattcctgtcctctccgtgaacctgcctgaaagggatataggagttattgggtaatcaggacttgtcagcacctcggttatgcaggatggttcaatccgataatgtgaatggaacctgtaatagggctgatgaaaagcactccagtttcaaaagggccttgaatgattttttgttcattttctgtttacatgtaatgtgttattgatgtcattaccttataatacggcagcttgtttcatagaaaaaccaggaattattcattctttaaaaaaaaaaaagacttagaagaaaaagaagaagaaaggaggaaagaaagaaaccctgttacgtgaggaaaattgcattggaatgctgcaactgaaacatattgattttctggcactagactttttagattaaaaatgccaatactaaatcctttcatgacctatagttcatgtgaagttcgcatgtcatttactattattctgggggaaaaaaagctgaatctttaatgaaaacatagttggaaagaatgtctgccgtttccacaatttgcataccattataataatgcctgattatgagctaaacatgctgatagtgggatgggttgaacatttctcttacttcaaatcagaagtcatttgtctatttgaattgtctgcttggcttggctccatccttggtgggagtcatgggtgtgcactctttccttgcccaggcttgttagggttggtgcattaagctccccacgctaagagagatacattccttcacattctactagtgccagagacttaagtatgtctggtcttactgtagtctagaaaacactcatgatacctattaggtatttatccaaattagttaaaaattataatatagatcaggtgcgatggctcatgcctgtgatccctcaggatgaggcaggcggatcaattgagaaccggagttcaagaccagcctggacaacatagtgaacatatgtgaaaccccgtctctactaaaaatacaaaaaattagccgggtgtggtggtgcacacctgtaatctcagctgcccaggaagctgaggcacaagaatcgcttgaacctaggaggcggaggttgcagtgaactgagatcatactaccacactccagcctttgagacagaacgaaactctgtctcaaaaaaaaaaaaaaattgtaatatggccatgtaagttcttggcatagtcttgatgtgattgcatggttactgccaatctcagaagtcccttagccaacacacaaattcctcaatggcatctctggtcacagtttttgttttccaacagtgagccaggtttgaaggttatgcaaaaacatcttcatttcctcctttgtattttcaaggtattatcacaaatatttgtactttgatcagagctttctgcaccccctgctaagtcaggaattatttagtttctttgtcgttggacagagatgagtaggtcctataacattttggcctctgtcactagaatgaggacgaggcacacagagggtgtagatttcttagataagcagcttctccagctggaatctttctcagtgtctatagtagggggttgcaaactaaggtccaaaaactaaatgctaccccaaacctgcttttctaaataaagttttattggaacacaatcatgtttatttgtttacatattatctgtggctggttttatactacagcatcagggttgagtcgttggaatagagaccatatggccagcaaagcctaaagtacttactatctggccctttacagaaaaagtttgccaatccctgccctgtaggattgtgttcctctgaaactgtcccctaaattatggtgcccatgagtaggtacagatgtccagcagtgagtgcaagagtagatactatggaacttaaaattatgtgtttgagtgagatggagtcttagaaatcaactcatcttaatttccacatggctgatgtttgattatcacaataatctttttgctattggggaactttttaagtctccaaacatgccattctgtattttgatagttctgttaggaactcttcctggtagcaagtacaaatctatctccttgtaagttctttcccttggtcatattcctatgctttgcagccatacagactaggataaatgctcttcaacacagtaatcactcagatattaaaaattattgtcattttctccctgactggttttctttctttcttttttttttttttttttgagacagagtcttgttctcttgcccaggctggagtgcagtggcgtggtcttggcttactgcaacccctgcctcccaggttcaagcgattctcgtgcctcagcctccagagtagctgggattacaggcatgcattgccatgcctggctaatttttgtatttttagtaggacagggtttcaccatgttggccaagctggtctcaaactcctgacctcaaatgatccacctgcctcagcctcccaaagtgctgggattacaggcattagccattgcacccagcctccgtgagtattttcttattcaagttatatattccaatttactttttttgttcctcttgtggcagaatgttgagctctttagcaatccagtcatgttcctctgtttgcactaatctgtcaccgggcactaacatgatatcccagatgtggttctaccaatgtggagttaggcagaattatcacctccatcattctagaagttatatttcttgttaatgtaaactaaaatttaattcacctttggggaaaccacatcactgttgattcagactctgcatgaaatcaaccaaaaccactttgttgatctgtagaaaagtaccttgctgatttccctttctcttttttcctgtcccctgtcatttctgcgtggactgtgcctccatttttttttttttttttttttttttttgagatggagtcttgctctgtcacccaggctggagtgcagtgtggtgcaatcttggctcacggcaagctccacctcccaggttcacgccattctcctgcctcagcctcaactgagactacaggcacccgccatcatgcctggctaattttttgttttttttttttagcagagacggggtttcaccgtgttagccaggctggtctcgatctcctgacctcgtgatccacctgccttggcttcccaaagtgctgggataacaggcgtgagccaccatgcccggcctcctctattcttacaatggagtctgattccttaacatctcatagttgctttttttttttttttttttttttttttttgagatagagtctcgccctgtcgcccaggctggagtgcagtggtgtgatctcagctcactgcaacctccccctcccgagttcaagcaattcacctgcctcaacctcctgagtagctgggattacaggtgcgcaccaccacacctggctaatttttgtatttttagtagagatagggtttcatatgttggccaggctggcctcaaactcctgacctcgtgatccgccaacctcggcctcccaaagtgctgggatttcagggatgagccaccgtgcccagcctcataattgctcttacctgagaagtaatgaaacagatgtctcaaattctcttttacattacccctacacatgaaggatggcttcttccagactgtttattcttcttcaacctacttgatggctttaaagaaaactaaaggcactgaaagcaaagattcttcttgaaagtcccgaaggctgctctacacatatttcttgccccttcccctgttagcagcatggtagtattgtccttgctggctccttatggttgagcaggccatgtgatgaagtctggcctgtgaatttggagtgaaaatgatgtgtgtagcttccaggccaaccatttgtctgcaaatttgaaaccctccagtgctctttctttttggcacggtgacgagcagcactcatgatggtggctgttttactagtctgggtctcatagtaaggtgagatagagcagagttccctgctaactcataatggatatggagcatgagtgagaaatagtcctgaattttttaagtggttgaggtttgagcattgcttttgcaacacagcctagtctgtatgactgacagtcagatttcctaggcactcattcattcaacattaggtcaatattttttggtacctagtatgtgaaaagtactcggagttatcacaatgaacaaaacaaaagtctctacccttgtggaaatagggggtttggacatttcatgtagtaaccacatgagacctggacctctctagataccatgtagcagacaaaatgcagtatgttcagagtgattcttcagatgtgattgtccatgaacactttagaaggagtccaggctgggagctggaatgccagggtttaagtgctactttgaccactcatctactgcgtgactatgggctgacaaccctccttgtctgggctaccattttctttacccctctctgttcacacatgattccactctatactgtctgtgccagtggttgttcaacagctccttgaatgtttttggaaacagcatgtacagcacttcctcaggcagtgcccgtgtcagtgtttttactctgaagcacttaggttctcgaagccatgagatatagccagaatttgcatgtaaataaatttgttactcggtttatattccgtgccaagcactgccttgaactgcacactctggaaattaaaggagatgtatacataatggccctgaaccttcaagtccaatggaacagatgagactgccacttaggtaccagaacacaacatttgatgctgaattgtgggtcaaggtcagaagaaaagaagtttaggggagattagtgcaatcaaggaaggcttcatagagggtgtcgggtttgtgccaagccttgaaggactttagattctaagtaggtggcaggcataaaggagaggcatatcagacaggacaaccacctcaaggaggggaaagagaggatgcacgtggtgtatttgtgaaaacagaatggagtcccagctggcaagtacaaagaatgggagtgaagaccagattctgaaccgccctgtgtggacaattattaaaagagtccgctgataggaattttaaaagatacggcactagccatccatactgtttgggtcggtactaaaggatatcttcatatcctcctcaaagaggcctcctgtagctaaaaaagaactttgcaaatctggaccttttccttttgtcacatattctctgtttatagtttttatttaattaacaatagctataccattaaatatgtagatgttccacccaaacattccctattggtggcagatagtgccaggtcagtattcacagcggggcagctgagggcttcctcaaaggaagcagggtgaggtttatgcctgtctttgctctgtaacaaaatgttcagagaagggaaatatggaaaggaatatcattgccaaatgggttccattcttcatgtaagtgatggctttattttgcctttcaataagaatggctttccccagggcacatatggtacatagacagttcaggctcatgacacaaactctcaaaaaacacaaggaatgacagtgggggatgtggatactcacactcaagctctgcctcctggttgacctcctaagaaatcctgcctccttgctcaagtcagttaccctgaaatcccaatacaaaagttcaagtaaaacacaactcattaatgttgtacttggttagaaaaaaaaggaaaaaaagtatgtgaaaaaataaatgcttatgttcaaaatatgggttctttgggggagatgagttgtttcctgcggtgtttagggaagtggttaatgaacttattgactacaaggcaatcatttttgaaatgccaaggatgatgggggtagaatcagagacggaagaaaaattaatgtgttattttctataaatggaaaggaggaattttggctaattacttttctgaaaattaaggttatcattaaaagtaatatactgacttttctgtagattttgatagctttcaaaacacattcatattcactgtttgatttgattctcaaaacaaccccgggagggaggcagaatacatttttttttttccattttccagataaagacctaagattttgagaagttaaaggactcattcaggattatacagctaataagcagcacgtcaggactgaaacttcagaccttctaactcctctggtcaagtatagaggaaaagtaaagcctgggagttaaaagtgggtttgtaaaatgcggttaattgaaaagaagaggtatagtaatgtaatttagtgagtgagagctcactctggagcagacattgcaaatagaagcctgagataataatgcagcagcagatgagcttgtacaattatggcccaaacaatagttacaaagtttttttcaatttttaacaacatttaaaaattgggacatttcacaataaaaatctagatttctaacctctgttttacaatctgcatagatggccccactggggaacattcccacgcagccacagccaggaggaacttgggagcagctgtccctcgcggatagacatgagctctctggttctcctcaatctcaccattccctgttgccgccagtcctggtgaccaatgatctgtacttttcatcacactacactgctgcttttctccacccatctgtatcacaccctggattctcgaggcatttgaatttgtgtcttcaagtctggaggcagcatcctggctctatccacttctagccatttgaatgtgggcagattactttccatgttaaggcttccatttctatttccattctgtaaaatagggatgatggtggtggaatgtagtggatatctgtttgttgtttttgtttttgttttcccagcattaatcctttccttggaagttcccctcttatgggaataggaagacccgcttgttttttctctagggtgagtgaccctggctactccaatcaaatgtagataaaccagacttagaattaagagttagtgacccaaacaaacatgcatatgtggttcaggttgcaagatctacatcaagtttctagggacggccctggcagatgcatcagtggttgataccattcaaaattcattatcagtacattggtggcttgaactgtaatgcttatgcctaatgtaggaagtaactaggcttccccaactccctggtatgatgtcagcgagtatctctggttgtgaaacttctttgcctggttccctggcccttccagagattttgcaagctctttaatatactgtagtgcttgtcttttgctaattggctcccagatctcttctccacctttctcctattgtactctgtgttgctttaggtaactgtaaaattcatttcctaagctcctgtgtcagcaggtttggaggatctaaggtttatgcaatttgggggccatctttagtcataatacaaaattatacatacaaaattatgtacaaaaggaagtatttattttctacgagaaaaaaataacagtccaggcgtggtggttcacacctctaattctagcactttgggaggtccaggcagaaagatcgcttgagcccaggagttcaagaccagcctgggcaacgtagtgagacctcatctctacaaaaaagaaaaaaaattagctaggtgtgatggtatgcatctgtagcctcagatacttgggcggctgaggcaagaggatccctggagcccaagagttggaggttgcactgagctatgatcacaccactgcactccagcctgggtgacagagccagactctgtctcaacaacaaaaaaaaattaattaatttttaaaaatcacaaaaaattacaaaacttaaaaatttactccaaattttaaaaatcaagaacaaataaaaaagaaaaagctggaaaaataaggtcatattttattagttaactgttgagatatatctcataatattttcctagaatttttagcttcatcatttttgtttcttttgataacagttttctataggaaaagcagaaatataattgtctttcctcactatgctaattggaatttacttttttattattgacaatttagaaacattcccattcataacgttattaatgttacataaattgttaggatcattgtcaattgtgggaaaacctctatcaagctattttcacaggagagctgtaagattttaagatagtttaagtttcttgtgttgcaaccaatgagtctgtcatcagtttcttggggttaagacatctgaggtgaatgccaggtaaaatggcacaatggatgtgtgtggattactacagtccattctaacaccaagacatcaacaaaaaccttttttttcctcctatctaaatgtctggtggagtatttttttatatatatactttcattttttaattttttaaaatactttcaacttttattttagactcaggtgggtacatgtgcaggtttgttacatgggtatattgtgtgacactgaggtttggggtataattgatcctatcacccaggtggtgagcgtagtacccagtaatttttcagtccttacctgcctgcctcctcccctctcttgtagtccacagtgtctgttgcttccatctttatgtcgctgagtactcagtgttcagctcccacttatgagaacatggatgtagctggaggccattgtcctaagcaaattaacatgggaacagaaaaccaaataatggcctccagctacatccatgttgatgcatagggcattattttattctttttaatgtctgtgtagtattccgtggtgtgtaggtaccacattttctttatccacttggtggacatttaaaattcatgctgaatgtggaaaaattcttaagagtacggggcagctctctgtctataggctctctggcatccccagtcttcacacaatgcaaaaaaaactgtgaatgaaatacacacatcccactagacagaaactaaatgagtcctcagctcaactccccctaaccagtccctagataggggcttacttgagaagtataatgcaggggatagcaaagtacaaaaagaaagcactcgtaactatttaaattaaaatactatactttttcgaattgtagacatacgaccatgtacacagtttgctagcacccctcccaggtcttggaaggggtctgcacagtgagtggctcagaagcttgagacttcctaacttccctctcaatccacttatctttttacctaatttggccaaaaggaagcactggcaagagatggaagagctcctgggtttttggataagaccatttacttctccagcctaggatgcatagtgcttcctgcctctgttaatctttttttgagacagagtcttgctctgtcgcccaggctggagtacagtgccgcagtctcagctcactgcaacctctgcttcccgggttaaagcgattctcgtgcctcagcctccagagtagctggaattacaggcatgcaccaccacactcagctaattttttttttttatttttagtagagagggggtttcactatgttacccaggctggtctcaaactcctgacctcaagggttctgcccgcctcagcctcccaaagttctgggattacaggcatgaaccaccgcacctgacctacattaatctctgtcaccataccatttagttttcagatcgtctaaaatatttgtaactacttgccacattaaattcattctgtcagtcacctagatccactagactggactctggtttatatttgttttttgatcaaagaatatgctcagaaatatttttatatttctaaatttggcctaaagattttgtacagatagatgtctattgtctgtataagctttttttatgaggcaccttgttaagcccacaggttgatctgaggaccattgtatctatgtatctttattacatatttatgtaatttttattccatctatctagaggtagggagtgtaatttttctccataattgacagagcatgccaaaggtgacatatagtattagaggaaagccttaattatgggtgagcacaaaccacaaccctctaaaacacaagataaaataaatacatgcaataaggccaaattattaaaaatggtacaaagtggagtctgtaaatattttaagccaagtcatctagtaggattaaggcaagaaacagaaaatgaaattttatttaatttggaaaagcatgcctgggggaaataatgtataattcagatatatctatagaagagaaaagccaggacgataccgatgctgaaagaggattcagaagagtggggacaacagatttggtgttctcattgtcatcagatggtaacaatattttatgggcataaattagaccacaaactgatgagagaacagcacatttggtattagcagttgacagtaaaaggaaaagacgtagcagtatagactggattgcaagggactgacaaatatgacaatgacgagattttctacttctttaaatttttgtccttttctgcattggagacattttaataaatggaaccgatgactataaaggacagagaaaatgatttaagtcctaaaattcaagaaggaactctaagaaactatccagttaaccgtctcattgtacgatgaagaagtgagggttagacagaataaattattcaccccaggtcatttagccaaccaaggtcctctgcttcccctcagaatttggtttatgtataaatttacaattctataaatgttgactgagggaaatcttataactaactgttaagtatttgattattataagtcgtgtaaaagaatacaacatttttgcatagataaaagcaataatgtaatcatagaaagtatcttattataagtgttaggtgccttgtcttattctttgtgttcttggtgcccgccttgtgtctggcacagggaaggcattaaataagtaggatagtcactaaatggatcattggctgatgactaggtggttggatgaaagggagggagagaggaaggaagggaggaaggaagcgaaggtaggttaataaggacatacaaatgggaaatgtaatctggtccctaatttcctgaggaagaattaactatgccagttctgggtcatgctatctcagattgacacagcaacaaatacgtattttaatcttgaacagcaaagacttcatatccagcattataataaagctagtctcatttcatggtcaaatctcaaagacttgagatcgccgagtgagctatctaggagtgtcaataacatgggtagtaaccatttacctaaaattacagagacctcacaatccatgactaagtggaaggataccaaattagtgaagaatctgaattacaggacacagttttcttgcttttagatacatataggaaatgggagtaggctaatattatctaaaagagatcattcgagaaaataattttcattaattgataagaatttataattatcatctcaactattagtaaaagaatgtctcctacaaacttaaggctattttgaaatgcttttctggtataaaaacattattggggtacctcttttacactatgaatcacatgtgcaaaccttgttcttcacaccacccagcctgtctgaattttcacaaatgcggaattagtggaattagtctgaattgatgaagctttcccagacactgctgttgttggaaacaacaggcatcctattgaatagttaactagagattttgaatatgtgttacttagaaaaagtttcaactgagcatgagttcctccagcaaaatttgtccgtctcactgatagtgtaataatctagtacactttttaaattaacgaacagaaaattagaggaaggtctgccatttctttttctctttcctccctctttatgtatagctgagttcagtcaccatcagcactaaattccattcagagttcacagccatcacgatagctagtgcagttttaggttaagcatattttatccataaattgctatatttggttctcgagttattattgcagttccttggggtacatttaaatccaccttattgtaatagattatggaatatagtggctaatgtgtctaatgtaaaataaatgactataatgatttatgatgcgacacttcaattttattgaacataaggatcattgtactaaaatggatggtgtattgctggtttagcataaaatactgaataacatattcaagaaaatgaatggctcggccagttcataatattctgccccttcagctgagaggtctttaataagcaagagtgtcattacacttggaaatgtatgtgtaggtaatccattatctagaacaatgacagggatctgctcaagtccttattaaagaaggaaatctttaggagcaaatgtagaattctttggtcttcttgaaagaatgattttctcccaaccacacagccaccataacagtgcttagcagaattgtaagtggcctccacatttaaaaattaccaccctgaaactctctcatgacctgcaagacagaagggaatttcaaaaaggttttgattttttcagcattgtcatcagacaatatccttaatgtccttttctctgtgtgtcaatttaccaaccttttattttaactcttgtagtgcccagcatagatagtaactcatgctctgtctttccccgggactccatgtttatgtttgatcactgaataattagatttaagaagacgtaatttagctgttaatgcttattaactataatattaaagatgattttcaataatatattggaccaatttatttgtgttctcagacctgaggagatgaaagaaaattcttatatggcaaatgatgtgtttagattaatggtgaagttttatcctccgaatagttgggggacatgaggaataagggaagtgacatgcatgttttctcaccctcttatcctggtgattctgagatcctgccatcaaaccctcaggtcctcccaggatacagtttaatggcatagacgatgcccacataataactaaatccttgtgggagtatcttaatagcatccatttcattccctggaaagataactagtttcccttctgtggaatggccatgttgagacagggtgagggggctttgagtattttgaatctgacagctgcattatgggtaagactgtcatcaattctccttctcaacacattgttagtttatgcctattctccatctcttagcccagacaatctcatctgaccaaccaaaattaaagagctgtcaggtaccataaaaacccacgaatgagggtcttttcctcacaggcctaagaattccgttcaacatgattgcatgcgtgcatggcagttttgattttttttctcctgaatagcagacttcaccacttcctgaaaagacacagatcttgatgagaaagtgatctgatgatgaaacgaaccctgcatttgtagagttaaggagttttgccatccagaaaggagagatattcacagtggattctgtactgtgtgagttgcagacagacatttattgattcaggatatactctcagtcacttctttttattcttttgaaaaggtgatctagcctagaactattcatgagaaaaagtaactagcactatctcaatgtcacagcttaatttgggtggtcaaaagcttgccgtaaatcagtctttctggaacagtggggacattttctctgtaatgaactaaaaaaaataaggatcatcttttttttttttttgctaatggatgttttgcctttggatcttttgatgcatcagtctagaccaaggcaagcgctgctaaggaacctctgaccccaaaagtcaccccaacctctacaacatccccatacccacttcctcatctttaggattcctctccacagcaaattctatgcagtcattgaacattgccaggatgttttcagaaagaatattagggcattttctttttttccttacaccttcattatcttcctcaaaatattatagtaaatttaaatggctcataatgtcttatcaccaccccataagatattattttctctgtagtagtactttcacaccagcttcagattgaaactctggctgatcgtctttagagctgatccatgctatttgactgcagaaaaggagctttccagggccaggacatacaaccgaaagtttggccaatgagaggcctgtctgccctgactccattactaattcaccagtccctgacccaggatttccaacatttttcccttctgccattttcttgcattttactttgttcctcatgtcaaatatttactttattattgcttctaaatgctacatctcatttctagtaccaaagtgatatttagaatccaaacttctatatatgtgaattcataggtagaattattcatgttaacatacctctcaaaaaagtgctaaaggagctttttgtgaaacctggggtttacttttgtttgtttgtttttgaccagagatatgatttgggttctttcccagtgaactcatcggctcctgcttccttcagtcttgcagcgtatagtcaaaccccaggcaaagcctcaatgttcatcacttaatccctttcaaatactttgatttatggaacagaggatagaacctggaaaattctgaggtatccacccaacattgatatttaagcatgctcattctttatatccttctttgaattataggcctataagtccatcaaaggaactttgggtttccctttcggagcactttttttccaagtggtataaccccggtgtggaactctgtgtttaacaagcagatctttttcagtacaaggcacaataagtttaggataagcttagaaaccatcagggttttccagtacaattattcctgagttaaacaggacaatgacccattacaagttatgtgtgatgcattcagactttgggaacttgaccaaaatgactttgaaatgtacagggaaaaaccatgatcatttacctggatggagtagtaaggtactgcttccgccaagccaaaggtaactgaatattggtataatacactgtcttttttgttgaccaaaaaatttaaaatatctagaggaaaatttaacagagataaaaataacatttttaaattatgctatcaggtcggtcacggtggctcacatctgtaatcccagcactttgggaggccgaggcagtccagtcacctgaggttaggtgttcgagaccagcccagatgacatggcgaaaccccttctctactaaaaattaaaaattagccgggcatggtggcaggtacctgtaatcccagctactcgggaggctgaggcaggagaatcacttgaatctgggaggcaaaggttgcagtgagccgagatcatgccactgtatcccagcctgggtggcagagtgagactccatctcaaaaaataaattaaaaaaaaattgtgctgtcagccatttgagtcttgaatcaatgcaaagagaccttgctctttggtagaaagctcagtgttgtgaagttgtaacttctccccagaagaagctataatttcaatgtgatgttctctaaaatttaaaaaaaaaaaaagacaaaaagattatttggggaatttgtggaggcaggcagtagaaggatggatgctaattgatgtgatgattctgaagttcatctgaaaaaattaaaagataatagttgaaggaaaaatgtttgtagaaaaaaaaagacagaaggaaagaccacctttccatgaaataaaatgcattataagcaacagcaatcaaaacagtaagttactggagtagcaagatgaatagcgcagcattgggtctggaggtattcccaaatacgtatggaaatttggtatatgaggtgggcattgaaatgagtgatgaaaacatatactatttaataaatgttggggggcgggggggaagcaagcttcctacctcattccttccaccaaaataaacctcagataagccatagagggataagtgattgtgatgaagaaaaagaaagttgagattgcaaagttctaaaagaaatatgggtctattttatacttagggagagaggacctttttaggagtgacatgaaatgcaagagctagaaagtaaaatattgacttgaccacaaaacaaaagtaagttctgattttcttactggccaagtacattcatttatatatcagtatacacattggcacacatatataaatcatatataccattttaatttctccaaatagatccctaatacttatgtgctctggaaggatacaaacaaaattttttactatgactttgggacaatcttttaattaattttataatcatatttttataatggcataagcatgtattgcataaacagtaaaatctgttgatattgtgtttaacttgtaatggcccataattcaatggttcttagtttttttaagataaacactactttaagaatcagaagctgtggccccgatcctctgacaagagcacataagcacagatacccaaaatgcaacatgagttggaaatccctgctctaaatagttctaaagagagttggtcagtgatctattgctgtataacaaaccaaccccaaacttatttgcttaaaacaagaaccattctattgcctatgattctgtgggtcaaaaatttaggcagcactcagctggtccagtttgtctaggcttcatgtggggttgtctgcacattactggggtcagaggatccaaaagggcctcacctacatgtttggggccctggtcctatctgttggcaggtatgcctcagtgctcctccattggcctctctccaacagaatacccggggctcaaggcaaaaacatggaggctcaaggcaaaaacagaagccatgtgatctctgaagctctgggcccagccaacacacagcatcactgtcaccacattctgctggtcaaagcaaaccacaggaccagctcagaatgaggggaaatagacccaaggtgggaggaatggcacagccacattacaaaaggacatgtgggataagagcaattgctgtggtcattattaaagaacagcctaccacaatagaggtctctgaaaatgtgccacttttagcaacaggtgaatttttccatttgtgccctaacattcatacgcaacaaaacatagtaatctgagtgactgtacactataatagtagtctactcagtttaaattcccaaggattttcttataacatattcaaaatcttccaaaatgaaaactatgaaagtatgcatggaatgggaaagtagatgccataactttggcttgtatatttcatccattttgatatgaaacattttccataacttagctctagtttagaactcttcagaaaacccacactgtcctagataatgaagggccacacatttttatagtggacctctatgcccacacgaagatgaagagctggagaaaaaacataaaccacagccctaaaatggatgaacatagggataagatttagaaattaaactaaatttatgacttcaaaacccaagaagacttccagttaagtgtggtcagcttaactacaagtttatctcccttcttaaacaccattcacattctagtacctcaatattaaatgacaataggcaatcaaggatcaccaagcacatgaagaaagctctgctaaactagaaagcaaaagtaaacaaacaaaggtgacactcaaggaagcagagataataaaggaagtggaagaaaatcaagaaaatcattgatttctagtctcggatgaattagaagatactgtgtactattgaagagcaggttcagtcagatctcctcctctctggctctctttgtcatctctttttgacttctggaaatgtagattcctgtgtggctgtctctgatggcatcatcaaggtatccaatgacatgaaggtacacaagttgttgacaccagaggagttgaagaagctcaagaaggtggtactcttctgcctgagtgaggacaagaactcatcctcaaggagggcaagcagatgttcgtgggtgatgtcagccagactgtcagtggcctctccaccacctctgtcaagatgctgccagacaaagactgccataacgccctctgtgacgcaaactgtgagacaaaggagagcaaggaggaggacctggtgttcagcttctgggcctgagtctgcacccctgaagagcaaaatgatctatgccaactccaaggacactatcaagaagaagctgacggggatcaagcatgaattacaagcaaactgctacgcggaagtcaagaacgaccgcacctttgcagagaagctgggaggcagtgccattatctccctggagggaaaccctttgtgagcccccttcctggaacatctggaagccccagacctgcccacagggattccatgctgccctattcctaacagacaggaaggggctggagaatctcagcagtgggagagcaatcctttcaccccagctgccaaacagctccccaccaagccctgccttttcctctcccctccatccctgacagttccggccttcccaaattacctttgatcttctgattcttcttgggttgaagtgttaacagaaaggagtcctgatccagacctcaagagagcgttcttagatctcatgcaagaaagaatttagggcaagtccacagaataaagtgaaagcaagtttattaggaagtgaagaaacaaaagaatggctactccataggcagagcagtgccatgggctgctagactaaggatacttagttattgcttgattatatgctaaacaaggggcggcttattcatgagttttctgggaaagaggcaggcaattcccagaactgaggatcccttccccttttaaaccatatagtgtagcttcctgatgttgccatggcatttgtaaattatcagggtgctggtgggagtgtctctcagcatgctaatacattataatttgcgtgtaatgagcagtgacgacaaccagaggtcattttcatggccatcttggttttggtgggttttggctggcttctttaccacagcctgttctatcagcaaggtctttgtgtcctgtaccttctgctgagctcctatctcatcctgtgacttagaacggctaacctcctgggaatgcagcccagtagctctcagccttattttacccaggccctgttttatgatggagtcgatctggctcaaacgctctgacagaagcagaccaaataccccccaggcacttcattttgtgggggttttttttttaataacaccccaactcctcatctattccttatccttcctctgctgccaacttctaactgcagtgcttactcgtgcttgtctgttgagttgtgtgtataaatggaatgttgtggtgatgagccctccccatgccactggttcttctcccttttttcctggtcatggccacttgtggaagcaggaccagtagggtaccttcagtttgggggttgttgggggaagccaaaaacaaagtggggggcggggggaagaaagagcttttggaaataaagataaaattaccaaagtgaaacaacttgttaaatgccagttttcttatggactcagttttagctaagtccaagaccaacagattccaaatcacctgttgagaccatgcaagagaaacggaagctgactgtacatcccctatcatcacctacctgaagcatatatgaaagaagataaggagatttattgaggaaggctggtcatgagaatttcttaaagagagttaccagtgtgttcttccctgcttatctcccccttggaaagaaaggggattgtcccctctaccccagaagtgaagtgagttgacttttagagaaatactcaaagatattgctgtatatctccctaaaattctgaggggcagtgtgattggtatccaactggacctgctaaagtcaaaagtgggagggaggctgtctagagttgcctctaacagtagaacaaagagaaaggggtgcagtgagggcttgctgcatctcactgatagttggacaaaggtttatatttcctgaaggttgcatgtggaaaggaacagaaattgagtcatcctgaaaaggacctctggaaagacaagatgtccccagttgtttattaagacaattgtctaatttagactatttttaatacttggaaatggcccaagttcctttcaagggtagagaaaaagttaaaaataatatggttgacaggctatggtattaaaaagtaaattaaataacttcttttcatgatttacaccttaaaagtccaactgtttttcagcaaagtagttaccttggtggtttcatcattctttagcatctccctagtggatctgttggcaccttttgttgtcaatccctggaatctctcctgaaacattggtacaatgagaaaactcccaatgaacatccttttatagaaatgaaaatatttaataggtaggctggatgacaatatcaagaaacactcacaaaatgtaggataaaaagacacagggatttttttttttaattttattattattatactttaacttttagggtacatgtgcacaaagtgcaggtttgttacatacgtatacatgtgccatgttggtgtgctgcacccattaactcgtcatttaacattaggtatatctcctaatgctatccctcccccctcctcccaccccacaacagtccccggtgtgtgatgttccccttcctgtgtccatgtgttctcattgttcaattcccacctataagtgagaacatgcgctgtttcgtttttagacacagggattataaaagtaggagggagcagggaagagagatttagatcagcccagaacgtttaacatttggctattaagaattacagggagaaataagagaaaacgaatgggaagaaattatttttttttaaaaaaagggaatttcctgagaactgaagaatacaaaatttcagactagaagggcaagatgtctgggtacagttattgaaaaattttttaaaaagattcacatcaagcagcactactacaatatttcaaaataatagatccaaaaaaggagggggaacattataatcaaagcaattggaatcagaaagacatcagactttttaatagctacattagaagagagaaaaacaaaaaggcaatatttttataattctgagagaaaatgactatcgacctagaattctatacctgccaaaacttttaagtttgagcatggaatagagacgtctttagatacgtaaggtctcagaatgtttctctccactgtactctttactaatctgatcttgaggtttggctttgaccagattaggcagttaactctgaaacagaaaggattcatgaaactaagtgaccaacataaatcagaaatgtaaagcaataatgagatgatgagaaacggtaaagtctcacatgacagctctatgatggctctagaaagaaacaagctgagattggatgcaaacaatgtaattggtatattatctggtctatttgactataggcaagtaatactaataatgaggtatatgaaagaaaattaagagtaggtgtataagcaagtttaaaaagagaagcaactatcgacttgcagaaaaataagcatttgtgtgagaaataaaacaaagtacactagttggctttgcagtaaaaaatacacagtacttataaacactatttaacaaaaaccttatcaagaattataaatatttctaaagaattattagcaatacaaattttcaaatgaagtaagcaggaggatggtataagagagctaattcctcttgtcccataaagaatatcaatatgcagtataaaattggtgtattaaggaatggcaatacaagatatttggcaacctagagatcaggataaacggatgagcgatttaagtagttgcctctaggccgggtgcagtggcttacgcctgtaatcccaacactttgaaagactgagacgggcggatcacctcaggtgaggagttcaaaacaagcctgcccaacagggcaaaaccccatctttactaaaaatacaaaaattagctgagcatggtggtgcacacctgtaatcccagctactagagaggctgaggcagaagaattgcttgaacccaagaagcagaggttgcagtgagctgagatcatgccactgcactccagcttgggcaacagaggaagtctctgtctaaaagaaaaagtaaaaataaataagtgaaataagggggaggttccaagatggccgaataggaagagctccagtctacagctcccagcatgagcgacacagaagacaggcaatttttgcgtttccaactgaggcaccaggttcatctcattggggcttgtcagacagtgggtgcagcccatggaacatgagccaaagcagggcggggcatcactgcacccgggaagcacaaggggtcagggaactccctttcctagccaagggaagctgtgacagatggtacctggaaaattaggacactgccaccctaatactgtgcttttccaatggtcttagcaaatggcacaccaggagattatgtcccgtgcctggctcggagggtcccacacccacagagcctcgctcactgctagcacagcagtctgagatcgaactgcaaggtggcagcgaggctaggggaggggcgtccaccattgctgaggcttgagtaggtaaacaaagcagccaggaagcttgaacagggtggaacccactgcagctcaaggaggcctgcctgcctctgtaaactgcacctctcagggcagggcatagatgaacaaaaggcagcagaaacttctgcagacttaaacgtccctgtctgacagctttgaagagagtagtggttctcccagcacggagtttgagatctgagaatggacagactgcctcctcaagtgggtccctgacccccgagtagcctaacggggaggcaccacccagtaggggctgactgacacctcatacggccgggtgcccctctgagacgaagcttccagaggaaggataaggcagcaatatttgccgttctgcagcctctgctggtgatacccaggcaaaaagggtctggaatggacctccagcaaactccaacagacctgcagctgagggtcctgacttttagaaggaaaactaataaacagaaaggacatccacaccaaaaccccacctatatatcaccatcatcaaagaccaaaggtaggtaaaaccacaaagatggggagaaaccagagcagaaaagctgaaaattctaaaaatcagactgcctctactcctccaaaggaatgcagctgctcgacagcaatggaacaaagctggatggagaatgactttgatgagttgagagaagaagacttcagacgatcagtaataacaaactcctccaagctaaaggaggatgttgaaacccatcgcaaagaagctaaaagccttgaaaaaagattagacaaatggctaactagaataaccagtgtagagaagtccttaaatggcctgatggagctaaaaaccatggcacgagaactacgtgatgcatgcacaagcttcagtagctgattcaatcaagtggaagaaagggtatcagtgattgaagatcaaatgaatgaaatgaagtgagaagagaagtttagagaaaaattaataaaaagaaatgaacaaatcctccaagaaatatgggactatgtgaaaagaccaaatctacatctgattggtgtacctgaaagtgacggggacaatggaaccaagttggaaaacactctgcaggatattaatgagaagagcttccccaagccagcaagacaggccaacattccaattcaggaaatacagagaactccacaaagatactccccgagaagagcaaccccaagacacataattgtcagattcacaaagttgaaatgaaggaaaaagtgttaagggcagccagagagaaaggtcaggttacccacaaagggaagcccatcagactaacagcggatctctcggcagacactctgcaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcacaaccaggcctgccctacaagagctcctgaaggaagcactaaacatggaaaggaacaaccagtaccagccactaaaaaacatgccaaattgtaaagactatcaattctaggaagaaactgcatcaactaatgagcaaaacaaccagctaacatcataatgacaggatcagattcacacataacaatactaaccttaaatgtaaatgggttaaatgctccaattaaaagacacagactggcaaattggataaagagtcaagacccatcagtgtgctgtattcaggagacccatctcacgtgcagagacacacataggctcaaaataaagggatggaggaggatctaccaagcaaatggaaaataaaaaaacaaacaaaaaaagcaggggttgtaatcctagtctctgataaaacagactttaaaccaacaaagatcaaaagagacaaagaaggccattacataatggtgaagggatcaattcaacaagaagagttaactgtgctaaatatatatgcacccaatacaggagcacccagattcatgaagcaagtccttagagacctacaaagagacttagacccccacacaacaataatgggagactttaacaccccactgtcaacattagacagatcagcgagacagaaagttaacaaggatatccaggaattgaattcagctctgcaccaagcagacctaataaacatctacagaattctccaccccaaatcaacagaatatacattcatctcagcaccacatcgcacttattccaaaattgaccacatagttggaaggaaagcactcctcagaaaatataaaagaacagaaattataacagactgtctctcagaccacagtgcaatcaaactagaactcaggattaagaaactcactcagaacagctcaactacatggaaactgaacaacctgctcctgaatgactactggatacataacaaaacgaaggcagaaataaagatgtgctttgaaaccagtgagaacaaagacacaacataccagaatctctgggacacatgtaaagcagtgtgtagagagaaatttatagcactaaatgcccacaagagaaagcaggaaagatctaaaattgacaccctaacatcacaattaaaagaactgagaagcaagagcagacacattcaaaagctagcagaaggtaagaaataactaagatcagagcagaactgaaggagatagagacacaaaaaacccttcaaaaaatcaatgaatccaggagctggttttttggaaagatcaacaaaactgatagaccactagcaggactaataaagaagaaaagagagaagaatcaaatagacacaataaaaaatgataaaggggatatcaccaccgatcccacagaaatacaaactaccatcagagaatactattaacacctctatgcaaataaactagaaaatctagaagaaatggataaatacctggacacatacaccctcccaagactaaaccaggaagaatttgagtccctgaatagaccaataacagggtctgaaattgaggcaataattaatagcttaccaaccaaaaaaagttcaggaccagacggattcacagccaaattctaccagaggtacaaagacgagctggtaccattcgttctgaaactattccaatcaatagaaaaagagggaatcctccctaactcattttatgaggccagcatcatcctgataccaaagcatggcagagacacaacaaaaaaagagaattgtagaccaatatccctgatgaacatcgatgcagaaatcctcaataaaatactggcaaactgaatccagcagcacatcaaaaaggttatccaccacgatcaagttggcttcatccctgggatgcaaggctggttcaacaaacacaaatcaataaacgtaatccagcatataaacagaaccaatgacaaaaaccacatgattatctcaatagatgcagaaaaggcctttgacagaattcaacagcccttcatgctaaaaactctcaataaactaggtattgatgggatgtatctcaaaataataagagccatttatgacgaacccacagccaatatcatactgaatggacaaaaactggaagcattccctttgaaaactggcacaagacagggatgacctctctcaccactcctattcagcatagtgctggaagttctggccagggcaatcaggcaggagaaagaaataaagggtattcaattaggaaaagaggaagtcaaattgtccctgtttgcagatgacatgattgtatatttagaaaaccccatcatctcagcccaaaatctccttaagctgttaagcaacttcagcaaagtctcaggatacaaaatcaacgtgcaaaaatcacaagcagtcctatacaccaataacaaacaaacagagagccaaatcatgagtgaaccttcattcacaattgcttcaaagagaataaaatacctaggaatccaacgtacaagggatgtgaaggacctattcaaggagaactacaaaccactgctcaacaaaataaaagaggacacaaacaaatggaagaacactccatgctcatggataggaagaatcaatatcatgaaaatggccatagtgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagacatatagaccaatggaaaagaacagaggcctcagaaataataccacacatctacgaccatctagtctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccttagaagaaaacctaggcaataccattcaggacataggcatgagcaaggactttatgtctaaaacaccaaaagcaatggcaacaaaagccaaaattgacaaatgggatctaattaaactaaagagcttctgcacagcaaaagaaactaccatcagagtgaacaggcaacctacagaatgggagtaaatttttacattctacccatctgacaaagggctaatgtccagaatctacaaagaacttaaacggatttacaagaaaaaatgaaacaaccccatcacaaagtgggcaaaggacatgaacagacacttctcaaaagaagacatttatgcagccaacagacacatgaaaaaatgctcatcatcactggccatcagagaaatgcagatcaaaaccacaatgagataccatctcacaccagttagaatggcaatcattaaaaagtcagggaacaacaggtgctggagaggatgtggagaaacaggaacacttttacactgttggtgggactgtaaactagttcaaccattgtggaagacagtgtggcgattcctcagggatctagaactagaaataccatttgacccagtcatcctattactgggtatatacccaaaggattataaatcatgctgctataaagacacatgcacacgtatgtttattgcagcactattcacaataacaaagacttggaaccaacccacatgtccattaatgatagaccggattaagaaaatgtggcacatatacaccatggaatactatgcagccataaaaaagggatgagttcatgtcctttttagggacatggatgaagtaggaaaccatcattctgagcaaactattgcaaggacagaaaagcaaacaccgcatgttctcactcataggtgggaattgaataatgagaacacttggacacagaatggggaacatcacacactggggcctgttgtggggtggagggagcggggaaggatagcattaggagatatacctaatgtaaatgacaagttattggatgcagcacaccaacgtggcacatgtatacatatgtaacaaacctgcaggttgtgcacatgtaccctagaacttaaagtgtaataaaaaaagtaaaaaataaatccttaatgtaaaaataaataaataagtggtttcctctaaaaagtggagcgggaaggaaaaaaatgagagttcatgtgtgttgggaattttcttaaattgttatctttcttttggcaccgttttaattatgtatgtatattactttcacaaagaaatttaaaagaaatattcatcatggcttcattcaattcaagctagcattatgtgttggtcaccttcttttttcagatcagtgtgagttgtggagaatgtgaagataagaaacaatttgactttctgttggggttacttagggatggggagagacagaggttagaggagtcaagagcatgggctctggtgttaggtgggggtgtgaattccagcccccacccatgctggctggctgaccctgggcaacttctctctgcctctgtttcctcagctataatatggggatggtaatagcacaagcatactgtataggtttggtgggaggcttaagtgagtgaatggatgttcagtgagtgctttggtgtgtggcacataccaaatgttcaataagcagcagttatcactctcttatgtctctcatgatgacacacacatcatgaaattctaagcacaatgctagaaggccatcctaagtgcctagaaggcagagccagtggatttttaaaaattaattcttggataaaaataattgtcagttgcagggcactgattatgaactgaaaagctttgcagaagcaatccactgtgtgagagacctctgtggcccggcatgttggcatgtattttattggcttctgtctcctgccttgtgcatatcaggccaggtttggcacctcattaccttctcttggcttccccagttccattgtgcagtcacctcttaaattttctgccctagggtaactgctaacagcattcaccccatcttctggctgtcaactgaaaggccactgtgagttcacttcctgagaggggccttgctggagaccaaataacccaaccaaattgccagaatttcacatttactttctgcaagagtggacagggagactctgtttctgcctctgacaacctcatctattatgatctctgctatattctcttcttgtactgatattttgtcacctatgtggccagggaacagtccacaggaaaatacaggagaacatgtaaagcatttaaatggggaaataatttagtagtatagccatacataaactttcaaagtctcattaataaatgttcatttatttgagtattatccatcctctaaaacacaggtttttaaaacatatataacaagtgttagagttcttttagaattttcctaataggtttttttcagttttcaccagaagacacccccactggggagggaaaaaaaaaaaaacattcaaagcatgctgtgatcttaagaggaaaaaaggaaataaaattatgtattccatatgatcttatctatgtaagaagagaaaaataaagacaactggaagaatataaaccaaaatgctaagagaagtcactctcctagagttcagagatttagtagtttttctttcttacaccttttcttttagagatatagtctattatgagaatgacatacatgctttaaaaataagtaataatagcctcaagataaataacacaattaaattccacagataacttcagtacttactattttctaatattttaggtgcttttagagttcaaggcacttgttaataaaatgtattttattcatttagtatttgtttaatggcttcttattgtcattattccttagtagattttaaacctcttgtgggcaaaaatcaaacgttagacttctctgtaacacaacttcctggcccaattcttctttgaggttaaatgcttataagtatttcagctttggagcgggataaggagggatgttccttcctctctgcccaacaacatatggtacttgaaacaaattctcaacaatgacatttggacatttatggccacctctctcattagctggaattccactgaactaatcctaggtttagtgccaattacctaaaggttaatgtggccaagcaataccgggagaattggggtttttccaagaaatggtctgtatcacattatgttcaggatgagagagtgattgacgctgtagaacggctcacttgggagacccagagtgtcctgctgtgctcctctcagaacagggtcctactctgaggcttaagggaggaaagataaaggacaaggaagtaaatgaagctgggcagagtgtgtggacgagttcaataattatttataaatcgccatggatgcagtgatgaacaagtcgctgccctcacagaaattactttctagtagagctaaactccattagatctcagcatcagaatgggatgcccctgaaaagtgagagatttgaggccatgtactaaattagaagaggcaggaacaagaaatgtacattttgctcatctatggatatgtcaaccactattaccaccatcctttttcttaccaacccccacccccacaaaaaagttagaatacattcactacagaatagcaaggcaaaatattccatggatcaacaataatttaaaaagtattgtatgtataaacatgattctccaattcagaatcctaatcacaaccattatagttaatttaggaagctcttagtaattcagagagaatctacagcatttatttgaaaagttccctcaatgtgtcagaagacctcatcttacagggctttaccaatagctacatttagcctcactttctacatttgcaccctcattcattctactcaggacagtcaacttcttaatgtgtctgaaatgcatcgacatcattcccatctcaaggcttttgcttttattgttctctctgcctgaaatgttcttccaccaaatctttacgtggctcttcccctcatatttttcaattacttcttcagacaccacctccttacaaaggctttccatgatcaccctcattaagataccctcagccacctctaaccctttaccctgctttatttttttgtgtgcagcactattacctgaaattataaataccttttttgccctagaatgtacattccaggagtatacgtttcttgtttgccctcttccctgtctacatccccagagccttagaagagtaggtgatttagagtggatactcaataaatatttgttggattaataaattaatgaatttagttgaactaagtttacctagacagaataatcaaaagcgtaggtcaattagatctaaaaactgtaatttatctctacaaacattcaacactatatctttcactgaaccacaggtttcacaataaaatcaccgttattgagcattgaagcatgtgtatgtcacccccctccaaacccccaacacacacacacacacacacacacacacacacacacacagaattaagcaaagtaccaagacataaaagttttctgaaactcatgagctacattttggtcacttagaccataaaagccctaatttcctaatccattgcatttcagcctcttttgcagcaggcatcccatgggagagcaagagatagtatctagaggctgtatttacaaaagggatgctctgctctgaaagtcctctggctattgtcacaccatttgtttttcatgattggaatgtgtggcattattgaagggtgggctgttgtctaaattgaatgggtgaagagaaacagagagacattctctttgccacctttgtagataggcggctggagagtctatgtactgaattacccactgtcaattattgatggtttggctggaatcatttacactctctagttactttgacatctagccaaaaggcagctgccagcctgctaggaacctcccttttaaccatagggaagttcaaaagaaaagattcagcaaaccaaactcatctgcacaagcttctgtgggtttctggaagactcaggtcatgttgcttcttcataagagtttaagtcatttgttcattcacttatctatttaattttatacaggaaaggctgacattcatcagtttgcactaatacaactctaatggttattaaaatactgaaatatttgtgtagtccttggtaagtggccactaccctgagcctttcctcaccagggtcaccacaccagaccttcccaaaatcaccactcaaaggttagcacttggcacagcagggggccttcaaaatcgggtctctgagagaacagttgagatccattctgagtagtagtgctcactactttccatataataaatatttgattatcacctcacctgagactgtaatagcaataaaacttgcacttgaaaggtctatgttctttacttcataataaattcaagactagcttaacagaaatggaagtcacataatctgaaaatattaaattgttttgaaacacccttaaaggagaagtctcccaggatcaaattgtattgccttgtcctaccgaaacaaacctcacttgctaaatgaagtttagcctaaagctgcctccttccatattttaagtttggcctgaaggtttctctgtacatcgtgaagtataacaactggaagtgtaaatactctgtagcctcacttgtgccagtcactgagtttggccagtcaaatgtagccagctgtttgaaccatgttcaagtagggcaaacactgagctgtaaccaattcaacgctttctgtacctcacttctgttttcggaacgtcactttcctttttctgtccataaatcttccaccacgtggctgcgcgggagtctctgagtctactctgactcaggaggctgctggaatcgcaaatcgtttgtttctcaattaaattccattaaatttaattcagctgaagtttttttttttttttaatcacactgtttgcctaatttgagagcatttcccccaaaaaaaggcattctggttttaacacatacacccacaaaggcacagggatcttgctctcttggatcctgtgttatagccgtggtttggatgttaagagtcaactgtattacattcccaggagccatagcattgtacctccagagaaggtctgaagactgggctcaactaatcacatatactgcaatgcttggaaacctattcattttctgggaaaagatcatcctcaacagtttccacaaaactgcataaaacttgcacaactctggctgcagtttttatattgcaatttaaacaatttctaaaaaataagtaagaggcctactgtggaggtgacccaagtttgagccatgcagaaggtcctgaattggtttaaagaccctgccatggacatatgaaaaagaagactgcagcctactagctattggtacagagcatgtaaagcgaaggagaacacgtgggatgaacatcactgatagtaaaatgcagagacctgctgacatgtttctccctttcaagaagaatgaggagtttggtgctcatcagtcactgcactgggctgactacaaaggactctgaaagactaatggaaaaaaaacaggtgactttattgtacttctatacttacctcatcatgttgttttaataatttttgtttctgtaggaagcttccctagtgagttgcttctgcctccatggaatgtaagttcaatttcccatttatgtgaggactagatataaccatcccttcatgctaagccctgttttctttaaaattttgagtccattgttcacaagtgatgagccaccaccatcaggctttcttttgtagagagaggaaataggaatgcgtattcttatcagttcttatgcctctggttttattttacaagcagcatggacatgtgaattaatgtgtggctctgaccaaaacaaaacattacttagaagcaagtgaggactttttttctccatttaaagtatctggctctacaaagcaggaaataaatactttgcctcacttcagcattcctattcttggcagttgatttggctagacaggtgaaaaacaagagagattttagggggaagctctgtctggagaacaagaaggaagtaggtcaaagcctggcaaggaattttagggaggatctcgctttggagaagccattgacagagcttgaagcaaatgaaaatcaagtctcaatttattcagcaaataattatgaggaatgaagctgagtagaattgcctttccaggtgaggttatctgagtgagtacagaatcattctcattaatcattttatatcaggattatcaatcaaatcttctgcagatattttctgtataacctcctaggtgctgaattgtgagctaaataggcgttgtctttgcctctcaatctgtgttcattggaaaggacatgcagccagcagaacataattaactgaacactcaactttgcctctacagcttcttctgtgttgtacctgagcaaagcaatacgatgagttcttggagaccaaaagtcttctgttactcatatctaaactgtggcatctaagaccgtgcctggcatgaagcagacctttaatacttgtctctggagtgctcaaaagaaagaagtacagaggctgtccataaagtctggaaacataggtgaatatacataagatcaccaaggacatcttccatctgtgaaaaagtgaaatagcattatatatgtttccagacattgtgaaatactgagtagaaaaaggttgtggaactcatggtttattcagggtgagagccagagagaatttgccacctattttgtcttcagcaaagacttcctagaagaggttttaaagctctttgaataaagcaagagggcttaaaagtttaccaaaggaagggttggggtgaaagatggacaggaattgatgacttctctctgtggtgtgactgactctcctattcatcttccaagtctttatttaaatcagtagttctcaactggggataattttgcccccagggatatttgactatgtttagaactacttttggttgtcacaactggaaggggaaagccaccggtatctagtgggtagaggtcaagggatgccactaaacctcccactatgagcaaaacagccccccataacaaagaattgtctgacccaaaatgtcaaaagtgctgaggcagagaggccctggtttcgttgagccttgggaaagcttttcctgacacacctcaaactacgctaatttcctgtaatatcctcattttactttgttctttccctacatagcatgtatcacaattataattaaatacattgtatctgtctcttccactaaaacaacacttcgtagaagaagaaatgtatgtatcttgttccccattgtattgtagcacctattacaatgcttgacacatagtagatcctcaataaatatttactgaatgaatgaatccatcaagaaataactaatatggaaaaataagaaaaagagatactcaagttgttaagcagactgcagtttcaggaatcacgtgaagtttgaccagtgatcttggatttctccatttcagttcaagaaagtgatgagtttagtcacagtatgaagggaaggtagaactaataaactctatgtataacatttttaatttatagacttattgcagtatttcagcattttagttctttatcactaaaggaacttggatgccaaccctttcaaaaaatctctgggagttgaaccaggattgatcttgtggcaaagaatcttcatcggctgctaggacagccattcagtctcactttcccattctctcttacagccgtatgacaccattttggtcaacaggataaaaagcagatctgctgagacaggatttctgggaaagcttttgcttttctgttaaaaaggagaggcaaaacaagtaccaaccttcttttttttattcctggttggacccaatatcagcaaactgcctatgcctgcactaattattaaatgagaaaagtataacccacctctatttaagccactgtaattaggttttctcttacctgcagctgaacgcagccctacctatgatacatttttctgccttggtagctaatctttttttcatggtctttttaatgatgcaaaagcagaaacagagacggtaggtagcacagcttggcctgggcttaatctcatctgaagtacaaagaaaatagaaggatctaaagtggtagaggttgtagccttgaaagatttgtgatggagcccagtgctgctttgtggtgagtatcagaaaaagagatgccagagctcatggtttaagaggggggaggggaaaagtattcataacacagtgtggctgatttcctgtttacattttgcaagtactttgtgtgtgtgtgtgtgtgtgtgtgtgtgtgtgtgtgtgtgtgtgtgtgtaatgctgaggcagtagttagaatatgagggttttaggtgcagttttaaaggttctgcatggagggaaagacctgaacacaaagtggctactctacaaactcttgtggatacaggtttcaaagcacttctaccatcttctgctcttctctctgctcttctactctaggctatgagaatcttggaggtaagaaccatgtcttgttgctctcagtttctctggtcccagaagagtgccatgcctatagcatattatcagtcaatattttcccaattaaacacttacagttttctccccctttgtctttaatgcatagttgtaaaaaagaagagatgtaattgaagtctggaggagattaatttcatttctttccctcatttctggcttttttttttacaagcagtatttcctatattttgaatagaacatgaagccctgagttagccaaaatgcttaagaaaaacttttttccagaaaaaaaaattggaaaaggaaattttcccaaatttatgttccacagaacccagttccttaaaataaatacattctttaatttgagcaatattggattaaatagttacagtgtttgatacactaatgtatgttgtatctttctaagaggtatatggtttgttactcttcaagtccgtatttaactatgtaaccccaaaaggattccaggacaaaaaaatcagggaataatgattatctaattattaatacatgttcaggtgtggcaaagtttgggagctgctgttttcgatcgtaagtcttgtcatgaggaaaatacaagggccttggtgaagaaggaactaaaaggaaagaggatggcagctcagaaaaagggaaattgaagcagacaaaaagacccagaaattatgacaggaaagtgtagtttgatgcctgccatcatggtctctaaatgtgtggcatatccatttggcaaatggagaccaaagaatttatgtcggcagaagtgttaggctaaggatcaggagcctggcaatgtactccagaaactttctttaaatgacttgtgtcacttctccaaactaattgcctcaggggtgatggggcatattaaactcttcatttcttctttcatgcaatcttatttgaaatgagttacaagctaagttgctggagaacttttgagttatttcaagaagatagtcacatcatacgtatgaaaaaatttggtgctttgtttttttaaaaagttatgtttattaatttttgtctgaggtccctgagaatcttaggcaagttttcatactaacaaattaagagcaattaatttctaagtagtgtttatgtctgagagattggtaagtggttgagctaattaacaaaataacttatcaaaatgcatctgccacactctactgcggtatgcctaatgatcattgtgtcagtggtaaactgagtcaggaatgggcctacaattcatgtttcagaagtgctcagtttggtatttgttgacaaattttaaagcacaaaaagacaaacacatgttttttccttttgactgaatttgaaagttccaagatgggacccctaaagccatgaacattgacacagcttggcaagc

SEQ ID NO: 1770 - DNA, 267393 bp, Homo sapiens
  KIAA0804 gene - 186025123 - 186252515 of chr3; NCBI Entrez Gene ID: 23355; Build 35; sequence includes 20,000 bases upstream of initiation codon and 20,000 bases downstream of termination codon of the gene
gccggggtgcagtggcaccatcatagctcactgtaacctcaaactcctgggctcaagctatcctctcacctcagtccccagagtagctagtactacaggcatgtattaccatgcttgtctaattttcttatcttttgtagagatagggtcttgctgtattgcccagcctggtcttgaactcctggcttcaagtgattcttccacctcagcctcccaaagtgcgaggattacaggtgtgagccaccatgaccagccagaagtcacttctaagatcaacttacaaaagactgtggcttccatctccctgacattcttgctggctcttcttgcttgctcacttggatgaagcaagctaccatgctgtgagctgtgttatggagaagcccatgtgacaaggaactgagggccctctgaccaacaaccagtgaggaactgagaccctcagtccaacagcctgtggcaaacagaatcctgccaataatcatgttagtgatcttggaagaaaatccttcccaatttgagcctggagatttctacagcttgggccaacaccttggttgcagacttgtgagagacccaaaccagaggacccagtcaagccatgcccagagtcctgacttatagaaactataagataatgcatgctattgattcatgcctctaatttgttgggtagttacacagcaatagataactaatataccttctttcttcctttcttcttccttgctaattggaaaatggatgtgatagttggaacagacatcttggacaataaaacagacttgaggattgaggccctacatggaggaacaatgagataatagaagtctgggccctgacaccgtgatgattttgaaatgtctttctttctcagctgacttcaacccttcctctttttgtgttacccttttatgtaaacaaggctatgtccaagcaaagtggcgaaataggtcaaatttgcctctgatatcctagttgtttctgcatcttctttactctttccttgacattttccttgtctaatgctcagtcctcttcagtccttgtctaatgcccagtcctgcctaggatcccctttaaagcccagatcctagccctggacatttctctccaccctcttcttgctattgagttctggcagaatgcccagttctaagttcaaaaggctgataagtgatgtgattatttgctgcaggagtacaggagcagtggcaggggtggggctggaagacaaaataagcagatttcaaatgataacatttctggaattgtgaaattattagaaagagaaatttttttttctaaggctgaaagaaagagggatgagggaaggcattagaatgaatgagtgaatgaaaagtgaaagccagcctgctgttgagaatacaaaacggtagagaatatagatactattccttttacgactttgggaagcaatttatgattcctgagtccctctttttttgttgctattctagtaatgtttggatataaaacatgatacttgctataggtcaggagaatttggccttttgagcttccataatttatttctatcatggatcttgtaaatgttgtgttttttagtgttgtcttcctggctagggatcaggtactggctttcattcatatttgtgttcctggcaacaagcactgtgcctggcacataataggtactcagtcaatgctggagtatgctgtaagggagatctttattcctcgatcctgactttggaagcattctcaggttcatgcatgtgacacctccttcacacacaaatataggctgtcattgcagaatttgttcatttatgtcacacaaatttatggagctcctactctgtgccaggtactattctagatgcaaggagtacaaccataaacgaactagacaaaagtctctgctctcatagtgcttatgtactggtggggaagacagaaacttaacagataaataagtacacatatggtatgttggatgatgacaagtactatagaaaaaaataaagcataggagagtggtgacagaatgtggggaggatgagagtggctagggaagacttcccggaggtgactgtggcaggagccagctatactccctagaattctgtgctcctctacactccctggcctctgtcgtaataaagcagggctgggtggctggtgctggccaatggactgtgagccgaaggggcgcatgtcactttcaggccaaggcaattcagagtcagtgggctttctgcacccctctcttctgcctcagagcatttagaggccatgtgtttagaaaacagtgtcaccagatggaaagaaactgggttcccgagaactgagtggagaagagaactgctcctcatcttccttgtatttattgccctgactaatgcagtgacatttgagcaaagccctgaagaaggtgagtgagtgagccaagtggttatcttgagagaggaacaccccaggcagagggaacatgagagtgacagctggactaggttgaatcacttacagagaaccaattttatgcctctccagcctgcttggacattttgactcaatgaagtttgcatatgtatacatgcaaacacaaaactaaagactcctgatttttagattaaaaaccctgtacaccaggttttggttttggcttttaaaatcattattattttcattattatttattatttttttgagacagagtctcgctctgttacccaggctggagtgcagtagcacgatctcgactcacttcaacctccgcctcccaggttcaagcgattctcctgcctcagcctcctgagtagctgggattgcaggtgccaccacgccgggctaatttttgtatttttagtagagacgggctttcgccatgttggccaggctggtctcaaactcctgacctcaggtgatccatcctccttggcctaccaaagttctgggattacaggcgtgagccacctcatccggccaaattattttaataagcttgattctttagagtgattttaggttcacagcaaaattgagaggaaggtacagagacttctcatacactgcctgccccaggcacagatggtctcctccaccagagtgctacattagttacagctgatggacctgcactgacacatcattacatcattatcatccacatctacagtttaccttagggttcattctcggtgttgtacattttgtggctttggacaaatttatgatgtttccactattatagcatcatacagaatcatttcactgccctaaaagttctctgtgctccaacaagttccctttttaaaaaaggaaaagaggccagtttattttgtgattgtgagcaaaaaagaaatgacaaaggcatccatctcctattctctgccttttgctctcaggaacagacatttttttccttcagaagagatgtggcttattctagatgcaggggtaatagtgatgtctgggtcgaggtctgcatccttcactcttggggagagctggaggcaatagagccggtgtaaggacaccatccaactgtggcagccctcagtggcgccctcttctagctcctgtgcaccccgcaggccagccctcactgcttcccaaggctctgagagctcacatgcaaccttttttctcattggcttaatttctcttaagaccacttcacaaaagctccattgtaatcactatctgctcaactgctttctcttacttacaagtttagtaaacacaaacattcttctgtctaggtcttactgacctgtagaaagttaactgatgaatggtacattttaagtcaaaacatactctctgaaccccaaacatagtagagcttttggtactctttccaaaaagaagaaaatcattacactattctatatggaaaaattccaatatataagctgatgcaaattttgccttgcaaaaaaatctcaatacctgtgtttagataagtacaaatgaaactttaagaaattccagtatcactgtttctcaaacttggatatcgttcagatcctttgtaaggggaaaagattctcacagatatctagagttagcttataattttttataatgttgcatacatatatgtgtatgtatatatgcaaacacaaaactaagagctcctgatttttatagattttatgcatctataaaactaaaaaaataaattgaatacaaacaaaactaccaaatgaggaaatgcaaatctacaattttgatttaatataaggaatgatattttgctggagccaatattcacatgaatattgtaatactgtgtgatgactcaattctcccactaccctttgttagtgcagcacaccacaatataatttgcctataacttggtgtgaccacatcatttattttaaacatcattctctgtttttttttcctcacaagtctgtaacaattcactcagtactatttgcaatcacaaatccagcagtgaaactgcattcccagaataattataaagggctgataaatttatatagatattccactccaatagtaatcccatacaggttaaaatgagagaccatttcatctatcatattggcaaatctttttttttttaagataaaataaatgccagtgggggtgcgtgtgatgggcaccactgagagcttctggtgagaatgaaaactggcctgacatttctggaaggcagtttgaccacgggtattcacagacttaagagttttcaaagcctttgaatcagtaattccacttataggttgctagcctaaggaaggaaataattttaaaatgtgggcaaagataatgtgtaaggatattcatggcaatgttcttgttagcagtaaaaaataggaactcctgtatatgtccaaaaatagtggaataatgaaatacatgaaactatatcattaataattatgtagccatgacaaataatatttgtgaacaattttagtgatggtggatagtgctcaagatataatagtgaaaaaaagaggatggattattaactatatatcctataaatatatagaatacacaactaaatattctatgcagttctattatgtcacaaatgtaaatatacaaagaaaaagatccaacggataagccaaaactataagtgcctttttctgggatgtgggtaatttctgctttattttaaaatatttcctgaattttccaagttttctacaataagcacacatttttttttattattattaaggcaaacagccctggaaaggatagcatttgagattacttcctgctgtgaacagaggtacataaaagggctgttactttggagaggtctcagagtcagtctggaccatcctaaaatattctttattataagttgaaatctgcctctctgcaacgtccatacacaggtcgtaggcttgctttctttctacagctattcagaataagtctatgagtgttgcagagatatttcaaaagggtcagttttttaaagtaatggcaaaaaccgcaattacttgtgtaccaacctaatagctacctttccactgctcacccctatgaccctgctctcccctacttctgctaatttcttttcctctggatactttcaaaagttctctgtcacacaggctttctggtctcaccagcttgcttatccttctgtagacagtctctagtttaatagctttactagaaaaatgtgatattcagaaccaaaggccggtttccagccttctaaagcacagctatcatcttgccactcctctgctcgagttcctctggagactctcaccagaagagcagaacaccccagcttagcgtgcaatgtcttcctggatctggtcctagcctttccagcctcatagcccaccacatctctaatacacactacaccagtgtcttcaaactatgggttgctctgcatcactgagtactgaaatgaattcagtaaccagcacttaaaaaaagagaatagaatagaaaataccaagttgcattgtacactctaagggcaattactgtttcagcatatctatctatctatctatctatctatctatctatctataatgcacactcacacatatgcgcatactgtgtgtgtttttatactaggccatggctgaaatgtatctttttttttttttgagacggagtctcactctgttacccaggctggagtgcaatggcacaatcttggctcactgctgcaacctctgcctcctgggttcaagcaattctcctgcctcagcctcccgagtagctgggaccacaggtgcatgccaccacacctggctaatttttgtatttttagtagagacagggtttctccatgttggtcaggctggtcttgaactcctgaccacctgcctcagcctcccaaagtgctgggattgcaggcatgagtcaccgcacctggcctgaaatgtatttcttactgtgagggatgattaaaagaaggttgaaagccactggccacaccacggctacatcaggccaataactagttcccaaacttgctttgtactgcctttgatcccacccttccctcagctaggcattctccctgctctctgctactgaaatccttcaaggccctgacaagataccacatccttccttgagtgtttcaccctttccccctgtctgtgcgaaaatggtggttcaatgtctttctttatattactcaaaacagcctgccttgtattttgttatgtctgtacactgaattcttagaaaataaatacctggaggacagggcaacaccttcgggtcttctgaaggcccagaagtctagtgaacctagctgatgctcaaaaatgtctgcccaaccgaatattttctgtatctccttccaagagtatcttctggtgttcttcctcctgttttcttgacctatatagcccccagcaggcctaaaatctgtgtcctggggctaatgttacgtacagtgatgactctagaaaccagtctgttctgaaagctttcacctttcttcaggagcgataagagaaataagcatacgtttttgttcatttttcagatgtttcctttatttgagactatgtttctcctgtatttttggtgttaagatgtattttggggagcaacactgatgatatattacaagataatagttggtattttagtatgtgtgtgcctattgtacttatttgacacaataaataggcaattctgagttcatcttttaaaaaaaaaaaaaagttaaaaaaaatttactggttgcaaactccaaaaggcagggaatcaacttcccttctgggctggctgcaagtaagttcactttcttaaaggaggagctttctcctctcacctcaaggactgttatttatttgtctgcgctactctttcgacgtttccattctcttggtcctcaagatgtgaatcacccattttttccgtaggggggaagacggcgtatctctggccctttaaataggggcgtggtgaagaggcgcggaccgcccaggagggggagcagtgcgaggaggaaagcggaagcgctgcccgcagtggtaggtagtgcgcgtgcgtgaggctagagcagtgggtgcggtcacgtgggccggcggtccacggccggaatggcagcaagctcaggtaacgagtttccagagagcgggcccgtggaaggagacaggattgaggggccgtattcagggtaggaggagagcgcgcgacaggtctctgagcctcggcgtctcctccccgcgcgacagcggcgggacctcggggagcgaacagagcagcccctgacgggctaaccggacccgagccacgggccgggcggggttgattctcgagtggaggggcgtgtcgtacgttggcccggaactgggtcgggcaatttccacttactggttccaaatgaatgtgaaaattcaaatgggcttaagtaaaaagggatttattggctccaaacctggaaggggctgaggtatcactaaatccagtgactccggtgatgtatttgtgtatctctccctttctgcaaagggccagtaacccctcagttccctatctactttgcgactataattgcaagcctcattctgtcctgttacagtcgtgcggcaattaggctgagggactggcgcgcccgctcccccgactgtgagcctaggcggcgggtgtcatgcccctccccactcccgggcggaacaggtgtgtagccggtctgtcgggcctgggaaacaggtgtggacccctttagcctccagggactgatatcaaggtgcctgagcctgaggcttagatggggtgtccacctcttaggatcggtgcgcaccctgtgaggctggttccagtttgtctccgcgtgcaagttgtgcaccagagtgagggcagcagggtgaaaggtgggcctctgaagttcgaggctactcctgtgccttggccagttctttgtgcttggcatctggggaaggagggaaacagctgctcagagtgtctgggtgtacaaaatgggggtgctttacaggaggatagggtgggaggaggtaggatcggtgagaggttccatggccgtgggttatcaggaatagctagctggggagccttctttaaataagcaggccccctccacttcttagattcttgttagaatgaataggaaggcttctggcctctgcaccatccaccctctaccatactctactttcccctactgaaaaaccccaaaacccaagcaaaacaagcatggatgttagcttgtggtgctaaaccttactccaaatgtctgcatttgggagacaattacatgttaattgtctgtgtatgtctatgtctgcctgtgtgggtttgaggtatatctaatataaatgtggatggagaatctgcatatgtttgtgtaagacgtgggtttgctcatggttaaatttaagcacagaataggtattgaatcctctggcaatagctggcctgttccatagaatatgcaataaagataaatggaaaaaaaattcgttgaactactgggctttatatggtcaaagaggcatttgtgagaaaattctttccagagctctaacagagtaatatgttgattttttctttatatttaatatatttgcttcgtatctggaccattgtcagcagatggatgttttctgtcttccagaatattgggacatgttggtgattcttagctgtatctcactattccattgacatttcaaccagtgtgacacaaaatgtcagttatgtatgtgaatgagaagtaagatcttttgaatttaatgaagtatgtttaactttggatctattgatagctttcatagagtttagatcgtatgttctcttgatccacagctgtaggtgtcatcggtacatagtggtaagatcaaactgttgtattcttaactgaatcttgaatgaatatttgacttatcttcacgctgtatgacattattaaatgtgttctgtgttttagcaaggaaatatagctttgcgttggatttttcactgttatgaatttcttaggtttactgtaatagcaattatacttttttagtcaaagatatttctgttgcaagtgacagaaaattcaaatgggcttaagctaaaagggatttattggctccaaacctggaaggggctggggtatcactatatcactaaatccagtgactccagtgatggagtacttgtgtctctctccctttctgcaaaggaccagtaacccccagttccctatctcctctgcaactgtaattgcaagcctcattcttcctgttacagtcatgggacagttaggggatatgttctgagaaatgtgtggttaggcaaattttgtcattgtgcatgcatcatagtgtacttacacaaacctagatggtgtagtctgctacacacctagactatgtgggatggcctgttgctgctaggctataaaccagcacagcatgttactgtactgaatactgtaggtggttgtaacacaatggccaagtatttgtatatctaaacatagaaaaggtacagtaaaaatacagtttaaaagattgaaaaatgtgaacctgtgtggggcacttaccatggatggagtttgcaggactggaagttgctgtgggtgaggcagtgagtagtgagtgagtgtgaaggcctaggacattattgtacactactgtagactttttgaacactgtacacttaggctacactgaatttattaaaaattttttctttctccaataataaattaaccttagcttactgtaatgtaacttttatgttataaactttttaatttaaaaaagtttttaacttctttgtgataaaacttagcttaaaatacaaacacattgtacaattagctgtacaaaaatattttctttatatccttattctgttagcttttttctatttcaaaaaattttaatctttaaaaacgaagacgcaaacacacacattactctaggcctacacagagtcaggaaggtcccggtggaatgtctttagaggcagtaacacatagggaactgtcatctcttatgataacagtgccttctggaatacctcctgaaggacctgcctgaaactgttttacagctaatttttaaatttttaaataagtggatgagtacactctaaagataaaaagtataggatagcaaatacataaactggcacatagtttattatcaagtattatgtactgcacataattgtatgtgcttagcttttatactactggcagtgcggtaggtctgtttacatcagcatcaccacagacagatgagtaatgcattcattacaacagctgtgacatcactgggctacaggcatttttctgctccattatgtgtaatgttaggggaccatggttgtatatgtggtctgtcgttgacccaaaacgtctttttggggcacatgactgtatataaatgcataaaagatgtgactgcagatgactcctgtgttatgccatccaagattaagcaccctagaataaagagaaattccagaagtaccttgattggccacataggacccaagaatgtgatgtgcctactcttctgctccgctagctaggcagatagggtacttgattggcagcaccaccaaaatcacatggttggaatggaggagaagcagttgccctccaggaaaggtggcagtggtgctggggtgttttaacctttgttttttccgttgcagttcagcaagacgcttccagttacttcctgctcttaaaaaaaaaaaaaaaaaaagaataaatctctcatgactctatatccttcttgacacctaaccaagagaaattgagatgacagttaattgcaaattaataaagaaggccatcatctactcagcctttacctaagtggaatcctgtcttttgcgcatttaacttacaagaatttacctgcatcagtcagttatgtgaagaagaaaagggaatatatttcagcgtacacaaggcccttgtgctttttaggaggagttctttggagctgaagtgggtctgagaagagacattctcatgatagtggagacagtattatagaagctggaagtgatcatttttctctgttatttatttcacttattacctcacacacatattgatataaaactgatcaataaagttagaatttctacattatctagatatttgtagacttcgttcatattattgttttgtatattgtgataggggattagatttttcttttctaggctggagctgattgtctgacaattcatagcagtaacttagcactcactgtatacaggaaggtcttaggcactgttccttccccttacttttctttttaacattttttaatctgtatgtacttatgatcactctcctcatttagacattcaccaacaacagaaagagaaacagagggttgggctttttcgtcgtggcagttctggcactgtgagctacaattacctaaatgtgccttcttggaaagaaattccagggtcaagtaaagcagcccatcccagtatatagtaatgtttctctaaatagggtctgtatctaaatgaataaggtgaaaattgagtaccctcaaagtaccccaagagggagtcatatcagagactgacaagcggtgggtctctcaggaagccccatacggccagatcttgtttttccatgttggaactgcatggcgtttgttattttgagcacaggtgacgtgaactgcttgggtgtgaggcatgtgagaactgagacatagaacagcagctgaccatctcctattctgtgcccactgtgaagcaagaagttattgagtggaggtatgcagaatcatgaatcatgattcatagaatcatctatatgaatcatttctttctctccttcccgttgctgaagataatagatgaaatcctgcaaattgaatggaagtatggtacatttccactgtattcatcttggcctctaagctgaattaacgtaaaagaacataaaacatctgagattgtgggatttgcatcatgttataaatgagctaagtgatttaaaaatatctctcctagatgcaaagaatggaacttgcacagatggaggcgttttggagtagtgtaactaaccatactttgtattacgtgaccagaactgctatttgagattctggaagccagtgatgcagtcttgcttgggtatttacctagggagggagggagggagggaggaatgggtggatgggtagatgggtgggttgatcagctgctgtgtcatatcggcacggggaatagaatggtgaacaaggcagatctggtctttgctctctcatggaacctgcattccaactgggggcaaggaatggtggtttagacaatgaggaaatcattacaatgtggtaagtgtagtaaaagaggagaacgatgttatgggtgcatactaacaggaaacagcctagttgagcagggcaaaaaaaggccttcctaaggaagcaaagttttagccgatagttgataaatatgacctgcagtggttgacaagcttgactacatataagtagtattcaattataacttggcttcttatggtatagattcctatatgctgtgagtcaaataatatcctctggagcttaacaattacaagtaataacactgatagatttaatttgcaacacagatgttattcctgtctcttagttcctatgttaatcaaacatttttcgaatgtctacctagctgtgcaagccagtaagcccagtgatgtggaatattcaaaggagcatggccccatttttattatatagctggggagaaaagagtcacatggtaaattaactaatgaatcagcatgaggaaagagccaagccactgttttaaaagaagacatgttttctgaattcagaggatggttagggaaggaagaggtcataggcagatccagtttgaacggtgcccagaaggaagaaaggaagttagataaatgtagagaaaaaggaaaggaaagggaaggtgaatcagcttgagcagacatgaagggaaagtggaagctattcatgaaggactcttagtgcaaaaataataaattcaattgtaagggaaggaggcagaaggatcagctcgtgtgatatctggagtcacaggcttagaatttgggattttatcctggaggcattgggaatctgttaaaaataagtccacttgtgctgggcgtggtggcttacacctgtaatcccagcactttgggaggctgaggcggtcagatggcttgagcccaggagtttgagaccagcctggccaacatcatctctatgaaaaattcaaaaaattagctgggcatggtggtgtgcgcctgtagacccagctacttgggaggctgaagtgggaggattgcttgacctgggaggcagaggttgtaatgagccgagcttatgccactgcactccagcctgggtgacagagggggaacctgtctcaaaaaaaaaaaaaaaaaagtccatttgccagaaggtaatagaaaactaatagaagttaacccaccattgcattttatttttccctttacaaagcaaaccacaaaacaaaacaaaggaatgaagagaaatgcttggattgggaaggccaaaaataaaatttgcatgtaatgttgtactatatcatgattttgtgattgttttctagcattatatagtaaataaaaacttgattctatttcattgtaatgtgaaaaagtatctcatatgacacttttaggaggaaaagaatgtcaggattaaacaggatcatggagcttgagaacagttaggaataaatgtttcccaaggtgaaaactggtgaaaagccaggcatggtggcacaggctggtagttgcagctacttgggagacgtgaagtaggaggatcgcttgaggccaggagtttaaggctaacctgggcgacatagcaagatcccatctcttaaaaaaaaactggtgcaagtttaacttggcgtaatataggtcacacattctagagttcttattcagttagccagtgtcataattaagtcattgctgtttatatggcgcatatctttttttaatggtccttgaatctattaattggttgggaataacaattaagaggaaataacagaattatcaagatgtcagataatcttatgtctgaactattaaaatactcatttatcagcactcagaagagacagcatactgggtaattatgattccatgacatgtatttcctatcagattaatctgatttcattctaagagagactaagaaatcatgaagcctgttttgttatgtgcaagtactctctggtatggtatcctcttaagaactataaaaacactagctcacatgatggttgggtgaagaactagttgtagaattgcatcccagcaggaatttatgagtggttcattatcaaccttttactgggataacatttaagggatagctgaagcaggatcagtatcaagagtgaaatattaagcatcatatagtaagcattccatcattggtgcatatattggaatgaagggcctgcttaataaacacatgggcaacaccaacccacaaggtaagggttaatatttcagaatgttggatatgtgaccagaaacaaattaacttatatttattagtacagttgacccttgaacaatgcgggggttaagggcactaccccctcaaccagtggaaaatctgagtacaacttgtgactccccaaaaactttactactactacctactgttgagcagaagccttactgataacattaacagttgtttaacacatattttgtgtgttatttgtatttagttacaataaagtaagctaaagaaaagatattaagattctaaggaagaggaaatatacttgcttttcattacgtgtaagtggatcattataaaggccttcatccttgtctgaacgttgagtaggctgaggaggaggaggaggggttggtctcactgtcttgggtggaagaggcggaagaaaacccacttgtaagtggacccttgaagttcaaacctgtgttgttcaaggatccactgtctattcatttcctattgttgccgtaaattaccgtaaagttagtagtataaaacaatgcagatttattttacagttcagtacttcacaagtctcaccccagtctcactaaaattaagagatcaagacgacttcagtccttctggaggctctcggagaccatctgtttccttgtctttcgcagcttctagaggctgcctgcatccttggctcctgagccctgttctccgtgttcaacgcctgtgacatggtgtcacatctctttctctggcgttctcttctgcctctctcttcccctttcaaggacctttgtgattacattggacccacccaaatcatccggaataaccttcctgtcaaggtcttaatttaacctgcaaaatcccttttgccatatcaagtaacatattcatggtttctggggattaggactggcattgttggataccctcatactgcctaccactggtagattcccagcttaggtactttctgaaaaattcacagaagctgctcatgtgaactctccttttaaaaaaaatttgagcatggtgaccttttgattcaccaggtctctttgagttggaaaaacttactgactaaaatgaagaaaggaataattgctggtaagtgacaaaagaggaacttgggaaggggacatagttggcttcactaataaagtgtagactaatgttgatgttaaaaaaaacctaaaacatgattttagaatgagttagtaacaataagacacttctgttataattaaagtttttattaagtgtctctgttgctttggtgggggctgtactagtcttagacaaaacccctatcattcagctcatgaagaactgctgtgatatccaggatatcgttctgatatgcttagcactggctagacctttacaaaaatactggattttgttttagaatctttaactttagaaaactttgaaaattttgaggttttaaatgtaatagctaatatctgttgaaaattatgtccagacattattctcaatgctttgtaatcatatcatttgttcctcacaggagccctgcagagtaggtagttgcatttataagagccaggactctcaattttaagtgctaaaagaaagggggaagttgggagagtatatgttggtttatgtagccagactgccagaaggctatgggcagagctaacttcatagaagactagaatctgaggcttgaataatgtcagaactttcttctctacttttttttttttttagagacggagtcttgctctgttgcccaggctggagtgcagtggcgcgaacttggctcattgcatcctccgcctcccgggttcaagcaattctcctgcctcagcctcctgagtagctgggactacaggcacacgccaccacgcttggctaattttttttttgtattttagtagagacgaggtttcaccgtgttgctgcccaggctggtcttgaactcctgagctcaggaaatccacccgcctcagcctcccaaagtgctaggattacaggtgtgaggcactgtgcctggcctctacttcgtttttttagataggtttcatgcttgctagagaatctgtacctagaacctaagttctatcaatagaggttcatctccagtgacagatgcttagtgtttagttaggtgtgtgttaagtgaatgatttcttttctgcagaagcgagctgggtggggaatgtgggatctgctcagccacattattcattgtatagagaacaatggaaatatctcttcctcatcagttccattttaatgaatcctggtgaaagactctggctatcacataatcccttatactaagggatttttgaccattagcctctacgagaacacatggtttgaaggagcccttcccagaacaagagacgctgttctgagcaaacaacacaaatgtccacaatattccattttaatgatatagaaatagagaggttcagaaaaggtaaacaaattaaccaaggtcacagataggaactcataaagtccagattcagacttgatttatttattttattttttggggggtcaggggtggggagaagtgattatttcctggtcatttctaagaaaagtggccacaacagcagacctaataatagactctttggcttgtgttctgtccactttgccagcacattacattggtaaaaggagctcagtgaaatgaaggtcagaaatggggcagggtagcttggtgggatgatgtcttcagggagtgcctgatcacctgacacttcttcagtgtgatattggggttcacagatgctgaattgttacatggtcttggaacctcttaataactccagatatgagataaaaagagctggaaaaaattgttttcctttctgagttattttggaaagagataaaatatgaaacattttagattattaaatcagttaaatattattttcctgtatggtctttcccactatttttgaaaaatgtgtaagaataaaagttaataactatctttaggaaccactgaacgtgaattagattgtgcatgtttgtaaatagttgttaaataattgcaaccctttttgcttagtggtacaaataggagttgaaagactttattaaaaagtaatttgtcatgagctaaggtctttgaagaaatgagtataaacattagtattgctactgcatttgggttattgcaaaaggagccctatatttagaacctgatgttggaaagatactttaaaatgttgccaggcaaagagtggcctcagttatgtgttctaggaatgtgtttgatagtgtgtgttttattaggacacaaccctataaatagaaaacccattttctgtaacgtgaaagaaattagtctgtatttggtaatataccaaatagtgtaatagctagaaaagttggtttcagctcttgaaaagtcagtttcataagtccatgatttatacaaggtaactattcatttcttttaatatgataaaaatgaaacatcaaaggaagtgaattaattataggtactaaaataatgagcttcattagataaaattgtcagtgaatttttagcatattgtttaaaaacaactaatctcagttcactttttaaaaaattagttatttcaagccaggcatgatggcacatgcctgtagtcccagctactcaggaggctgaggctggaggatggcttgagcccaagagttggaggccacgttgacaatatagtgagactccatttcttaaaagaaattaagtggctcagtaattacaagtcttttttttctgccttcactaacatgcacaatccatctttactaacatacacaatctaatttactaagagaagctcactgcagggcaagggttggtggtagtggtgtttatacacgctaaaggcagtatgtagtttgaaagagctttgcactgagagttttgccagttgtttggtactgtgaaaaacatctagtttaggaaacaaaatgatctttattattattattattagggcattgtttctgttttcatatttttgctttatcctaaacaggtaaagctaattggactttttaaagttgggtcacttgtggcctaattgaaacacaaagtaaaatcatttaaaagcagacttaattattaaacttacagtaatgttttcagtatattttagctttctaaaaatgacagttttgcaagtaaaccaaattatctgtgatttttgatataagtgtgatctatcatttagagctctgaaataataaaaagctgtataagtttctagttttctttagtatttcatttctctctgaaaatgtccatgtttctctgtgactggctctgtttctagaaatctctggtaggctatggagttattttatcttggggtcattgttgtttcctttaatagatctgaacccttaggtttgctcgtgttgtattaaatagctagttgttcatcctcagtgtttctgctaagctcccagagacgtctgtggccctgtgcagaggccaacaacaaaactggtttatatgcttatttccaggggaactggagcactaccctggggtttggaatgtaaagaaggcattaattgcagcttttggcaccgatttacccttatgctgttaggtaaataaatctagttggtaccaggtctagtggctgagcctattaagttatcactatcaccagtttcatgactttgggtggcgggccacttcctaaagtccttgagcccaagttagctgttcctcctttatgctctcattgaaaccctctcctaataacataccctgtaccccactgttaatttcagtttgcctgcaatcggatgtttaggtgaaatctgaccaagtaagtctttggaatgtccaattgacaaggaggaaatctaaatgatagtgttttgttttgtttttgtttttttctttttttgaaaagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctggtaaaaatttcaatttctgtcaagtgataatgtttaaccagtgtagattagagtatgctttgtgacccagagactctaagtctgtcatttttgcatgggttaataggagtctgtgtataatttttttttttttttttggatacagggtctcactctgttgtccaggttggagtacagtggtgcaaacatggctcactgaagcttcaacctcctgggctcaagtgatcctcctacctcagcctcccaagtagctgggaccacaggtgtgtgtcaccacgcccgcctaatttttaatttttttgtagagagggtctcgccatgttgcccaggctggtctcaaactcctggacttaagcagttctcccttcttggcccccacgtgtatagttttatgagataacattactcttcatttgtatagtccattacagtttatgaaacaatttgattcatgttgtcatttgagctttacaactctcacaacactctgataatccattgtatagatgaagacactggcatgcagctatgtaaatgacttctcaaagtcacagagccagtggtagttccttatcttgcacagcatttttttttccctttgatttaatattatgttaatgggtttctatgagtatgagaataacagcatgttgcttgacctaattatctctcaccataatttatgaaataactaagaaatgtgatgtcagacttttgcttattgcttatgacttatgtctaaacttagaaaattaggggttttcttagatgttgttttgtcatgtttaagaaagcagatgcaaaagtctttcaacacaagttttctggaaagtaggccgggcgtggtggctcacgcctgtgattccagcactttatgaggccgagatgggtggatcacttgaggtcaggagtccaagaccagcctggccttatgatgaaaccccatctctactaaaaatacaaaaaagattagctgcttgtggtggcacgtgcctgtactcctagctccttgggggactgaggcagaattgcttgaacccgggaggtggaggttgcagtgagctgagatcacaccattgcactccagcctgggcatcacagcaagactctgtctcaaaaaaaaaaaaaaagtgttctggaaagggctgtcaggatagtgcagttagtgcatatatgtccttgatggtaactgaacgtgtagataggaaaggaaaccactctgtagtcttgacttgattattactgtggatttttgagttgatcattttggtggtaagtttgtcttttaattgatggtggttttaatcaactaaaacccctcacaattataagcagaaaggcatcattttgtgagcactattttttttctttatttagattgatgacaaggagtttgatattcctcaagttgatactcctccaacactggaaagcatactaaatgaggtaagtgaatattaatgattactgtcattttgtgtgtggcattcatcttaatactttttggattagttatcatacatgcacctagatgcgcactttccagtagggtagccactagtcgtgtgtgtcagtttaaaatttaaattaattataatcaaataaaaatttaattccttggctgcacaaggcacatttcaagtgctcaatagccacgtgtggctagtggctactatatggctaggggacagcatagataaagagtatttccgtcatcacagaaagttctcttggacagcagtagtctagattgtgagcttctcaagggcataaaccatctcttgttcatctttagggtctctgtgcccagaacaatgcctaatacttggcagactttaaaatatattttattaagtgaattgagatgcaaaatttatgtcacttttgaggtttgtattatgtgttgctaatggttaagttgtctctaccactgatattcaaatagcttgtcctctgacgctaaagaacatcttgcaaccttataataagcttcatcactcttctacatgaagaaaactaatcttttatagtttatcttatgaataccatttctaatgaaaagtttttcagagttttgaaatggtgttattcttttctgaattgggagatcaaaggctttctaaaggggctctgtgagaggacatggttggtgaagcacgcctgttttatataccctgcatctgctgacaacccttcaactcagtcttcattttttaaaaacttgcttgagacttcccttggaggttttagcttctaatttgagaaagatcttgcaatgtataaatctatttcaaatccgcagttatgttttccaaaagataaagacccaaaagttccctgacagaaaggcccacgtataccaaagctccgagtgagttgggcctctgtctttattatttctttgcctatcctgtgagggttgtaggcagcactttataggatgcaaactactttctctgtcaattatgtcttttatttttcttgtatggcttttatttctatgttttacatcagtttgatgttgctgttactttgagtgtattttaactttgaatgtgttctaacttcagaagtgtcctatatgttctgtgtgaagacttaagcatttttagttttgataaagaaggctttggtccatgaaagaatattctgttacagtgaaatgtcctttatttactttctaatatagaggaaatctttcatttagaggtgagaagattaattttagtcagttttgttaaaatggccttaattgcatcctcatttcaattattaagtgtaaaataaaaataatcttagaggactgtgtataaggccttgtttgtaaattattatatcagcaaagaaaataatgctcatgtgaatgagctgtggttcataatgaaggaaaactgttcctgcacaacaactttcttatctgtgagtaacagtaagtatagtcattagtggtttactaagaagataacactgttatcatcctcaatagtagtttgagtgtctagtgtatttgggtcatggtgttagatgttggggttataaagtgcaatatgactatctctgtgcttgagaaggaaatgaggctgggaactggccagactttacacctccagggaaccaggcaagtcgtaagtggaagaaaacatagttcaaattgtagaccattatgaagacgataagggggctgtggggagtactaaagaaaatgactgaaggaaaaatgaaaagggccgaagtagaaaacataaataagaccttttctcaggatatgtggatgcatatattctataatgttcattaatatcaaccttaaaggagactgggaagaaatggacatccactttttttgtttgtttttgtttgtttgtttgttttgagatggagtctcactccatcgcccaggctgtagtgcaatggcacgatcttggctcactgcaccctccacctcccaggctcaagcgattctcgtgcctcagcctcctgagtagctgggattacaggtgcccaccaccacgcccagctaatttttatattttagtagagacggggtttcaccatgttggccaggctggtctcaaactcctgacctcaagtgatctgcgggcctcggcctcccaaagttctgggattgtaggcatgagccaccatacctggccgatgctttttaaagtagaaatttagagattactgagacatcctagatctcagaatttaggacatgaaagaatgttactaggtattgccatcctttgaaactatgcttcttctgagatttttaattttgaaattccattctttaactataacctttttcccctatttccttccattgaaactgttttttggcctcattaagaccaagtctttgaccctttctaatctcccagtttctgagaatagtcctaggtttacttcaatcctgctgttggattgtgcagccagaaatttcttttgaacttttcattgaagtatatcatacatagaggaaggtgcacaaatcataagtgtacagtgtggtgaatgttaacaaactgaacaacctgtgtaaccagaatccagataaagcagccgaacattactagtaccctagaagctcatcttgtgtccctttagtacccaaacccagggtaattactactctaacttctaccagcattgattaagtttgcctgctttgaactttatataaatggaattatatagtgtgtacttttctgtttctgacttctttcccttaatattatgtttttagatttgttcacattgctgtgtaaaattccttgtgaatatacctttattcattctactgttgataggtatttgtgtagtttctaatttctgactactatgaagagtgctgctgtaaagtttcttattaatgtgttttggcatgtacatacttacacacatttctggtttttatctgttttcattttgttcttttttttgagacaagagtctcactctatcacccaggctggagtgcagtggcgcgatcagggctcactgcaacctcctcctcctgggttcaagtgattctcgtgcctcagcctcccgagtaggtgggattaccggcatgcaccaccatacgtggcaaagttttttgtatttttagtagagacggggttttgctatgttggccaggctggtctcgaactcctgacctcaggtgatctgcctgccttggccccccagagtgctggtattacaggcatgagcccctgtgcccagctttatacacatttctgttgggcatatacctaggaggggaattagtgggtcatcaggtatagttatattcagctttggtatatattggcaccgtttttgaaagtggtggtattgatatacacttccagcaacagtatatgagatttctgattactatatccttgtaaacgtttgaatttttctgtctttttcactttcattcttaaaagatttgtagtgctatcacatcatgattttaatttgtatttccctaaagactaatgaaattgggtactttgacataggttttgaccgtttgaatatctcttttgtgaattgccttttcatataattagcccacttctgtcgttttattttttaagtgatttataggagttctttatatatgctaatacaagccctttatttgatgtacatattttatcttctttctttctgtacattaccttttcactctattaatggtttcttttgaggagcacaagttcttaatatagttcagcttattaaaattttccattcgtgtgcgtgtgtgtgtcctatttaagaaaatttttccaattctgatgttatgatgatgttaccctattttgttctaaaatcttcattgttgttcctttcatatgtagatctgtaattcatctggaattttttttgggtgtgatagtgtgagctatgagccagcaccatgtactaaaaagagtattctcatctggtgtcacctttgttataaatcaggtaatcatataggtgtggatctgagtccattggtgtgtccatacttgcctcgatctcacattctagtgattgaaactttataataggtcttgatatctggtagtttaaaatcttccagctttgatgttattcttcaagattgccttatttatttatttatttttttgcattttcatgtaagttttagaattagtttatcagttcacacacacacacacacacacacacacaaatcagctgaaatttgaaaggattgtgcagtttttttcacatcagtttggggataattgatacttttactgtgtagcagtagttttaaattcagtcttgacatcttcacttctttttttcccttcactttttctttcacttatcctgtaagcctggcttaattcatctgatccattttctttaattatgtccccaggctttttaagaaaatcaaataacattttgattgactctcttgtttaagatcttgatgctgctgtatttatttctgaattatttccttcccttttcctacagcaatcgttccaatctttatagcacttaagcaacataatgtcttattgccagtcctaaccctctttttagaagacctatgtgtagagatatctggaaagcaatggtaaatttggacctaaaccttgagaaatgttgatgctaaagacacagattttggagtcattagataacatggttcttaaagctatagatatggatgagcttactcaaataggaagtccatgaagtaggaagagaagatgagagcttagaatataatcctgggggacaatcgtatttaaaggttgggctgagaagaagctagcatgtgactaataggaggacacataagttagcggagaaccaggaaggagagatgtaccgaaaactaaaggaaaagaaagcttcgagatgtagtgaatgagccaggcgtggtggcatgcacctgtagtcccagcttcttggaggctggagtggaagattgcttgaggccaggaatttgaggctgcagtgagctgtgattgtgctactgcacaccggcctgggtgacagggaatggtcaacaggattaaatgatgcctggagaacaagaacatgctaacagaaagcaggccagtggatttggctagtagcatcagcaaggtcggtaggagcttgtaatgagtggatcgaggtagtgagtagacattaatctctcaagtacattgattggaagtggtaaggcagaaggtagtgcagctgaaagagacggtgagacattgttctctgatgtttgtcactcagaatcaacttgggcaaagccaagttcctcatcctgctttatctgccatttgtctgctttctaatttcagtgagtagagtcaccttttacctggttgtagaagctggaaaccttgtactcttctgtgacttctcccttacctctcctcccatccgtactcctactcaaccccccatttcaatggtaaccagagacgtttgattttttctccgtaatgtgttcatcattccctctgttgacttcttctgcagcttcttaggttgggatctcccgtttttccttgatagtgcaatagccctcttactggtccttaaagtcttcttgtctcgcctcatccattcttcatactgccccacctatctttttaaaacatggttcccatcatgtctttccacttcttaaaaatgtcagttgccttcccactgcctgctatatatagtatactaaatattcattaaatgagtactggttatgtgtcaggcattatactaggcactagaggtacaatgatgaacaagatagacatgggccctgctgccatctagtgtaatggcatataaggcttttcatggtttgggtaccagcttatctttctagggtcatctccaacttctgcttatatcctccagacattttggactactacttttcccatggacaaaatctgtattgtgaaatcactgtgtctttctgtgctgtttcctacccagaatgcctttctgcactgtttcctacccagaatgcctttctgctgtctgcttgtcatttttttttatagtagactatttatagtcagatggtgtttgttttcttcaaattagccattggctgttagttaactgctaaatcatctgtaaaagcttgatttttaagaaatattctacagctaacagtaatctgcatactgctcctgcttcttcctgctacacgaaagaagttttggggtgacttctttgtagagagaaatagctgtctagaatttaatactagtaattctgtatggtttctttctggtcaataagaatgcatggaatagaggcgaaaagcagaaataagcacttgtgtgctctggagaaacccattaatgcctgactcatttcatagagtatttggattttgaatgtattgatttatcttcttccaatttagactgatgatgaagatgagtcttttattcttgaggatcctacattgttaaacattgatactattgattctcactcctatgatacttcatctgtggcaagctcagatagtggtgacaggaccaacttaaaaaggtaggtattcatgtcaatcatacttgcttacagttgaagtattcaattgtttcaaatgtaaatattgtactttttaaagtacaatatggtctgttgaagccttgcatgggaagtagaagggatataatatcttgaaaattttggtaccattaaggaagaatgtaaaagggtaggtgctatgaccacagtctgaactctcggtaggaaaccataatgatagccagggacttctggaagcaggagagcccttggaggaagcacagattaaacctggcacagtgtctgtggtggaaacatgcagcttggttcactgccctactgttctgcccaccctcccgcacctccctgtcatccgcattctctaagatcagccttccttcatgctcttggagtgggttcagagaatcacaaagacgattaaaaattcaggaaaaggacttctaaccctaaataacttaaatttgggctgcttttcaccttccaagttcttggagagactatgaaaaggaaagagaattggaggaatcatactataaatacattattgaattcacgtgtaactttaatattgataaagtgatctgtttttcttcttcttcgattttgcctgtgtcaatgttcttttctttaggttatctcttatgggataggggctgttgctggatatgttaacctgttcaacaatgtgtccttcaaatagataacttaaatgtttttgatgatctggtcactacctgcttaaaagatatggtatcatcttgttgcctgcaaaattaagtcagaactcctctgcatggcatcagtctgggccacgcttactgttttgacctgatctctaagcactcacacttcagccctcctagtctgtaccttttgtgtatgtgtaccccagacacactgtacacctttacatcttcatatttctgcctgtgctttttgcctgacaaactcctagtcatccatcaaggtcaaattagtcatcttctcttttctatagctgtccctaatgccccccaaataaacagaattaaactgttcttcatttgcatttatatggcacttaattcatatctctaatataacatttatcctttagagttacttctcagcccctcagctatgaaatccttgacagtaataactgactttcttatttttgtattcccagagcatacttctagtgatacaaagtaggtgctcagtaatgttgggtaaaagtttaaaagttactttttgtatgaggatgagtagagggggaatttgaggaggtggttgaagattgagagggtggtcataggagaagcagcagcacaggaaaggtgagcaagggtaagaaggcagtagggtaatgtagacttgcaggccggaggagtgctctgtaggcagccttctggagaacatgagaacctactgccgcattccctaaggtgggcatggagcagtttgaatcgtgagaaaggaatggtgatttgattcattttcctgcttgtgcttctttgaggttcaaggcgggtttaatacattttaaggtgggattgttagatccgtcatacctcttttaggagatatacctaatgctaaatgatgagttaatgggtgcagtacaccaacatggcacatgtatacatatgtaacaaacctgcacattgtgcacatgtaccctaaaacttaaagtataataataataaaagaaaaaaaaacagatctaacaaattacatacaatgttgtcttctgctttttgtgcgtgtgtgttttctttcaaagctttgggacctctccttttcactatttttatctgtttttaaatgtttttctttttttttttcaggaagaagaaattacctgattctttttcacttcatggatcagttatgcgccattcacttttgaagggaatttctgcccagatagtgtctgcagctgtaagtattttgttcttttccctcaactttgtaacctgcaatggcataatgaagtaggaatgagcatagaacaaaatacagcacttctcttggcccgaggcttaagaaaaatagaatctggctttcatggtttttgtgtgatgatttttgacttatgagacatggctacacgtcttgacagaaattagtgcagccatgaaaataaagttctgctcagagtctaggctgtgcctaaatgaaatatggcagcaagcctaaaataaatactatttgccttttctttaaattccttttcatttagttgccgtcttgtgtatttgttgagattgtgtgcttgttttttttttctcttttcatatggagaaatgattgatcagaatcttttacaactgaatgattttttttttttgtaattcacaaaagtattttcatgtcccttatttcatttattcttacaacttggaaactaggtaaagctgtattctattttacaaatgagaagataggctcaggaaggtgatattaacttgtcttagatcattctgttaggaggtagcaaggcatttattcaaaattggggtttctggcttcaagtgtagtgcctctattgtgaaatggaggtggcattggtgaatgtggtcaatgtgtaaaatggctggaacagagtatctgtggccttttttgaaaattatgtagagcactgggttaatgtaaacgatatttaatggtccatagacagcagaacttttcgtttgacactatcagacttttcttttgaccccaaagcccatagttttatgtagtctttcaattttggttttctgagtacaatgtacagattctgtatataatgataatgacagatttatactccaggaagtttaatgtattttcatgttctttttggggcatttaattggcattttgcatatccaagttggacaagaaataaaaatttggatttttcttttttttttttttttttgagacggagtctcactctgtcgcccaagctggagtgcagtggcacgacctcagctcactgcaagctccacctcccggattcatgtcattctcctgcctcagcctcctgagtagctgggactacaggcgcctgccaccatgcccagctaattttttgtagttttagtagagacacggtttcaacgtgttagccaggatggtctcgatctcctgaccttgtgatccgcccgcctcagcctcccaaagtgctaggattacaggcatgagccacctcgtccagccaagtttggatttttcaagaggatgagagattgatacagaattacaagataccacaattgcacttcaatgttcaggtttatcagaaaaagcccttagtgcaaataacaacaacaacaacaaaagtatttactataacaattggggtatcctgacctagctcatatatcatgaagtgaatttaaatagagagatgctcaagcaatagaggaaacctgggcaattgttcttcctcttttaggtggagagtaactcatatttgctagaatgggaaccacctgttgaggattacatttccatgacgttttctgaatttaatccttatgtaggtgatgaaattcattcctttcaaaatcaagatgaaccagaacagtcatttgacccacctgtgcagttttaaaaatattttgagtaatggagactgagctaaaactcagactctgaacaatgattagataaatctgttatttaaaaggagttctccttccccttgaagaggaggggaaattctaataaatcccagagtgtttgcattctgtttttatttgattgctatggctgagctcctttggtatgttaaaatgaaaactgcctttcctgtgacagtcatcatacggtgccttcctatttttggattaccagctcaatttaaattgcatgctttcctgtgatggttggtttattaacatgtaaagctagttatatttttggatatttctccctgaataattgctcaatagtgccttcagccatgtggttagtgatgttattagggctgtttggggccttgatcacagttttgggattcatgcatggaaaacacttggagagatgaaatttttgcaattgtgaagctcattttttaatttgggatccttttcaaagtagtatgacatgtgactatactttaaaataattcaaagtaacttttttttaaggatctttattatttttatgatcaacttgaaaatactagagatagcttagtgtagtgttttttttcaaaatgcgtccactgtataagaatctcctagggtactgattaaattgcagattcctggggctcaccccaaacctacagaatcccgagcatacaggcatcccaggtgattcccatgcattttgacttttgagacccactaccctcagatattgcaacaccagtactaaaattctgtaatctctacaatgcttcctaatatctgtgttttttttagcttttgaagtcaggtgacttctgattccattattcaggttctattttgaatatagaacagaccttcgaataacatcattttgttcaatgtcattttgttataatgttaatgaagaaaaaacaattggtttaagttgttttgcttaaagtcagtttctaagaacttactgacaacattaagtgaggtcttactagagtttttgaccttcatctgctgtctcatttctctttccctgtctagatgcaaatcagtcatttattaactatgtattacatgcttcttaattgtcgagcattatgttaggcatgtttgacacacagacatatacactcaaagttggatagatgctgctatccagagcattgtgtgtagcagccttgctcattgcttttttctcctgtttccatgtactggagtaagtttaagtgagtgcccaggaagctctacagagtttgttaaatagagtctgtagagtctgccttctgagagatgataataattgaccacgctgacaaggacagacatagaaaagaagatgtgtaagtgatacaaggagcctgtcctgggatttggaagctctgagtttgagatgtagttctgccacttaccaagtaccctttgtcaagtcagttaaactcttggaaatgtctgtttttaaaatctggaaaatcagaataacattgcctgttctatacatctctctaggtctgagaatcaagtagtgtaatatctgtatacgcaagctctttgctgctacagtactgtatcactacaaactcttagggttatttaaagctatgtgagcatagaattgatactcttacatatttatttgattcttcacatttaatttgatcctcaggacagctcactgaggtaaacagtgcagtatttgctatttctttgaacagatgaggagactaatgttcagaaaagttaggtgacttttcaaatgccatgtagttaccggtaaggagctgggactagtacttctttatgttttaatttcttatgcttgagaactgatttaatataccctgttggggtttatttagaggttattaggtaattggtagataggaaagtcctacttagtagtagaaacatctttaacatgtttacttttctcaaatctttatgtactcctaccattttgaccccatagtacttatagtttattcaagtatagaaaatggaacatctttcctctttttcctttgcatttccattataatcagtaccctccctgaggcatcttacttagcaaaggcacttatatacttagtaaaataaaacaatcccctttcatgccctttgtattttgttgagatatatagcttttgtaatttctgttagttgggggcaaaaataaaggttctacctctaatctaaattgatttggagcaagtatatgtaaagcaagagccatataccattttctgttttaaaatgagaatatttttcaaatactttctttaaaatttcatttaggacaaagtagatgctggcttgcctacagcaattgtaagtatactttaactttttaaaggtaagttttctatttgattgggttttcttagatttatcattacattgttcaaaatactacataagttgttatggtaataaattcacaagtcattttactgccagtaatcaggtttaacatttatccatgttgaatgctttcttttttcctaattttttgttactttttaggcttttgtttgagaagcagataatggagtaatattagccttctccaggtttatttgtttgtagtactaccctgcccaagtaaatttgcttcttctgtgatttggctccccttccacaaggaatggaaagcatcatttgataggatcactttgtggaaaatagtacatttaacagctctggattccattgtcaggcttgccaaatagaactctgttgcagtattgtagagaactaggggatattgaaagcacgctggtactctctcttcttgtcttcctccagtgcctttttagcattccttttagtcagtctttggtaaggaagtgggtgagttttgaacactttggatggctttaggcccctgcggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctggatgaaattcttcttatttacaatagtttgtatgtcatctggtgcctagaggaaggcaggccaacaaattcaactctgattatttcaagattcttaatgtaatgtcttaaaacgtaatcttcccttttgttttcaggcagtatccagtctgatagcagtgggtacatctcatggattggctttaatatttggtaaatttttaagtgctttcctgcttttaaatattaagtgtccttttgggttttataatgtcctttaatcacagtttatatagtgtacttgattttcttgaacaaaaccagaaaaacttgaaaagtagcagtcagtatttttatagctaaaaattatttgcctcacagctttgttttgctgcttattgcaagtttattttcttcttcatgaatttataagctatcatatctattgatctctctgcaaacctagacaaaaagaataaagttgaagggaaccttgggttatcatcttgtctgcctccggttgttggtggtggggatttttgattctgaatcaccttccagtaatgggtattctaaaagatcttcaggaaaacaggctttctcagtaattttcaggagctctcactgacaataagcttttttaaaaaatttccattgtaaatcactctaaaccgaattttttttggcctgtaatcacattgctttcttggttgaaagagaactagttttatttgtatagtagaagatagttgtattttctcatttttttctacatgagactaaatgactatagtttcattaaaccttctttgcttttgaattcaatgtatgagtagaatattttgttctttttaaatttaaaaactgttagatttttgtggccgggcatggtggctcacgcctgtaatcctagcactttgggaggccgaggcaggtggatcacctgagttgaggagtttgagaccagcctggccaacatggtgaaaccccgtctctactgaaaaaaaaataaataaaataaaattaactgggcgtggtggcgggcgcctgtaatcccagctactcggaaggctgaggcaggagaatcgcatgaacccaggaggcggaggttgcagtgagccaagattgtgccaccgcactccagcctgggcaacacagtgagactccacctcaaaaaaataataataataataaacaaaaaactattagtttttttggggggggtcatttttagtgttctcttctggatattaagtcatttcatctcccttaaatgaaagacttgagacactgtatttagtaaggaatctacagacttctatatggattacctgagaatacttaatagcagaaccacgatttgatttctgtggggccttgcatccttatttaccatggaagtggataactagttattttctgttggttttgaatgatttggcttactattataaattttgtattatgacaaaagctttttaaaatgtaattgtaaaacctagtcttttcaaaggtaattgatttaaataagagttttattgtttggggaccagaagagtagaaacaaaattataattcccttgaaggaatttagaattgattgaaaaagactcttaaaacctatatagttgatatatagtcatagtagaaaatatagaaaatatagatgagcaaaaagttgaagatataccaaatcctgccatgtattaataatccctaacatttttgtatgtaatcttttagtctttttttctgtacctatatatgtgtatctatacaccctcaaatgggatcatgttaatttgtaaactgctttttattttaatgaatatctttccatgcagttatatattttgtctgtaacatcatttttaatggctatatagtattctattaaatggattcttcctaatttacttaatcatttcctactataagacatttaagttgtttgtaaacatatagtactgtgatgaacatcttcgttactacatttctgtgtccatgattacttttttaggacagatgttcctaaaggtggaattgcttggattaggagatgaacattaaggacttttgatatgtatcatctaatggccccctagaaaagttctgtcagcctgctctcctatcaggtgttcagaatggtggtcttcctgtggggcataattaatgttagataaatagaattttgggaaagaaacttacgaggtcatttagttcagtccccttattttacatctgaggctgctgaggatcagagaggttaagtgagatgcacagagccaagttcagccaagttcattgaggaatgctgaatcctgtataagtgtatttccactattctaagcaattctgctatcctgagagaaaaggaggcaaattctaagataggaagaaaagaataaaagaactaaggtgaatgagaatagatgataatacatatatttgtcagcagattgcatgttgatttttggttcccatttaccagtactcacttctcctcacctctatctgctttaacatccctttcttgtcaatgttataagaatatgtggaatggcgtgaacccgggaggcggagcttgcagtgagccgagatcgcgccactgcactccagcctgggtgacagagcgagactccgtctcaaaaaaaaaaaaaaaaaaaaaaagaatatgtgactgcttatcatcaaactcaagtatagcttactgcaaacaatttaaaatgaatactttacaaataaaaactagcagaggaaaagagaacattgtcttttgatactgtctttttaatttccttgggcctggttcctggttttttttttttttagaccccagtagctttcttgtagatatgaggaaataatctttcattacagtctcatggaaaagaaagtatgtctaagtgaacattttgagaaagaatcataatattctggttgtgctttgggtattaatagtgtagctaataaattttactcattactgtttataggaatcagatgtttggacaacgtgttttatcaaatggattaaaatatgcttgaaagcctggcaacaaatggcagagtaataatactataaagtgtctagaggcctgggttagatctcatctctgttaaacatctgtgttgatcataggagaaagtgtagcaagaagagctatacttgtttaagtactgaatgtttctctttgaaacagaggcccaggtcattaagaaagaaaccattataagtttcttgaagactgatgtttattgcctcttcttaagtaattataggcatatagtgtttaaaaaaatatattggtacttaccttatacagagtcttaaaagttcaaatcttaataaagatgtttccccatcccagggttcttagttttcctctttttttttttggttattagtgtacttcagtagattatctttttgaaattgtttttgtttttatctaacttaaacatggatttacttactttgctctaatgagagtattatggattttttcccataacccatagctgagcataatcataaatactagaggcatcacttaatcaaatttagtatcattcccacagataactaaagcttgtcacttatattcttgaaattttttacctgccttttcttcgaacttttgaactgatttcttgcttttctttatctttcttgatcttttcttcatggattcaaaaggaaaaggtatagtaagtaattttagtttgcatgaatggtttcttttggtctttttaatgttggaagagaatgctaccaattatagtcaatgtcctcttacgaaatgcttattgaaaaaaacccagctaattgaaaaattagttaagtgggaaattgtgaaaaactgtaaatatatatataccttcaatgttttaactgaaaaatataatttttaactgaaagtatatacattttcatttttcctttgatcttttgatgtagtcccaaaccttttctttgagtttgtatttgccacttgggttctgaagtatcttttttggcataaactttcatcattaatgggtcatgcaagatttgccattttaaattttaaaaatgaggtgaaagcttaagcacctgtgagtcaatcaatgcatgcaaaatcctagattttaacaaaactttcagtcttttcctgttatattatgaacaccttattttgtgacagttttgtatagaaactcatctttaccaagtttttctaaatcatcccatttaatgttcatggaaacaacagctctttctttttcactctgtttcattggtttatttactgtttaagttttaaagtacagtaacattacaatggcatgaacaggcttgggaatgaatacagctgactcatagtaagcataagcattctggaaaatatccaactagcaatggggattcagtatgccctggcttcagtcagtaagccttacagagggaaggagaacttgaattctgtgagttggtttgctggaggtcaggtaaaagtgcttctgttgttttatgatcatcgatgaaaaatgtttcctgattagatcttttctccctcggtcctagagaatattttagtgtgaataaaggataagaaaaggctggatgtggtggctcacacttgtaatcccagcactttaggtggccgaggtgggcagatcacttgaggtcagtagttcgagaccagcctggccaacatggtgaaacccgtctctactaaaaatacaaaaattagccaggcatggtggcatgtgcctgtaatcccagctacttgggaggctgaggtgggagaattgcttgaactcaggaggcagaggctgcagtgagccgagatcgtgccactgcactccagcctgggtgacagagtgagactctgtcaaaaaaaataaataaataaaaaataaaaaataagaaaagaatagtattaaagaatagtgaatattggccaataaaggtagagttccacacacacaattaaactggattcctactaggatgtaggtatttccttctttgagaaatagaggattgggctaattttggtatatggaaagagttaacagaaattcttgaagtatgttcaaatttagattttagggctgttacagactttgtacattatttgtgacttttctttgctattcagcatattattcttaagtccagaatatgctgaggagatctactctaagcaaagtgtactttgaaagacatgctaataaaagatacagatataattcagggcaatgccaaatagatgtgttgtttgtgatatttggccttcaagttatctaaattaattggtaagctatattactgtcataaacagtaattccttgcatttgtgccatttggtgattttctaatttttcataggcaaaactctttgtcaactcagtgaagtttataagaaaggtgatagtctcatttcatatttcttgccagggtaaccattattaagacccctgcaatttttttaaaacacagatttgacagtagtaaccaaatatacctttatgtgactttgtaaagaaattagatatgctgttaatttaataactttttccaactgtagacaaaggagacttcagagaggaggaggagaatagaatttttccttttaaattcatgaaatcaagagtaacctggagtggctctcattttcaccttctgtccaggtcattttgttctttacatgtatccatggaatttaagtgttttgaagaggttttatgtttattttggtcaaatatttcccagaattgtccagaattttctggactacagaatgtttagttactctagcaggagaaacctcttcaataagactgctttcttctttccacagaaattctaccttttctgaatttagtctaaattatataacagcaagtttgttaacatggtactataaggataggacatatgaagaggagtggccaggcacagtggctcaagcctgtaatcccagcactttgggaggctgaggcaggtggatcacttaaggtcgggagttcgagaccagtctaacatggagaaaccctgtctctactaaaaatacaaaattagctgggcatgttgatgcatgcctgtaatcccagcaacttgggaggctgaggcaggagaatagcttgaacccgggaagcagaggttgcggtgagcccagatcgtgccattgcactccagcctgggcaacaagagcgaaactccgtctcaaaaaaaaaaaaaaaaaaaatgtatgaaggtaccaataagagcttgataaatatctttatggagtcaaagtagattacatttgttacactgtccatcatgtctctcaccatcactgctgtttttttttaagtgtatatatgaatgtaatctataaattagtttgtgatgagcacttagtaatattcaagggacactgaattggttcctttgtgcattatcttactttactcatttattcctcttagcaacacagtgagataatgggcattttctacattttacagatgaagatagggaggctaagtgaatttaagaaacattcctaaaattaccaagacatactgtagttgtaaggcttgtaactatctgtggggtaggggtggaattaaaatccaggtatctggtttcatagtcatgataccttctaaaggaacattataaaaacaacaaatatattgtaaaaaatccagaaaaaagttgagaatgtttccattaacagatttgtgggctgtaaatttaatccatattgcaggaatggctaagattgataatttacttccctgtcttagctagttgatggtatgtgggaacaacagtcaggaaagcacagtcatgtttggtttttaatctacaagttatgtccttttccttccctcatttcatccattgccactcttctctatttcctcttcatggcacccttattctctttgttatcatattctcagttctcctgcttatacttcctgtgcctgaaatagtccgatttaaagtatgaacgttgttaaattagaaagtagtagtgagagtctttaagtattggtgaatcagaactctgtgaagtttggatctcaaagcagggactacaaaggatcttcgcagtatgctgcttagacatcgctctgtgcctggaaggcaagcggtccaaactccagggtatgaaatttcataccagctctatctttgtcctcttactttcagtccatctgttacctatacatgtgacccagagtagaggtatatatggaatactgttgcccaaccatcatatcatgacagtttgcaaattaaggtatgtggagaatccactaactatacagcgtggttctgatgaaataaggatcatgcaaaacattattttaggtaggtagttttggaagagcaaaataaaatgtgatgttatatttagagtcaggaaaattatagaataaagggaagttttataatttggattaaatcgaggaagggtgaaaaaattgtaaggaggagaacagtcagaatgtattgaaaaatatctgtagttgtaaaattctagatgtgaataaagacagtaacttttaaaatacatcagaccttgtatatttatgagttattccttttcagtgttcaccttggaaggctaaaatccaaaatgattgaaaaaaatagagtattttctatgtgctatgtagttatactcattgtttcagaactcttttttgggaaggagggattactatttaagtcattttatgagcacagaaaaggactcttacagtattcactctgaatgggcaaaaggactgacctaatattattccctagacctgagaatgagtgactgtgtctgataactagatttacttttatagaaggagaactggcaaatgtgaaagctattcagatgattgtcagatgccttctaagcacaaggcattaagcaaggtgctttgggagtgttaattcactcatgatcttagccctcagagaggtcatagtgtaataggggaggtaagacataccccaaaattcacatgtagataattaagggagacacaaacagtgctggggaagttgcgaaaactccaagttgtggaaatatggtgttttttgcatttttctaaatagttaaattttgtaggcatgcattctgacatttaaatttttaatttcattgttttcaagtgggtataataatgaactctagacaaaataagcattgcctaggagaaaccctagagaaatttcttttaattattagataacagaatttaataaatatttgagtgcctcctggagaaatcagaggtgattaaggcaagatcctcgcccttatcacccttaacaaacttaatctaatagatatttgaattgcttgcttttagcatattttgtttgtttgtttgtttgtttttgagatggagtctttctctgtctcccaagctggagtgcagtggcatgatctcagttcactgcaacctttgccttctgggttcaagcaattctcctgcctcagcctcccaagtagctaggattacaggtgcccaccaccacacccggctatattttttatattagtggagatggagtttcactgtgttggccaggctggtctcgaactcctaacctcaagtgaccttcccttcctcagcctcccaaagtgctgggattacaggtgtgagccaccgtgcctagccacttttagcatatcaaattttgatgtttgaaataattttctgaagctgtttaaatgtttactctgtaatttgcaccgttaattagcttagtaaattttctttatggataatataaatgtaaatttcagccaaattctaaattaagtttcttgagttttgaagttttatagttattttaaaagacgatggtattcccgataactttgcatcttaaaaatagcaagaaatacaattctaggatgagacaggtgacggtttgtttaaggagatacagattacatgtggattttttggcttatcattagcattttttattatgcttccttgtagatcttttttttttcctgtattcttttttttttttttttttttttgagaccatgtctcactctgctgtgcaggctggagtgcggtagtgtgatctcagctgactgcaacctctgcctcccaagtttaagtgattcttgtgcctcagcctctggagtagctgggactacaggcgtgggccaccatgcccagctaatttttgtatttttagtagagtcggggtttcaccatgttggccagcctggtctcgaactcctgacctcaggtgatccacccacctcggccttccaaaatgctgggattacaggcatgagccaccgcacccggccttttttttctgtatttttaagtgtctaattcaacgcccagcatctgctagttgctcaataaatatatttaaaaatgaatgtgacttcattatctgctgcttttgattcttgtcacctcccaagtctttgaaagcatgcctgtactcgatgtatttactctcttgcatttccttcacttgactttaaaaactgctttctttagatcagaatcaagctttgcgactctgtctgggtagcactagtgttggaggtcagtatggcgctatctctgccctcagtatcaacaatgattgctcaagacttctttgtggctttgctaaaggacaggtaagatatgaacctcctttaattcataagacaatgttaaaacaagatgaatttacaaaaacttacatcttagatcaaagaccaaaatacgtgttatgaagtaatatgtttgtagagctaaccagagattgctgaatctgagttttgtcttgttcaaaattttacataattgttatcgactgacccagagtctgtaattttttatatcctagttcatgtgtctatttgagtaaataatttttgtaaaccaaccagggatgttatataaaatgtacttccttacagtcgtgtaaataatggaggctgctttttagaaagattctgtgttcctggataacgatttttgcatttctttcttcttctgaaactggcattagattatggtttttttatcttctgattcatacatcactagctagtttggcagtaagcctttccgatactttttactagtgctaaacagattgacttattagagaaatatcttttgtctctcagtatgagaacaacatttaaaatctaaagggagaagtaggatgggcaggatgaagggtaaatgaagatcgaataaaggctctatgctttaatggatctgcaacctttaggtatgttttaactttatagttctttgcctgcaatgtttatagtcaaggaatagattattccagccagaaggcaggatacttaagtccaaaaaaagagcaataaatttgtttttgaagcacttagttgtcttatagatcaccatgtgggatttggccagtggaaaacttctaagatcaataacagatgctcatcctccaggaacagcaatattgcatatcaaggtaagagctttattttcttttcctaataatttttttattatgcctttgtgtttattttaaagtaaatttctctatgttgatgatcagagtccaaaaaatgtatttaacatgaagctgaacattaccttataaatagaatcctcaacattgagctgtcttttatttgactagcccaacatgatgtttttccaggttaaaactagagatgggctagtatggaaatactcagcttcaagttgtattgaagtctaattgatacagcggcaaaaagggcaaattggtgtgttgctagactagagtttggccataaagatgggcagcaccctgctgaaactcatatggagctcttaaaaggtctttttacctttgtttaggtcatcaaaattttattgctgaggtggtgtgctctgtcacccttttttgggagttgcctgaggttcaaggcacagatcgtgaaaaaaccaaggtttggattatgtttagaaatgaatctattggtttattttctttcaggcctctaaagggaaagcattaagatcctagtcttggctttctccttataggcctgaaaaaataaactgacttaggtaacagatttcatttataaatacaatgtgaatgttgattcttccacgctgtcaagcccatgttcagaagcataaaaggtaaaggattataactagagaagtctaaaatcagatcttctagattttaatcatctacacattttgttgcttagctctgcagagctctgtcatccgtaagtatgctttttaaagtctgcaagcatctggagtttgtatgtctgtatctaagttagttacaaaaaagtcttctgtgacagagcagcgttgaagcatttagtaacaataaaaacaaccaagacaagtaaaagtggagagaatttcttctctttcagagcattatggcaaagtatcttgacctcttttcatatggcttgtgccaacttctaatatgttatagttgtttgtatatatgtcttatctctcttagtggatgaatgtctttgaaatcacaatctgtttgtcatttatttttgtgttttacccatagtagctgctcaataaatatttgattgaaggaaaaactagatggtggtgtttatacaagagaaatccttttgcagaaaaaaaaatactgggagaaagaataagaaacagaagagataaaagcagagagaaaagagaagaatgcagttgagataaataacatatagtaggagccattgtgttgcttgacaatggtgatgaaggtggtacatgtagataataacactggagtaagacacataggattgaatatttctgaagtcttctactgacatcagccacttgcattttaatactcctacacgttgttctccaaacttaagcctgtatctcatcaataacaatttggaatttcattctttatggatatttatgtgtgtgtgtgtgtgtgcgtttatatgaatacactactttactaatttttatgtacattataaagcacgtacaaaagaaatagaaaattaaacagaaatacaagttctgttatttttcctgcactccagcggaccatgtcatgcacacacctagggtatatgcttcccactctggcaactgctcatcgaggctgtaagagcaaagttgtggggcttcttaactatgcgtgtgtttgggtcaaggaagaagaattttacagtggcctccagtacctcagccatccctgactgggaacctgaggcgtgctatttaggatggttcactaacctttgagtttagggaggatagtcactgtaaatggtacaagttcagtttattccattttgtgtcatgcagcattgaccatacttcaggtcaccttaggactgtctgtcattgtgaacatgacttattattctgagttttctaagttaggtagtgataactgaagtatatgctgtggaagaagatcaaggaggtagcacgttttgggaagagttacatatgaaaagttaaaatgttttagatatagtggacttacttttcagctattcagaagacatattcagataagtttatttctcaaagataccaagtattttttagagtctttattctttaaaactgggcaggtgtaaatgtaaccaaaggatctcatttacttagtaatagcaagttacaaaaagttattgtaagaacccaaatagagaactttagggtttttaatcaatcatagtttgtatttttcttttatcgtgatgaaaggtggttttgctttttgaaagcctctgtttttttaaagatattggaccattattactctaaataaaggtaagtttgtaagtttagagtgatgagcactgaatctagtttaggttatttcaaaagctattaaatgtgtatattgtagtttttcaaaattgtataattttttcctccttaatacttgactgtttaaaaatgtacaagaaaataaattccttctctgtttagtttacagatgatccaactcttgcaatttgcaacgacagcggaggctctgtttttgaattgacatttaagtaagagactagtggacatttgttgacaaatgaaaagactagctctgttttaatgatttgaaattgaacatgaagaggactagaaagcccctgtaattgagagtagattatgactgtgtattacaattacctgggaaggcttatattaatagaacaaacagagttctgggcctggtcctcccgagttttatctcagtaggtctgagttgagattctagactcctactccccagaagattcttatatgctgtcaagcttgggaccactcttctggaatagctcactaattttggtttaggctcaaggcccagttgattttaatcataatgggcaggtgtaaacaggtttttaattatcttagaattgccatgtttgctctttaagagcaaagactgtctagatacatcaaagaacatttaggaagcagagttttttgaaaagtagaacataatattcattgaatattatgtctccataagttcttcaaggttaacaactatctttgtttcttgtgtttctcatagcttctaacaatgctaagtacaaagtaatttctgaaaaaaacatacttcttattcagttaatgtttattgagcatctcctatgtgtaggtatttatctagatcccagagttatagctgtgaaccaagcaaagtttctgctctaagagaacttacattctagctgcagtaagggtaaggaaacagcaaaccagcacgtaaatgaaatcacctcagatggatgtaagtgctgtgaagaaaacaagacaggggattgcactaggttgtacttgaggataattctggaatgcctttctcagaaggggcaacatctggaaaaataactgaatggtgagccagtcaacaaatgcacagatctgaggaaaatattccaggcagagaccattcagacacaaagactttgaggtggccacaaacttggcatgctagagcaatggaagaaagcaggtgtggctggagtgtgactttgtcaggaacacaataatgggagaggagtgaagggagagccagatcatatccttttaagacatgggaaagagtttggattttattttttatgtacagtagcaagccagtggactgtttttggcagaaaaataaatgaatctgacttgtataataaaaagaccatgctgctgtcctgtggagcttggattgttgggggttaaggaggtaggaggtaggaggctatgaaagtagtccaggtagagatagtagtgccttggatcattgctaaattgattctgaattttcaaattgcattttcaggagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaagtaagtgtatttagaagttaaaactcagaacttttagaagctttgaataccaaatatttgaaaattccaaggtcaatattgaaaacatatttttctcttacagatactggtcattggattgaaaccatccttgaaagtatggatgacttttccctatggccgggtgagtacgtccctccatcttatttgccaaaggaaggaccatgtcaggaggttgagagagatggcttgcaaggggtgaattctatgagattgtcagaaaactagacaggatgaaagtcagtgctccagagatcgttggctggacttgccttaaggtgatcaaagcatcataaagctgatgaccagcacagtgtcctagggatcatgagtcttgtacttttccactttatcactttaagcttttctctcatagacagcatacagttggcttttgttcttaaccttaacttgacagtccctgtatattgctgtcctggtactctgtggtcacacctaacttcatgcatggcatttcctagcttcattcgttgcccttctgagtgcagtaaaattcccttatcagatttaaagttgaaggataagttgatttattgagtccaagccctgattttcagtgtttgaaagatacttgtttttacatggctgctgtgctgagacaggcttatactcactgcctgcagctttggcactgaactatggatagagtagaccccactgtaatatgcgccatagattgctattacatgtgctttccctggcttctgcctctgataatttactttggaggatgatacttcctagcatgtgttatttatatcccagttttcccttttttttcttcttgattgttttcagagttgtaatcttccaatgtatatatgaggagaggtgttgataggatgggatggagaatggtggtacagaactctggctggtgcagaaagcgttccctatggtgaaggaactcacttttgttttcttgttggtaccctgtgtgtctctgggccctaggggaagcaggtctatcctttcagatggcaaaactggcttagatggccattaacatttgttagattagcttcattggcgaattgagatttttttcatggtgttatgtgtttgcttctttttgtatgtttttattgttttttttcaacattttattataaacattttcaaacaaaattgaattttacattgaatacttgtatagctaccatttaaattctataattaacatttactgccctttattacatatctgtccatctacccatccctctgtccacttatcaaattatattttttatgtatttcaaaggaaatttcagaaaccagtattctttcccctaaatatttagcatgcatattattagctagagtttaatacttctttaggtttttcctttggtgtagaatatacatacaaagaaatgcacagatcttgagtgtacatttgctgaactttgacaaatgcttaacacttttgtaactcaaatgcctatcaagatgtagaacattaccatcaacccagaaagttccctcatgatacctcccagttagttcttgctttactgagaaattggggaaagtttttatcaaggaacactagtcagatgctgtttttaaccatagttttctctttgtccccttgtttattaactgtgatgattttttttttccatctccctacttagatggatccttccagtgtgccactgctggcctggcactttgtagcagtacaaaattacgtgaatcccatgcttgccttctgcagaggagatgttgttcattttctattggtaagtcctaatatgaccattagaaagcctcttacaattttttttattcatcagcaattaataatgtgtcagagaaatttgtgttactatcctaagtctttggagagagagtgacctatttaatttttatctaaggctttaatgattagcatcggaaaatggtgatcactctcagctacataacttctcatggtttatttctcagcttcatttctttgactgacaaataattaatggtatatgtaaatgtataaagatatgaatgtgaatatgtgttaatgtatgtgcaactacatatgtgtgtattaatgacagcaagtatcattgagcacctattatgtcctctacactgtgatgggcacaagcagcaaaggaaagaaggaagtatacaacataatttcatcttccacacagcttataatcttgtttgaaaagcaaaatcagtgtgttcattattactacagaaaatggtttaaggattgaactatgtgatgaaaatcaagctgatgtaaattcagagtacaaagtgattagtatggactagagagagtattaatggctttatgaaggatatactgcaactactgcaggaagggtaggtatgcatactgggggaagtgagatgaactgaagtcacagaggcaagaatgtgcctttgtattaataatctcttgcgtttcctagctcagtgaagcaagttcaccactgtccacctagtttctccagccagaaacttacgagttacttttcagttacctttctctcttcatatgtgctctatcaccaagtcctattgactctacctccaaaaatctcttgaatttctccttttttgtctcccccattgctgtttccttagtctaaatcatgtacatgtctagcctggattctgccatagcttcctagctagtctctggcctcagtgccttttacatatactgttgcctctgccaggaaagttctgtgctatcttctgttgtctctgagctcatgattaacatgaccttccctggcctctgaactaagttagttacatgcatcttttgataacattcagcacttaaaaaaaaacaaaagagggacgaggtcttgcgggtctccaaccaaggcccaggctgactctcgaactcctggcctcaagcgttcctcccacctcagcctcccaaatattgggattacaagtgtgagccattgtgcttggccacattcagcacttttaaaattacttgtctaatatttttcttccccactagacagaaagctccataactctagagaccatctttactgttatatttccagccactaggacagtgcttgtatattgtaaatattcagtaaatgtttatagaattaatgacaaagagaaacttgtggtggaaaatataattgaatagatggggtggattgatagtaggggttggcacactatggcccatgcgccaaatctggccagccgtctgtttttataaataaagttttattagaacatccccaatacaacatttgagagtcctatctttactttcaactcaacacattgaaatattccttaatcattttcttcctaaacagtatctcttcaaatatttcttgattctaaaatgtaaagtcagaaatgggatgtttcattcatgtccttcagtctctagatccaatatgatgagaaggcttgtttttccttgaaagtatcatcccttaactctcactgcaaccaaccctctttgtataaacaccttacatgtgctttattatgagagaaaaacctttaatgtttctcctcccttctgtgtgtattctttttgctacttcaagactgatcttcctaaaatgtcactttaatcccgtctttatgactttaattacttaggaacctgtgatgactccattaccagtctaggccaatcattattaatctagatcaggggttagcaagctttttgtgtaaagggccacaaagtaaatattttagtatctgtggaccatatattctcgggaaactgagaaagagtaggtgactgcccttggtcacacgggtataatagtggaacttagatatatggctctagatcccatgttcattttaccaaaagatcttttcttaagggagaagtgatttagtgaagtgaagaggggtccacatgaagggcccacattaagtggtttcagatttttgttaagatatcaggtgaggtcaccactgtaagtgatgggatcagaaggtaacttaaagggaaagacatctatgatactactatggggagtgtgcaagaaagcccaggttgaattgaatgccatgaatttcaggtggtcgggtgtatcttgtgctttatatttcttcagtgttctgttaccttggagcagaaggggaagaagcaaattataaggatgactgaggatatagagtgtgtacttatatacatataaataaaagattgacactcaaggtccttttgggaaattttgggctgcaagagttacacaagggaacttcaaaaagtttgtggaaaaatggaattaaaaaataaaaataaattttatttctcaacatcagcttcatcttgttcaagatactttttaaagtgatgataccagccatatagtccatcctaaagaactgaaggtcttgggaatttaatcatgccaatgcagtctttttcacattattaactaaagagaaatgggtgccctttatagactttttctagattagaagacgaaagtcacaaggagccaaatcagtactgtatggtggatcgaattgctctcaaaattggccttgtgtgatgagagcaatgagcaggaacatggttgtggtggaggactctctggtgaagctttcctgggcatttgtctgccaaagctttggctaactttctcaaaacacactcataataagcagatattattgttctttgttcctccagaaagtcaacaagcaaaatgccttgagcatcccaaaaaactattgccatgacctttgctcttgcctggtctgcatttgctttgactagaccacatctgcctcttcatagcctttgctttgcttgtgctttttcttcaggatcacactgataaaaccatgttttatctcctgttacagtttttcaaagaaatgtttcaggatgttgattccacatgtttaaaattcccattaaaagctttgctcttgtctgcagctgacctggacacaactgttttggcagccatcaagtagaaactttgctcaactttaatttttcagtcagaatagtgcaaactaaaccagttgaaatgtctgtggtgttggctgttgtttctgctgttaatcgttgatctctttcaattagggcatgaacaagatgaatatttttcctcactaattgatgggtatggtctacagctgcaggcttcaccttcaacatcatctccttccttcttaaaacgagttacccatttgtaaactgctgatttctctggggacattgttcccataaacttttattaagcatcagtgattttacattcttccaccgaagcttcaccataaatttgatgtttgttcttgcttaaattttagcagaatttatgttgctctttggggctcttttcaaactgatgtcttatcctttttaatgcctcaaactagatccttttcagacatgttataacaagttagtatgagtttattttggtgcagacaatttttgagatccatgcatagttttttcatagtatacattttccatgaactttttgagtcctctcataataatatcatagttcagaaaagtctggtttacatcactgcagcatctctttttctttaatggacttttgacttcctcacaccatgtcacctttcctttttgtactttaattatagtcattgatgtgataaagttaggttgttctgaattataacagagtgaaaactatgtcacagcatttgtcagtactgacaactagaccacccccagatatgccctgcattttggtgtaaataatggaacaaataattttttttctattttcataatcatttgtgtaattatcagtatttttggcttatctacagggaatgggataatgggtaaatgtgatactctaggtggagtataattaaatatctaaaaaagtccctcaaacagtagctggtttttaggttgtttttatttcatcatcaggtaaagagagatgaatctggagcaatacatgttactaagcaaaagcatcttcacctatactatgacctcatcaactttaccgtgagtattattcaaattaaatatccccatttagttcatgtaattgttctgaatctatgatatattaaagctaccaggatttctgccaagaattattacctttaagatcatatgaaatatggacagtccggcaccgaggctcgtgcctgtagtcccagctacttgggaggccgagctgggatagcttaagcccaggagttcgaggctgtagtgctcagtgatcgctcctgtgactagtcactgcactccagcctgggcaacatagtgagaccctgtctcttaaaaaaaaaaaagtatatgtgtgtgtgtatatatatacgtatatatatgtatgtatacgtatatatgtatatatatgtatatatgtgtgtatatatatgtatatgtatgtatacacacacatacacacacacacacacacacacacacacacacagaaagagggagtcctggttatattgaataaactctgaatgtggtgtgatgccacaaattattgcctttcagtctatgtcctgctgaacacaggcaggattagaaatttaatgtcttgtttagctcaaaggggagtttggcttcagaagaatttaggtgaattttttgagaatcattgccttgctttctctgtaaaacattttttgtatttttgagctttgtcttcattgattcagcagcttgtgcaacctctttttttcttgcggctaaaaactttgcagagctctctttctaccatgcatctcaatcctgagtgacttcttggttttttttttttttgagatggagtcttgctctgtagcccaggctggagtgcagtggtgcgatctcggctcactgcaagctccgcctcccaggttcaagcaattctcctgcctcagcctcccgagtagctgggactacaggtgcccccccatcacgcctggctaattttttgtatttttagtacagacaggatttcaccgtgttagccaggatggtctcaatctcctgacctcgtgatctgcccgcctcagcctcccaaagtgctgggattacaggcatgagccaccgcacctggccaacttcttggtttaaaaagagatttctttttgtatcaaattttattttttctctctcaaatggttcgttaattttgagaacaatgtaattataatatttctgggttcccatcattaatacattttagcacatcagtgtctggtgtccagtaacattctgtagatgcatgaatataggcaaccctaaatataaggcaatgcctcatttttctaataaaaagaatgaaaaagtgctttttcctcaacttgataactgtaattttttaggatatagatgaagtaaatcctttctttacatgatttattgatttagttgtacattacatttttaactcgcagacagttgtttagaaataattctttcttccatacacattttatgaaataattttgttcagactcttagaagacatcagtgttgtcatcaccagaactgtcttgttgaatcatgtcatacagtttttcagaatttatcatcataatttctgtttaagatgtttgagatacagtactttaaaaatctgcagaagtgtatgtgaccattaactgcattgttttgtaaattacccttaaaaggcttatttacaacaatgtcaacacttgcaacgctgcgggtctaatctcaggaataattactaaacttattgaggttcatttttttctgccattctcttgttttcaccaggtgacctctgagagtacctaagaactagcactgattaaggttgtataaggctaaataatgtgatttttcccagaaaatactttttctaaataaaataattaagagagcaccttataagagctttctgtaaaagatttgcatatcaaactccctgttttctgaaagatattttttagaggaggagaggggaacaaactcttcccttagagtggctaatatacagtaatagagtgtattttttagcattttcaactggttatctttaattggacattatgcaaataatatctgatgacatggaatagaacatacaaatacaccagcatgaataccagagacataaagggcaggggacgcacttcgttctggcgacttctgaattctgattgagcagattttaagatttatttcttgggaaacgattgggattgccaaaaaaaaatttgaaaataagaaatctgattttatacataacccaagaaatttgttaaaatggcatccttcagaagatttttaaagttattattgttaatacttttaacattataatagtacttattaaagaaaatttgggagatacagagaaatagaacaaaggactctcataattttaagagagattttgaaggaagtagattgttaaaatagcttctattttaaaatatgtattgtttcagtgctaacaattgtcctctgaccagctaggtttatcggctttactttgttcttttgtttcagcaatatcagaaaaactagaaatgcagagtttgtcatgataatgaagtcatttgtgccaattgctttaaaaaatcttttataaaaaacgatatgctctaatccacctacagcttttagtcttcttttacactatgaaagtgtcattttaacattttcaaaagtcagtagtatattgtacctactgttctctggcctgtcactgagtagttcttgctttgattgtgttgccatgtaaattgttaaatggatcaagtcctcaatgtaatttaatcgagcagccaagctttcttcttgacccaaatgatgaagcgggtgtggtctcacttttgttttgttgtgtgcttgaattacagtggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggtaaggataatcacttatcttgctatcctagaaaatactttgataaacttggtattttgttatagttgttttagaaataggaactctggggagttacctttttctgtcttgaggtgtttctttacaagccactaggttgaagtgggtgtggatgtgcttataagtgtttgggaatacaagctaaaacaatcatttttcttcccttctattcagaaatgtgacttattttacttaataacaaagagttttaatttttatactaaaataatgacgtataatggaaaatttgtgagaaaaattgtaaaaatcaaaatatttttagaaagcttaatttggcagtaataagcctgatagatttaagggataaataactacagacaggtactctatgaggctttggaaatatttgggtgataatggtaaaggcttgaacaggtatggtagctgtgggtattaaaaaacaaagatggctttgagagaaagaagatattctagaaataggtgatagatgagatgcaggagcctagagagaaggaggacgcaacaaagttatggccttagcattaattttattgtatcattaagcaactacagtaatggccttaagcaatttccacagatagtttatagttcagtcaccttgaattgtgatctcatgttcctaaaccacaaatctttaagtaggaaatttagaccattgtgcgaacttccttggataattttttgaaaaaaatagtaatgatggtcatatttaatgagtgactacagcatgatgtgtaggctttgctcaaatctccttcatattataacttcagagcataaaatatatatgaaagggtcttccagcctcccactttaaaaaccaagaaaagtcagaataagaaatgatagtgtaatataattcactaagtgataataataattactgttccatactttattttcttgtgtttgaatggtattaaaaatactagtggactttgaacttgtacttttagccaagagggagttatggggaatcagatttactctcctgcttgaaataacccaggaagaggaaggagaaggagaagggagggggaggggaagggggaaggaagaagaagaagaaaagtaaacagcagttcttaagacactggacatctgtagtgatggacagcaatctctcaccaaatggggaacaaatgctgtgaactctgtgattgtcctagcttccagccttgagagagcatctgggctgtggaggaacccaaatggagcctggaagactccatgatttgagaagacagagccaagttgcaggaagacaaaattgggttgagtttgcaagagagagtactggagaaaagagcactatgaaagagtccctcttgagtgttcctcagactcctaatcagcaaatgcatagaaggaaattgcccaaggaccagggaagagccatttgaaaggtttagagggaaccgtatctagtgctcacacagggctgaaaacagtgcttgttacaccagctagaatggaaagcttcatgattcacagggcattgggtagagtacttagaggcatcttgcctcattaggactagaataaatggcgcactggtcccagctaacacatcttaaaagtaagaccagaaaggatcaaactgtttccaaatcacttatctcctagaagaaaacacaagaatattaataggaatacagaaagatccagaaaccaacaaggtaaaattcacaatgtctcccatccaattagagattactaggtatgcaaagaagaaaaacaacctataacaaggagaaaaataaaaactaaatcacacctgacataaatgttagaattagcagacaaagacatagtagttattatgactatactctttagttaaaaaagttaagtagagacatggaagatatttgaaaagatgcacatcagacttctagagatgaaaactatagtgcttatagatgaaaaaatgcgctagatgggattaatggcagattaggcaatacagaaaaaacgattcatgaatttgaagatacaacaatagaaattatacaaaatgaaacgcaggaaaataattttaagaaatagtattagtgaactgtgagaccacatcagatagcctaatgtacgtgcagttaaaatctctaaaggagagaagaaattggaaaaactaatggtcaaaaacttttctaaaactgtagacacacacatttaagaagctcagtgaacccaagcacaactaaaataaactgtatacgaattgatcaaaattaatgataagtagaaaaattttaaagcaaccagtggggaaaaaaagacacattaaatgcagaggagcaataattatgagaacccatttctcatcagacagtcaacagtgatctgtaaagatttagaagtggacagtgagcacttaaagagctgctcaacatcattaggtattagggaaatgcaaatcaaaatcataatgagatactgcttcacacccactgggaaggctatcataaaaaaaagaataacaagtgttggcaaggatgtggcgatattggaagcctcatacattgatggtgggaaactaaaatggcgcaaatgctgtggaagatagtttggcacttaattaaaaggtaaacattgaggccaggcgtggtggctcttgcctgtaatcccagcactttgggaggccgaggcgggaggatcacctgaggtcaggagttcgagaccagcctggccaacgtagtgaaaccctgtttctactaaaaatacaaaaattagctagacttggtgctaggcacctgtaatcccagctactcgggaggtggaggcaggagaatcgcttgaacccaggaggcagaggttgcagtgagccgagatggtgccactggactccagcctgggggacagagtgagactccatcttaaaaaaaaaaaaaaagttaaacattgaattaccaatctgactcagaagttctactcctaggtgtgtttccaaaagagttgaaaacacacgcttatataaaaacttgtatatgaacacacatagcagtattattgttaataaccgaagagtgaaaacaatctacatattcactaactggtaaagggatgtacaaaatgtggcatagccatttaatagaatactgttccacagtaaaaagtatgacagctgatacttggctacaacatggatgaatcttaaacatactaagtaaaagaagacatgcaataagagcacattttgtttaattctattcatataaaatgtccagaaaaggcaaatgtaatttatagagacagatgtacattagtggttacctgggtttggaggtgggaatgggagtgactacaggtgggtacaaggatctttgcagagtgatgataatgttctcaaaatggattttgataatggctgaacaactgtacatttactaaaaaatcattgaattctgtgcctaatgagtgaattttatggtgtgtgttatatctcagtactgttgtttaacaaaagcaattgactgtttaaaacaaaaataatgtgttgtgaagtttatgatctatagaagcaatatatataacaaaaatagtatgtagcgctgggatgtaggagatgaaagtacatcattgcaaggttcttacagtatatgccaaatattatttaaatgtagactgagataagttacacattgtaaactataatcactaaaaaagacgtgtaactaataagtcattaatagtgatgaaatgttaaaaaatatattaaatacaaaggaatttttttaccttttttgtatgtatgtttttcttccaggctttggttggagagaaggcttgttatcaatccatcagtagctatggtggtcagatcttttatttggggacaaaagtaagctcttttactctgtgagttggtatttgtatgtatcagggtagttgaggctgaaggagattgctggtaaagagggcagtatattgcaaagtgaatattggtcagcaattatcctaaaccctttgtggttaggtaggcatgatttttagttaattatttttttcctctacttttagacatattctttacttttgtttaggtgctggctaataggatgcttattttcttgattcagagatgtgcttttgtaagcttccttcacgtttatgtttttatgaccaggcagctacctaatcatggatatttgtcatgtacttaagatggctgttagcttagatcagcttaggatgctgattaaaatgtattgaggtatttgacttagaatagaattgttggaataggaactttctgtacctcaatttatctcagtttgttcctgtgctttttaaaaaacatggagaaacatttcttcattattaaaatttaaccaaaatattgccaagtcagtagagggaaatgagcttgggctttccttgcttcttgtccatggaattaactccttcttggactgtagacctttaaatagacttactctttaatgtgagttctaggccagatgcgttgcctcacacctgtaatcccagcactttggaaggtcttggcgggcagatcacatgaggctaagagttcaagaccagcctggccaacatggcaaaaccttgtctctagtaaaaatacaaaaattagccagttgtggtggcaggtgcctgtaatctcagctactcgagaagctgaggaatgagaatcatttgaaccccggaggtggaggttgcagtaagccaagatcccgctgctgcactccagcctgggcaacagagcgagactctgtctcaaaaaaaagaaaagcgttcttgaagacccattagtaaattctaagatatacttctaactgtagtatgaaatgttttacttaaagggatatcaaatgagatgtgggactaggacaaatgtatctcccaaagaagtctgttaagggtgatcattttaatttccatctctttactttccagtctgtttatgtgatgatgctgaggagctggagagaggtgagttccaagtaatttcacatgtcagagttactgaattggtagcttcttaacatttctgttttgacttttcagaagaagattatttggtaagcttcttaatttcagaagtgtacaagaaaaccattatagctgttaggtacttgatttgctagaactgacagtataagttagaattaggtttgtctacatatattagaaaattcaaaataatagtggcttaaataagatttctctgtcatgtaaaagcacctggagctaggtggtccgcagctcttgtaggaattccataagcttaagcgtgctgtcctgttccaccatgtttgtctttgaattctggtctcagggccattttataattcagtatggttgctagagctccagctgttaccacattttaggaaggaagaaagaaaaataaaggctgtctcctacctcttaagatgacatcccagaaataccagacaacacttccacttatcgttagccagagctcagtcacattgttcccagtggctacaaggtagtcttagaaatatccttcagctggtatattgctgtctcaaataagcttggggtttgttactaccaaggaggaggaaatcaatgttgtgataaacaactagccatttctgctacaatggcattccagctatttccccttttcatatttaggccccgtggctctctatactagcatatatagtcattatactatctagtgcttgaagatattatttttctttgaaacaagatattcacataattattaaaataattttagccactaagcagcaacttctggaaggattttaggtggaataggaattctgactggtgactggtcagacaaaggggcctggtttctctcatttttccgttttagagagtggatcatctcctgaaacaagattgtcttacagaagcgttggctcttgcgtggtctttccatgaaggaaaagcaaaagcagtagtgggtgagtaggcagaattccagtgtagtagacgtggttctcctggagtagagggaatggttagtactaaccactcataggacacttttagctgagtgtcgaagtgtttataaacaggatgctaattaaaccttatagactttcagttaagaaggttaatgtgacaaataatgtgacaaatagagggtatagaaattaaaatgtcgcttttaaaattattttgtaaggaaattactattggaatgaaagagaagtacattgatatgctatccggtccagtagatttgaggtgttcctattatggtgtattatccaacattttgatagctaagaattgttacaattatacctgttgtttcacatcttataaatatgaaaccagacatagtttcactcctaaagatgtggactaacttttgtttttttgttggattttccttctctgcaggattatcaggggatgccagtaagcgaaaggctattgttgcagaccgggtgagtattttaagagggtctttactagaatacagtgcagatttgcttttgtcatttgccagtatctttgggcatgagtagataaatggctacaatctagaagagagtgtattaaaaaacacacacacacacagacacacacttggggtcaggggttcaagactagcatgggcaacatagcaagaccccgtctctaaaaaaaaatagaaagattagccaggtatggtggtgtgcacctgtagtcctagctacttgggaggcgaggccagaggatcacttgagcctaggagtttgaggctacagtgagctatgattgcggcactgcactccagcctgggcaacagagtgagacctgtatctaaaaaaacagtcaggttataattccctgtgtcatcttgaatacttttaaaattccttcttaatcaccttttcttttttcccttgctcactcttttatgaagataataaagtacatagccaaaagacagcaggaaggaggaggaagaaaacctgggaatctggattatttctgaaccaagtaatagcccacagaaaattgacatttgttagtttttataaacttactagtaattatgagaactagtgtatgtgcaaatgtttgtgttgcccagaactagcagagaggattaatgttttaatgttattattaattagcatcaatataattgatgctaatatttaatattgaccttctgttcctactctagactgggctgaattaattgactataggattccctcccttttgttgtgtaaatgcattggtaaaaattatattccaaattagtataaacatttgtggaaaacctggatagaaattggttactccttagactccgaatgatttgctcatctgtgctctttagggaaacacctacagcgaggattactgaagaacttgaatgtttcatttcctgagcagtatagatgccactgaggtctagaacatggagatatttcttaagaaagattagcaaattagtactagccctgagactggaagaaatgaggctagagttttaaaaagttggtaaataaagccactaaaattttcagttaaattttaataacaaattctaattatgtattatttaggagagccacatacatattgaaaaactttagagatatattttaatgtctatgccaggctgttttccttacagatggtagaaatcctattccattatgcagatcgagctctgaaaaagtgcccagaccaaggaaaaatccaagtgatggagcagcattttcaggtacacattgcatgtgcttccagtagacgatgctctggataggtctaatactcctcttttatgttacttgagaatgtgactttcatttttggttaaacatttttttagtattcaaaactttatttcagggcttgtagaacattctaaatgattatatttttaagtaatgggtataaatgagtaaaacgttgtggagtgttacttagcgcttagctgcttagtggcgtgtggaaggaaaggatatacgtgtgaagatcctttgctgtaaactgataccttatagtggctgacatcctgctcgtctaatatttatgttaaccaggttatttagtactgccaaggtttaaatttagttctcctaggagcacctatgacttaagaataatagatcaatcacaaatatatatatatatataaaatatgatctataaaatatgctaatgaaagacctttagtttatcttggaacttaatgaaaatgaaagccaaagaacaatgtagacgtgtatgtatttattatgcaggttttactttctgcagtgctctccagttatatttgttgcaaattgctgttccccattcctactactcccttccctctgcctacctcctcttttaacaaatatttgagtgtccaatacagggatcagcagactttttctaaaaagactcagatagcagagtttaggctttgcaggctacagtggtctctgtcacatctttttcttcctttcttttgttttttgattttttaagcaaccccttaaaattgtaaagtccattcttagctgtgaacaatacagaaacaggctatgggcaggatttggctaaagtgtgcgtcccgtggtctgatatgtacttggcactgggcaatagtaaaatttacatgatctttactatcttaaagtttgtagtctagtcaaaataatgggtttttttggtttacattaatggacatatttagaagaaatctagggattttgaagttctaaagagtaggcacaggtcctatcttttcatattctatttgatgcttgtaacattggaagacaagaatagatatggcagttaagagttggctggtatcagagaagcatttggcttcctgaactgtgctgttcaatgccatgctagtgagcttctggtagagtaactgttattactctgtttggctggatgcttattaaatttatcagtagagaaggagaaataagcctagataaagttataaaaataaataacttaggaagaagacatatggtagaaagaaagcatttgggaacaaaactgtttggaaacaatactttatatataagtacttgtgtataccaatgcagtatagatagaaaacttaatatttgtaacaagaatatacctatcaccaagaggttgtaggaactctggcctttggaaggtatactttgttgaaaaaaatcatctagtagaaaaagctaggaggggtgaatggaatgagtgtgtatgtgtgtgtggagaatatagaaaccacagtgttgggggaaaacgtggtagagagcttctttctaaaagatgaaaggaacaaaggtgacgttctgatggagaaatagtaaagaatctcagatacgggaactgtagatggtggtttctgatgcattcctgtagatggtggtttctgatgctgactgcagaacgtacagagatgcattactactaacagatgttagtagtaatgtgctctgtaaccatctagcttcctgttagaagtctcattctgttggtaagagtatctgataaaatttttgatttttcagtgattagtctcataggaggtgaaggaaacaatggaggggactatttctctggatttaatttttactaatgattggggaagtagaagagatagacccttgagagaaaaattatcactttattttaacaatcataataatgatgaaaaatatacatagcatgagtcctctatttcagaaagcaaatatctcagaaaaaaatatgggcacaatcacatggctacaggctccaaaaaaagaatgggttcacaaggaacaggaaattctaaaatttcaaccattcaaggagaaagtaatgttgaaagaaggttctatctgcaaatcacagaacatctataaatatggagaaaggcatataactaaagatacataccagaagtatcatgaacttgtaagactgtcagaaaggagaatgatatggtccagactgtgcctaccacaatgctgtggagtacaaaatagggatttttaacaaagatttactgagcacatacgatgtgccagatactatgtaaagtatgtgacatgtatttttattctcaaaacaacctaaggcagtaggtgtcatttttaatccccattttatagatgaggaaacaggcttagaggagtgaagtgaagttccaaggtaatattgcagtaaatggtggagatgggactcatatccaggtctttctgacttcaaagcccagttcttagctaatcattgtattatactgttattttaagagcaagcacagggagaagatgagtgagaaggggtgatgttaataaatcaccaagaatgagaattacagcaagcatctaaactgtttaatacttaactgtgtggcagacactgttacagaccctttatgcatatttattaactcatttaattcttatcataactctgtaaggtggctactgttactattcacatttgtaaatgatgccgaggcacagagaggttaaattatttgttccaggtcacaaagctaataaatgagagagctagaatttgaattcaagcagtgggcttcagggtttacatccagactgccacactataccacagaacaatgctcctcattttgactccattttcatgaccacagagaatggttttaaagtggaaaagtccagataagtgtattaaaaaactgaagccgaccatatgtaatgtgtaatatcattatgattgttcaactctcaagacccagtagaattataacccatgatactgttgaaacaatctgggccaacatgaataatttgcaagtaactttgcgtcaattttcaaataaggcattcttgattaagtgtggagtatatacagggagacacaatttattccattcaggaggacagttttctctggaaaacgtgaccttcagtgcattaggataggtgaagtgcatgcaccgtcagccacaaatccgttgttttgtttaatcatatttaatcataaaataattatataggttgacttttaaagtgttttttttttttaagtagagtggactttggagactatctgctgacatccccagtgtgaattgtgaaggttttccttgaattcatctcaaaacaaccatgttaaactcatataattacctttttgaaaggaatataaagatagtatattcctggaatgcctgtgacgtaacataattgatttcattaaagcatttgcctaatttttccattatctttgtggctggaatagattagtaaatagtaaatagatttgcagctagataaatatttctacccaaaaatattctttggtggcttagtattaattacatcctaggactctttcatacccaagtttttatcattgatttgggtgaagatttagtgactggcctgtcaaatctaggtagcgccaagaatcaaggttcaaagtgatcttgacaagaaagtgcaatcaaaatcatcatgagttgaaatttaatgaagattaacatcaagacttagattcattagattgaaataatcaaattacgtgagtactggattgggaagatctaggtggacagggttttagttgaccataaacttagtatgagccaattgtgtgttaagactcagatacaggaaagtactggtactactgggctgcctgtttgaaataaaactgctaaggcattttgtaggctgttgataaactcagccacatcccacaactgagatggtggaaggttttaaaaacaacagttaaaaaaaatactgggttgtttaatctgaggagaaagtaagtggagacatccctgcctagagatggtagaaggctgtcctatgggattagccgtattgctccagagggaaggcctagtatatagtgggtggaaatcaggagatgtatttcagtttaaaatgacctacttatgatgtaacagctcttggatttatgcatctcttattatggaatgtattcagataaaggcaggatgaccaactgatggaagtgtttttaaaactttttttttttttttttttttgctcagtgggaaggtctcagattctgtatctgtctcaagaagctattattggagacataagtaacctctaattcggttagttgaaattcctattaagactgatctctgtcacagtcaaaatactgagaatttgtgttttaccagcaggtggcacctcctgcctgctgcctcaattttaatctttacccttggtgaggaacctcaccttttccttagagtcagaatatgtaaggctattcactatttttgcttttctccaaagatcaatcaatatttgtcctgtcttagttatagaaaataacttttggatcttgtcacattttggacaggttgtggcttttatttatctgagaaaagatttcaacctataattataatttatttgtatcataattattatggtaggataaaaaggaattacagtgttttctgtctcatacatcttgagacttgccttttcttctggctttcctcatatgcgtttatatatgttcaagtgtttcccaccctaaaactaagtcaagcagcaaacaaattcttttgtttgcctcacgccgtctctaatatcctatgctttcttgttcacccattctttatagagccagacatcttacaagagctgtctctggccagggatgatggctcacacctacaatctcagcattttgggaggctgaggcgggtggatcacttgagctcaggagtttgagacagccttggcaacatagtgaaaccttgtctctacaaaaaaaaaaaaaaaaaattagctgggaatggtggtgcacagctatagtcccagctactctggaggctgaggtgggaggttcacttgagcccgggaggttgaggttgcactgagccaagatcacggcactgcactccaacctgggtgacagagcaagaccctgtctcaaaaaaaaaaaaaagagttgtctccatttccttacctccttctcatcccttaacctattccatgtctataaattctgtggacccttttatttctcatcttactggtcctcagcagcattcagcacatgaagacttcttgaaatagtctgtccatttttggcttccctgatatcatgcattccagttttttccctacctctctgactgcttattgattctctttgtttattcttcttccttttctttacttaaccaagaaatgttaggattcttcacaatacccttctatttttatatcaatgtttgtcaagatgtctgtgtaccatttacttcaaaatcatttgaagatatttgttaaaaatgcttttttttttttaatttcccaggcctactgaatcagactctctgggattggtgaccaggatttgtagtcagctttcaagatgtcccttaagcacattaaagtttacaaatcactgctttacattcttccctaggtgatataggcacatggctatctaaccagtgttaacaacctagattgctcttctgaattctgaggtctatagagtaagttgcccatttacatttctgcttggatgttttgtaggtacctcagactctgtttcctcacaaagccttttctgaggattcctgtgttagtgagtggatccaccatgcacctaatgcaaattgggtgattcttgtcttttacttgttcctggctattctgcctcctgacagtttctctcatctgtttccaccatgctgttaattctgccactatcctagtctaagtgcccatcatttccctcttggtatattatagaattctccaaatcgatctctttgtacacattcttactgtacttcatttcattttctacacagcagccaaagagaaatgtatatcaaatctagatatgatgctttcctaattttaaaatattttaaggacttcctattgtttctgaggtagagactaaattccctaacattttctaaggctctgcatggtctacgcttgcctaactgctcctaattctctgtattgctgttatactagagttctttccagtgtcttaacatccctgttctctctttacccagagcctttgtgcacagtgttctctctgcataaaaaatcctttctcatttctttgtagctcaactagctctgtttattttcaggtctcagtgtaattgtcccccagattaactcagatccatttctttctaaaatactatgcactgaagtcactcattcaatgtcagttttctgcagctagcctatgtatgtttagggacctgtgtaagtttaggaacatgtctgttttttgtcattgccgtatgcccagcatctggttcagtgtccttgataaatagttgttgagagaatttttaaaaatatatgaacttatgttgtagagcttgctttgaaagcatgctttcaatttaagaggtttgagctaagaaccaaatgtaggacttagtatttgcaacacatatgtcataatgatggctcatgtggtgtgctgtatgcctgatggctatcttatttagtccttataacgtacttgaggagtgcttattatttacctccattttccagaggaaatagacacacaaaggggttgagtaacttgcccaatatcattgaaccggtgaatagaaccaccatagatacacacccaggctgcctggctcaggagcctcgaccctgtactgtactatgtttcatcccacagtttattctttgataatctcagaccaatgtgttgttatgtaactcactttgaaacagagaggactaagtaatttatgagttttgggaggatattgaaatatatgaaaaagaaaatacaaatgaattttagcataaccatggtaaatatacctgaacaattgactgatttgagttgctagcagtgttttcaaactaagaaaccactgctaatcagttaactgtggaaacagtattttgggttattttattttgctatgcttaatatatgtgtttttatttgtttttgaaacaacgtagaggtataaataatgaggcattttaatgctgtaatgtgaatcaagcttaaaggatttgaaaaataatataattttaaaagaccctttttttttttgagatggagtctcactcttgtcctccagattggagtgcagtggcatgatctcggctcactgcaacctctgcctcccgggttcaagctattttcctgcctcagcctcctgagcagctgggattacaggtgcccgccaccacacccagctaatttttgtacttttagtggagatggggtttcgccatgttggccaggctggtctcaaacttctgacctcatgatccacccgcctcggcctcctaaagtgccgggattacaggtgtgagccactgcgcctaacctaaaagatcttaatgaagccttatgttaatcgttactaagctctccttccagcttcatttcacatttctatgagggtcagataattcaaggctatttttgtagcagctgtaggcatatatttttgcattaagaggtaatgtcaaagagtggacagtgactacaagccaaacacagagcgaggcagtaggagctttccttgtctaacccatacctcctctgagaagatttgaggagaggaaaagagtgttgatgtctagcacattgccctatccctgaggcttgattaaagtgctggttctgaggagtcaggtctttcctagattattttatcatcatacctgaaagaagaaaagaaaaatacatacacacatatacatgcagagagataatctaatctatattgctgtttgggatgtttgtataccaatcctggggataccagctgcctagctctggtagcctgtggagatttatctgtgtgtgtatatctgtgtgtagatagatatgtttatctgttttggtgtatgcgtgtatacatatgtatgtatatataattttgaatcattttcacacagtcaagttttccttatctgatagtcttttagaatataaattaagagaattagtaccatcgctccaaaaagcaaaggaatctgcatctgttatttcttttcaaatcatcccatgaaatagggaaaaccagagattatgtcttcacttcacagatggtaagatagtcacaatgcaataaaatgatttattcagtcactcaaaccattgacaggctcaaatttaggttatctgtcagctcagttttttatttgtatatccacattgccttctttaatacatcttaaatatacatgaatatccgacaagagaagcagtcttttttggcccattatagcccatacattgaagaagagattagagaaatagttacttgttttcttttttttaattttggagaccccaaattcagtgatttcttgcatcctgcaagcttttgagactgagtagaatattcttaatattcttaaagcaggtattgctcacagtgtctatctcgaaagcccttaatctgtcagcatcctgtagagaggcatatgtagaccaggtctggctgtatgaactgagggctttgctgcaagagaaggacttgttctttcccattctgctttctttcagggctctcatgagaggagccttccaaatgagtttagagggatattatctgagcttgggcaccagctactccaggtggttgtttactagtccgggaaatgccagctgcccagctctgtggagcaaggcaactctgtgaggattctgtaggaagttgagtctttgtgtagcccttgccagttgggagatggagagctactgatcccacttagctcattttcaggcatctaagagattgccatcagggattatccactggacaatatagtttgtctctctgtaatctgattctgggaagcaaagcttaaaatatggaaatagatttggctttaactaatactctgttttacttatggttttaaatgttctaaattgataaagacctggcttctttaagaagccagattgaaagtgttaatttggatggttttgccttaattgagttaggaacagttagtggcaggcataaaaagtatgtgtatttggtttttttaaaattagtgattttgtgatatttgtaaattcatactcagttgcaagaaataatgcaaagtgatcccatacccttaaaccaattttccccaataagagaacatctcatgaaactatggtacagtcgcataaccaggatattgatattgataaggtaaagatacagaacattttcatcaccacatggatccctcattttacccttttatagccacacccacttctcttctgctcccaccccctccttaacctctgatacccagtagtctgttcctcatctctataaattataatttcaataatgctatataaatggaatcatagagtgtgtaaccttttgggactgactctttaaactcagcataataattccttagtgattcacccaggttgttgcacatatcagtagttggttgcattttattgctgggtagtattccatagtatggatgagccacagtttgattaacaattttaccggttgaagaatatctgggttgtttccagtttggggctgttaaaaataaagtggctctaaacatttctgtatatgttgctgtgtgaacatgtcttcttttctctaggagaaatgtccaggtttacaattgttggatcatatgatagttgaatgtttaattttaaaagaaactgccaaatagttttccagaatgccagtaccatttcgcattcccctagcagtgtgtaagtgatccagtttctagtctacatccagcatttgatgaagtcactgttttattttagctattctggtaggtgcataatggtatctcattgtggctttaatttgcatttccctaatgactaatgatgttaaacatcttttcatgtgtttatttgccacatgtatatcttcttttgtgaaatgtttctgcatgggttttgcctctcttctaactggattgtttctcatcatactgttgaatttttagggttttaatatattcaaggcactagtccgttattggacttggttctcccagtttgtagctttcttttcatccttcttaacaggatcttttgcaaaccaaaggttttaattgtgatgaaatccaatttatcagcttttccttgtatgattgtgcttttgaaatcaagtctcagaactctttgcctagcctaagatcctgaagattttctcctatgtttttttctggaagttttaacagttttgtgtgtaacttaaatgtgtgatctattttgagttaatttttacataagatatgagactgaggtcgaagttcctttgtgtgtgtgtatagatacctaattgcagcattatttgttgaaaaggcaatactttccttctttcctccactcagttgctttaccagctttgtcaaaaatcagctgggcttatatagtgaatctaattctaggttttctattttgttccattgatccgtgtgcctatcccactgccagtaccacataatcttgataactgtagctgtgtaagtcttgaaattgggtagaccgattcctcctcctttatgaaaattgcttcaactattccaatttctttgactctccatataaattttagaataatctcgtctatatctatgaaaaatcttgtgggaattttgatataaattacattaaacacatcagtttgaggagaactgatatttttactatgctgagtttcctagtttttccatttatttcactttttttgtaatttttagtatacaggtgctatacatggttttttagatttacgcctaatatttctttttttcttagcagttttaaatggtattgaatttctaattttggtattcatatgttcagtaatggcatatggaatgtttattttatattctgcaatcttgtagaactcatttattaattctagaatgctttttgtagattccttgggatattctatgtggacactcatgtcatctgccaacagagacagtttttttttttctttcccaatctgtgtgctatttttttccttttcttgcctattgcataggctaaaacttcagcattgtattgaagagaggtgagagcagacatccttgccttgttcccagtcttagggtaaaaacatttgatttttcactatgaagtataatattagctgtagattttttgtagttacttcttatcaagttgaggaagttcccctctattacagtttttctaagagggttttcatgaatggatattgaattttgtcagttgctttttctatgtaattaatatgatcatgtgattttttttctttaggctattggcatggcatatcgtaatgattggtttttgaatattgaaccagtcttgcatcctggaataaacctcacttggtcatgaggtataattctttttatgtaattgtgaattatcattcctaatattttgtgaaggacttttacatctttatgaagaacattggtctgtagttttttttgtaatggcttttcaggtttttgtatcagggtaatactaacttaacaaaatgaattgagaaatgtttgctccttttctgttttgtggaagggattgtataggatttgttttcatactttttaaatgtttggtacaattctctagtgaaaccatctaaacatggagatttatttttgggggattttaagttatgaattcaatttccttaataactataggggtattcaaatgagctgtttcatgttaagtgagttttgatagttgtgttttttgagaaattggtgcacttcatgtaaattgtcaaatttatgtgtgtagaattttcatagtattcccttattatccttttgatgttgtcaatgtctataatgatatcctctgcttcattcctgatgttttctcttattctttgtcagtcttgctagaagtttgtcagttctaatcaggaagataaaacaccttaactaaaaacaccaattatatccaaattgctaaacgcaataaatatttttcagatcttgttcattctcaattctgtattaaatagcaatgattagttcttccttcttgaaagcctatatcctgtagatatctgtgactgtgtgcccttctgattttaaaccccagtgacttttcctgaatcagtttgtttctatcctctgaccatttcataaatattggtcttcctcaaaatgtagtccctttgtgactgcttttcatctcactctattgtccttggacaattttatttctattcattgtttcctctgataacttagaaatctgtaattctaacccagatgtttcagattactatactcaatttcttgttattcaacatcaaagtgaaggtgttcctcagatctgctgtggaccagattgtacttaacttcttccttctaacacctcttcccacatttcttatgtcatcttgtgacctcttcattcaaccatcacttaaaccagaaacctaggaattatagactcctctcaatgccttccaaaccatgatcaatctgtcaccaaaccctatagttataaataattttgtccacggttctttatacctgttgtcagtactctagtttagtccaccattttttttctttgatgactgtaatagccttggtttccagtcttggtttttcagatgcccccaccctacagtcaccatagtgatctgtctaaatgtatgaatctgatgatttcacactccattaagccctacagtatatccatagtacttagtaccaggccaggcacttaattccttattttatgcccttaattattttaaatatactttaaaatatagtttctacctgataattatattatttgaagtcttggggtatactactgccctttatagttcctccagacattcttgtatggtacattatttaatgaagtgttttcaaattttttattttgagcacatattcagtaggactttatcagtagctattttgcctgtgtttagggtgatctctggggagtttttgaacttgcttctttcaagtatctgaggagtatcctttttcaggatcacttttttttatactttaagttctagggtacatgtgcacaacgtgcaggtttgttacatatgtatacatgtgccatgttggtgtgctacacccatcagctcgtcatttacattaggtacatctcccaatgctatccctcccccagcccccgacccgccgacagaccctggtgtgtggtgttccgcgccctgtgtccaagtgttctcattgttcagttcccacctatgagtgagaacatgcggtgtttggttttctgtccttgtgatagtttgctcagaatgatggtttccagcttcatccatgtccctgcaaaggacatgaactcatccttttttatggctgcatagtattttcaggatcactttttatgtgaacctcttggctcagttgttctcatactaaggagatagtataaattcaaatcccagctctacctgtagacagggtcttgattacagattcttggtgagtataaatttaccccctctgagcccaggctaagacagacaaacttccttgtcatcttcctatgctaacaggcagattttttttttctaatttcctttcattgaggatgtggctttttaagaatcccagttttaggcaggtcctctgcttcatttccctctgttaaaagggtttgagacctcagcttctttctggcattaaaacccaagctcttctgtgaccagcaaacctacacgataggattggtaacagcttggaacttactgctttggttttcagttcccttttcacttttggacctgggtattgcccttactatcttaggagctcagctatgtattttaaaagatgtttattttctctagcatttctagggaagtcctcctgccaccaactccccattacctagcccactgtattctcagtcagggttgagatttgctgtagctctaacacttttcaaatctatcattttacctcctgtttttgaagaatcaaatctacatgtagtcatgaataatattcataagtaaaggaagcaggatggatcagggatagccctataatccttttaggattgtaggtccttctttagtcacctctctctcaaataataagagttccttagttttgacctttttatcagacaggtgttagtatgtggagctctttttcacgtagtgccttctccctcctgatgagatttctgcccagaacataacccttccaggatttttaaagggaaaccatttccctgtagtcagcagaaaaggaaagaatactgccgaagtttgatgcttggttacttgacaatttccagtcataataagctactgtttctccctcagactctttccattgaaaagggtcaaaattatggattatcatttacttgatacgtgtgtgtacatgatgaatttaaagcaataaaaatattatgaaactgagaagttaaatcaacgttacaatagcaggtttggaggattgtgacaaaatatgggcaacctaaatcacctgagccaccagcaggaccaactgtatcccgttatcaatttgatttatttgcttatggttttcttttttttgcgagttttctttacagatctgtgagacgaatgcatattttcacctagtatttgttttaatgatattgtaaactcttgataagcttgtaagatatatgtagtgttttacttaaataacaaaatttacttattttcccatgttgttgaatgtaattcatatttctttttttttctttcccattttcccttcccctccttcttctgctccctctgttagaaagatgcagtgaacaccttaatgcattaaaataatttttattcttaaacatatttagggtacatttccagaaatagaattactaggtcaaaatgttctgtttttcagactttgacacataatgccaaattgcttaccaaaagcatgatatgaagttatatcctcctaacaatctaaaagcatcttaagcagacctgtcattatcagtggaccactggacagggttgtggggctgatgctttctttatggttcctctacaggatatggtgcctgtcatagttgattactgccttctgctgcagcgaaagtgagtatgcgttgcctgtcacattcaattattttgaacccaggtagcctcttatgtataagccattgctaagaattctatgaatttgactgaatagatttaaaaatattaatttatagaaatttgattctttaacagttttcagttcatttacctaataaaattaacttccctaagacagatgctatggatatatcatttatttgtctgtgtggcaggatattggagataaagaacgtaactagcaaaagagcaatactacttaggggttttaaaagtaaaaagtgtatgattcattatatgtatatatatatacacacacacacgcatatatacacacacatatatatatacacacacacatacacatatacacacacacatatgtatacacacacacacacattcttctttttttggtatatatacttttttttttttgagacggaatctcgccctgtcacccaggctggagtgcaatggtgcgatctcagctcactgcaacctccgcctcccgggttcaagagattctcctgcctcagcctccctagtagctggtattacaggcatgcactgccacacccggctaattttttgtatctttaatagagacggggtttcaccatgttggccaggctggtctcaaactcctgactttgtgatccacccgcctcagcctcctgaagtgctgggagtacaggcgtgagccaccatgcctggcctggtatatatgcttttatgaaccatcactagaacatagtattttatactattcaaaaaaggctagattcattgtgcttatgcagtactattttttgtttgtttgtttaaaataaatcagtataaataaactcttgattaggctttgttagtttaaattgtaactatataaactagccaacctggctggacgtgctggcttacccctgtgatcccagcactgtgggaggccgaggtgggaggattccttgagcccaggagtttgagaccagcctgggtaatatagggagaccttgtctctacaagtaaatttttaaaaaattagttgggcatagtagcatgtgcttgtggtctcagctactcaggaggctgaggtgggaggatcgtttgagcgcaggaagtcaaggctgcagcaagccatgattgcaccactgtactccagcctgggtgacagagcaagatcctatctcaagaataaataaaataaaaaataaaccaaccaacctgtgctaatgcacagggttttttttttcttttttttttccacactaataatgataaccaggtattgttctaaacgctttacattaatttatctaatttttgtagcaatttatttttataacagtgaggtagggattattatcatccacattttatataagatgtgccaaagccagaaagtgattaagttacttgccaaaactcagtcccacagcttttggtggcaaaggtgggattcaaatgcatgagtctagctcctgtgttcttggttttaaccactagcttgtaccactttgtaagtgatagagaacaaatgtgaagatttaatgtagatgctcccaaaaccctatgcagcatgacttggttcatgaatttatgtaaattctagtagcctgattcagaaaaggttgggtcatactttgaagcatcagtaaagattgtcaagagggcagtaatttgctatgtcagacctttgatgaagtcatagatagctatatagtaagttctgcttacttggggctcaaatttattccagtgttttaactctagtgttacgtaattagcaaaacacatcgtgtttacagtagggatcttgttgagaacattacttttttttttttttttggagacagaatctcgctctgtcgcccaggctggagtgcagtggcgtgatctcagctcactgcaagctctgcctcctgggttcacgccattctcctgcctcagcctcccaggtagctgggactacaggcgcccgccaccatgcccggctaattttttgtatttttagtagagacagggtttcaccgtgttagccaggatggtctggatctcctgaccttcatgatccacccgcctcagcctctcagagtgctgggattacaggcatgagccgccgcacccggccaagaacattactttatattacacatggtctgctttatgagggcctacgggagaaatttctttccggtgttagggccacaaatacctttgtgtctcttgaatagctagttgacttttagctgatggacagtgattgtgtagttaatcattgtttcctagaaagcaaagcgccatgatatgtctgctaacctgaccctatctttttctaaattagttttctctttacctcactttcacactcaattccttgttatatgtcctgtatttttaaagcagccttaataggttatgaatcagttttacatattctacttaaccctcataaatacagtgtaaagagagaaaatgttatcctcattttcagatgaggaagtggaggtgtagaggtatttctagtactaataagtactggaatcaactctgatattcaaattgagataatttataaatgagatgaagtgaagtgcctgaaggactaaattttatttagagtaaaacggcttatttttataaaatggactatttctacctagaatgatacctgacacaatatagctatccaatacctgatggttgaactgatgaagtaattctgcctcctggtttgcagggtgacttgtgatcattatcttgaatactagaatactgtcacagtgacataaagttgaagtgggcctaacagttgtaagatgaaagattatatagggaaaaaaattgattatgtttttccagaatattttgttattccctaaaatattctggagataagcttttcttttttatatgatttggaaaggaaatattctctaacatttatttcacctattgactgtctgagaatgcaataatttctgtattgaaccacagcatataacatagaagataaaatctggtctagattttcaccaaattaggatccatttattatttctttatttttgtcaacttctttcctataatttttcctgattccttagcatgctttctctgtattgtgtcagaaacaaatacaatatttgttgttggagatctcagaaataacaggaacagcagtcatagtatatactcctcacctccaagaggaagagaatccttcctcagttcagctcttcctggtgcttttcatacctcttttctttcttcctcctcctgctcttacatacacactcttaggtcaaggccatggacattttccctggaccatagtacaaagagcgtatggatggcttccctttctctcaattctgttttctaacaccgaagactagattgtactagatcctgcctctgcttgggagaagttccagcatgtgtgttcttattgtctttctttccctccttgtctctttccctaattctactctttgggttctattctaataggagaaaaagcgggagggcagcattcctagagatgtaagaaaggtcggggctgtgaaactaggcattgggtcaaacgctccctcttttgttctaggtctgtgttgtgcttgtttgcttctcaccatactggcttttctttttcatcagaatgttaagattcttctatatatgggcctgaacttagaaggaaagattgaataagccgtttgatcaactttaattgtttgcatctaggccatctttcacttcccttctatttcaaacatgcaatgactaaagatttattagatacaagaattctatgtttaattaaatagttcagtctaaccacttaaatggtagagttttaaaaatttttttcttagagttgccatagataataaggttaaaaatggtcagttccctatgctaaattgtagcggaggattgtcagatgtaagtagcttcatcccagcatagtattttttctccttaaactggatcctctctttatactatcctttttgacatttggtcctatttatgtctaaggtcttctcttctgcatttccaaattagcaaaatatctgtgacattaacattgctttaaggaatgctcagattttgcataatacaaacacagtcttacaaaatgtcatctagtactcagctagccaatttcaggtaacttcttccacttctagattcattactcactcaatcctgttccccagattccttttatattaatgtcttctgattgagtatgttgtttttataggcagtccttttattttcacatattatattgtttcttaggtgggtgaaattataaacataatacatgctctgaaattaattttaacttagtggcacaaccattattacactataatcactgttacctcatagtttcataactcagataattcagtacccatcagtaatattaattaagctagtggatatatgtattcctatttatatttaataacacttttataatgtaaaatcatttttactatgtcacagtaatcacatttgtttttctctgtagggcatactactcagtgtattatggacatctttcttggttaaaatttggcattagagtcttttgtaaattacttaatatcagaaatgacaggaattctgtttttgaagacttatactttattttcataatttggtctctgttccacaatttcatttcaatttggttttgtgtatttttttttcagtattagacaaaagacacaatgtcttaaggctttttgtgaatacttctgatttgtcattttacctatgcaaaatataggctatatgttagcatatatatgggtagccctaatgtcagttttactttgaaaatagatccagagtttatgtaaaccataattataattttgaacgttgtttaaaaatagggttatgtgattatatgtgaattatatagcaataaagcagttattttaaaaaaaagcaaaatgggtgctctatatggatgataccgacgactttgagtttatatcactgtaaggaatatccacagttgttaagaagccatcgttccaatggcttgtgttatgtatgcatctgaaccaaaaatgtttctgttaaatccaaagtgaacttgaagtagtcttttaatttgttcactcatgttgttcaacatcaggactattgtttgagaaacaaaaagatcttaattatcaagacttgttgaggaactggatgtttaaaattttattagggtggtgcaaaagtaattgcaaatttcatcattaaaagtaatggcaaaaactgcaattacttttgtaccaacctaatatcaaagctgggggaaaaaaggcgtttttaattttataatagctatattgagatataattcacataccataaaattcacccttttaaagtatacaattcagtagtttttagtgtattcacagctgtgtaagtatcaccacatgcctttttaaaggaaatctttacgaactgtggtacttgtatcaaaaaatagagcattttgaacataatttgttaaaattcatttgaattttgcttttgcttttataaataaggaaaccagcccacatcaactttggatatattaaataccacttgtatttggtgggaatttacttgtttggttctggttatatatttagtatggattggcaagggttaggattgatgcccttgttccccttcacatacttctaaatttgtaatttcttataaccaaagcagctcttcacatttaaaaaattatgaaatcgataatgtacaaagtaaatttaacagttgtcctctttttgaagttataaatgataaacttcaaaaatacctttaatgtgagtactgttataaagtgaagtttgtagaaatatctctttggtcctctattattcatgatcgattttctgttacactggccatagggaggctaagcttgaaatggtaaacatcaattttgaagtcagcccttctaggaaacaaagatagcaccctggagaatagtgcctaaatatagaaaaaaatatgagagctacaaatttttgtatgtacttgtcttttttttaattttattttgagatagagtttcgctcagttgcccaggctggagtcgatctcggctcactgcaacctctgtctcctgggttcaagcaattctcctgcctcagcctcctgagtagccaggattacaggcgcgtgccaccatacgcagctaatttttgtatttttagtagagacggggtttccccaggttggccaggctggtgtcaaactcctgacctcaagtgatctgcctgccttggcctcccgaagagctgggattacaggcatgagccactgcacccggcctagcctgtatgtacttttctatctcccctctttcctgatgcactaataagtattctcccagaatgatgagaatttgtcgttgaatataaaaaaaattttattttaaggtagagatgcaaataggagttgctgagccttatttttcttgcttctttatattatagcttctgattggttaagaaagaaacgtgtggttttgcatttatcttagcagcatcacatgctgtttgtaaacaggagtgccttcttagttaacttttgtagcctttactgaatttttagctctctttaattctctccccaaggctttttgtactaaactaaaatatataattatcttttttagcatgttccttttaacaacacattacagagtacaagggcttccaaatctgacattttctttgaatcattggttatcttgttactttttctttcttacagtaaaactccattaatctctgtttgttttgcttggctagtaatcggtcatcacaaaaatatgatgaattattgattcaaatgaaactgacatgaaaatattttgataaatatgaaatggaggggaaaaatgatgtaaaattacatttgtgcatttgagaaaaaaataaatggctgtggattttccctagaatgttgcaaatgctgttaattgcagggtggtgtggagttctggtgcagttgtagccagtctgttttccatctgtccccttccaggacttcagatgagtcaaaaccccatcctagtcctttcaggagcttccttgatgtttttgtggaacttgtcatgaaagaccatacctgtgaataaataaaccatttaccactttctacaattgacatgatatacatataaagaaattacacatttaggaaaaagtaaataatctcaacaggtaaataaaattcacacagtttttgtattttttaaaaaacagaatgaacaaagaagtgaatgatacaaggcaatacaatttataaatgaaaacatggaaaatattcaattttgctggtcataaaagaattattaaattgtcaggggagaaaaaccaagtttgcaattgtctggtgaaactggtaggattatacattgtgggtggcagtgtcaattgatgctgtgatgctttttgaagataatttcatagcacatttcaagtgccacagattttttcatatcttttcacttaagataaatttctaaaagttgactgatttaggaattaagcccttcaaatgggaaaggctttatatgtagatgttcattgtagtatcacttgaaatactggaaataagtaatatatccaacagtacaggaatacttaagtatattctgatttttcagcatattgaagtattgtgttagacaaaatggtaattttgaagaataaatagcaacttagaataatgcttatcatataatgtatgaaaacagaattccgaattctgtctgtggtcaatataactcaaattatttatgggttgtttccagaaatatgaaataaacattgtcgaggttgttgacatttaaagtaatttaaaacaatttttgtttctgcaataaaattgtttctaggtttatattttaaggattaaacattttttttcttcttcttccatgaataatcactagccaaacattttgggatgcaaagggttatagctagacaaagaagcatattgactgcaggtcagctaggaatatttaaataccaagaaggagggaaggataaatcatgagtagtccttttgtttttttcctacttcatgatgtccacccaattatctgttcccatgtcagtgttgtctttaagaagcaatatgccacaatagactgagcacaggatttaggccggaaggctgggttcaaaatctgactcttttgtttgttagatatgtcactattagcaaacaatttatcttaccttttctgatttgttaaagaagtgttgggaggattaattgagattttatatatatgtatatatacacacgtatatatatatatatatatatatacacacacacacaaagtttttgcagtataaaactctgtgaatattattgccattttaaataaactcatgagtaagttgaagtagggaaaagatgagatatatttgggagactaaatttaatggatatttggcatgttcctaaaagtttttctccccccctttctgttacagggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtgagtttatagacagtctactaacttatgaaataaacttcattcctttattgataacacttacttcactgatcaggcctgaccctgccttctaagaaccgtaattatttattgagcactttttgtaagatgtattataaacttgtatttgtcaatatatttcctaggactgtatttaagtgaaagctagaatataattgccttgcaagtcagggattatgttgtcttctgtttctttcacatccccagtagcacttggtatagagtttacatttagaagttgctctataaatgcttgttaactgatccctctttatcagcttgttcgttcactaatataattttcatcgagcaagtgactttcaactatggctgctttctcatgaattgtagaatatttttaccttgaaaaatatgatgccattttaaaaaagagctggtatgtatgtccagagttttgaaatacagagcatggtatataacaggcaagttatagaactttttagcatgaatagccagccattgtttgataaatacttccgctgtatctgaggttctcacaataagttatcttaattgagtttcttgaaataagtttcttaattgaggtgcagtatttattctggcctaagacatttcacaatttattttttcctcctcctgctcctcctcctccccccctcctcctccccccctcctcctccccccccccccactctctttttttttttaaagacagagtttcgctctgtcccccaggctggagtacagtggcgtgatcttggttcactgcaacctcctgggttgaagcgattcttgtgcctcagccttcagagtagctgggattaaaggcatacgctactgtgcccagctaatttttgtatttttagtagagacggggcttcaccatgttgggcaggctggtctcgaacttttgacttcaagtgattcgcctgccgtggccttccaaagtgctgagattataggtgtgagccactgagcctggcccacaatttgattttttaattccacattagtcctaataatgagcatgttactcctgcaaaggtgccaagccctcttgagcttgaatatggaagactaacaaaagtcttagaccaaaagttttttgaaagtgtgcaaaatcacatagaaattaagggtttggaaaaatgattattttatttctggaagctctttatgaatggctgtgagtttgcaaagtaaagccagatcctgttttatacctgcctttgtattatatggctaatttggcatagtcttcatagtcttacaataggtctgatgacttgagagcatgttgtccatctagttttgcctacctatcacatacaggaaaaaaatttaatttcttctatttataatactttataacattttcagtctttccccactaccatgtaaatatactctagtctttttaatgttaaacaacaatttcaaaatgctcccctcagtttcttatgtctccatatcaagacttctcccctttttcctcctaggttactgccctatctcactcctcccagtcacagctagatttcttgaaagcgttgtctaggttgctattttcatttttttcccccacttcctaactcttcaatcttacttttactagagtcaacaatggcctctttgtccactacaccaaatggtatttttcaatccttattttatttactcttttaacagcatttgttcgttaattcaagaagtgtttactgaatgtcaggctctgaggatgcttcagtatccctagtgaacaaggcttgtcctctcataaagcctaaattttagcagaaaagtttgacaatgaacagattaatgtacaaaaatccagaaagtatttcaatacaagtattatgttaaaaatcaaactgggaaatatagtaaagagataatgtgaggctaccttagattggctaattatagatagtctttttgaggaggcagcattgagtcttgggagctgaatgacaagaaggaatcagtaatgcaaagatcttggaagagaagattgttataggtaaaagcaacagctagcatttaaaaaaaaaggatttttgtctcgggtgttcaaaaggaagcggatctggagcttggtacagaggtagatcttgcagggcaaggtatagatctttccattttattctaaatgctatgaaaaatcattagaaagttttaagcaagagcaccctgtgctttaggggtaacagaatcagggatgagggccaagtgcagaggaagcaaagaggctagttaggaagctggcccaggaggtgattctggccagagatggtaacagtgagatgaagagagatggcctgattttggatgttttagagatagaattgatttgctggtgaattgggatatgagggtgtgagagtgtgggaatgagagaatttaaggatgatgactagtttttggtttgagaaacagggtgaatagtgagtgattcctttgagaagattgcaagactaaggcaggtctaagtttgagagacaaatcaggagttctggttggccattttattttgagatcactactggacattcaggcgaagatgtcgaattaagtagttggatatatgtatgggttagaggggaggttagggctgaagctgtaaatgtgttagtcatcagtgaagagatgcatgatcatggtactggctgagaggggtagagagggagtcgtaggagtcccagaacaggctttttctagaaagactctcccagcacatctcacttccattttccctcttacctctcactccctcttgtcattctcctttgccgacttctgcccttctcctcttgccactgtttatagtattatatagctgtcatagggacagaatatagagtactgtatactcaaactcatatctagtcctcttcctaaatattttctctgatttctctctgtccttaagcacttcaagctcacttccacattaggtccttcatcctcactcttgcttcttcctacagaattcctagctggcacttctgcttgtggctcacatatatccattctttaggtcccaccttaaatgttgttcctttaggggtgactttttgaatactccagaccagttaggttaatagcacttaccacatttgtaaataatgaattatttgtgtaattgagtatcttccccaagtcttaactcacacgccattttgtacccctacgtccttttgctgggtgtccaagatcaatgtaagttctataagggtagggacaaagtctggatttatcttatctaacactttattcccagtgcctatgagagggtctgaatatgtgttcaataaatatttgtagaactattgatcaaaggtaaaatgaatatagaaaggggaaggatagagaagaaacaaaattagacactgtgaatgtcttaaagtaagcgttgtactattaaaagtagtaatttcacctacagcagctcttacccttgcattgtgtttgagtacttgaatttcagtttttatcagagaagaaacaagaaaaattagggaagagcattcaagacctttcccattcttaaagcattaaggaaaataattggtgactgaattgtatggaccaagtggcttttccttttcacaggtagttctcatgtgttgggaaaatcgtttatatgatgctatgatctatgtctacaacagaggcatgaatgaatttattagtccaatggaggtaagatacttcctaacttggatacgtaattaattttgtctactaacttttttctcctattctccatttgcttttaatagtttctagttttatccaattatttaaaaattcttatatatttattgaccttgaacccattttagcttggggcttttagatagtcttcaattttataccttctgccattgcttgctttcttatctaaataagtaggtatttaaataccagggaacaatagataaaatttaaattaatgcttgcttgttaggctttacatgtttttctcctaagaatttttgatactgcagtaactttttctaaagatacgaaaaatttattttgtataattattttatataatcaatgtactattgagtaatgctatttgtagatatattctgctggggaaggctcctgaaaatggtaggaggccattatttgttaattgatcatttttcacttttactgactcagaattttatagcattcattctaattttttattctgcttaccaagagaatctaaaaaacatttggacttacttttagaagaaccaaaccccatatctgttttcttatttgttttcagtttgatggcagaatagtggagaatgagttgtagacacatgtagtgccctcctagcccaatgctttattatagtgtccctcaaaaaaagcaggcctctgccaaaggcatccagtcaaccatttagctaatttattgctatccaaaactatcttcagtattaagaagtcagcattctatgataggtaggcttctttaagcacattcagtttggtagggcgagtacccctctaattcataacccttcagttttggttgcacctctcttctttcggttagtttctaaagttagtcccccacccttctacctctggttttgggggtttggccctgattgtctgttatctcaaggatttttttttgtcttgaacacctctcggctgctccttcattaaggttcagtagttccctgaaaaagactcatcagctgccttctcagtgaggtccagtgcctccctgcatgccacaactaagccacaattcagaagaattaatacagtttctagttttgctcaaaataatccctcaaaacagattctattttgatgcattctgcattgacaagatgattactgtatttctgttaacgttgcttttgaaatgtttgttttgcatgggttttgtattcctcatattaataaaatctggtttgcatttatactgatacatctcaaatggaacactgagctattgaggttaccttgttttgtgttcgaagtgtttaaagtttagctattttagtacttaaagaggtctgaattaagagaaggtgtcctgtctcttgaaattgtctagattttttagaatgaaagcgtgtcatcacatttgagatgactactatagtctctgaaatctttccttttttctagttttgactaaggtaagaatagtgccttgagttgggaggaaaaactttttctttaccaatttaggtcccaatggtgggaggtacagggaaaggattgaaggctttgaattcactgacaatatacagattaacaggagaaaagataaggattattcacatacgtgcaggaacactcagtaataagcatctctgctgagtagccagaggtagacgtttatataccagcttcacaaaaatgggggtagcacgtagttaggtcttcagtgggaaagcatggaaagttcttttgggctttttgatgctaatggcagctgaatttgcatttcctggtgctaaggatcagttttttcccaaataggaatctccctctgaagggggagctaaatatttgggagactctgcttaagtttagatgatatttctttctgtggctgctgattggatgttttcagtttaaaatcatctctattaccactttagtgggaaatcctttcacttgcttactagtttttaaaagaataaagcgtttaagaaccaaaggatactttatatcaaaattataatctcagataagccctttatataactggtatttattaaatgatttttttcggtgaggaatatgacaacagtgattgtttctcagtgagccttctaaacatttcatgtacagattaaaggttttcatatttaatcttaatggtaaatgactaattccattagcgaatggtgatgaatagcataagattcttattttttaaataatatcatttgagatgatgatgattgttttcctattaattttaatgcagaaacttttcagagtcattgctcctcctctgaatgcaggaaaaacactaacaggtatttattttctaagccttaattttttgctttcctgtatttaaggtattatttaaatgttacaaaattggccaattatatgtgtgcagtgtgaatgttggtaatcatgtacagtcatgtaacaccaccataatcaagctgcagaaggagccatagcttctcacactaaaaagtttcctccttcccctttgtacttgatcctttccccacagccctgctctgggcagtcactgatctactttctgtcactatacttcatgtaaatggaattatgtgctatgtaacctttggtgttttatttctttcactttacgtggatgaagcataatatttttgagagtcatccatgttgttttatgtatattaatattttgttcccttttaccactgaatgatagtccatggattgaatataccataagctgtttaatcattcaccacttcatggatatttgagttgctttcagtttgggactactatgaataatataatgctgctacaacatttgtggacaagttttttaaggtttttttgggttttttttgtttttttttttagttaaactttctgagataattgcatgcagttgtaagaaatgggacatagagatcctatatagtctttacatagtttccccaatgataacatcttgcaaaaataaagtacaatatcactactggatattcatattgaattcatattgataaagtcaagatatagaaaactttcattacctcaagtatctcaccttgttctcttaccctccattcctgacccctagctgtaagtttctttgtggacaaatgtgttcattttcttggccaaatacctaaggttggaatggctggattgtatggtaaatatatattttactttctaagctactgctatatggtttttcctaatgctgtaccatttctcatcaacaatacttgagagttcccgctccacatccttgcaagcacttgatactgtcagtgttttaaaatcttcttaaaactttggccattctaatgagtaatggtatttcattgtgattttaatttttattctgtgatcattagtgatgttaatcattttttcatgtgcttgtttagccattcacatatcttcttttgtgaattgtttaaatatttagcccccccccccttttttttttttaattggtggagatgacctggggttgtcttcatattattgaattgttaaaagttcccaagctggccaggcatggtggctcatgcctgtaatcccagcactttgggaggcccaggcaggcggatcatgaggtcaggagttcaagaccagcctggccaatatggtgaaaccccgtctctaccaaaaatataaaaattagccgggtgtggtggtgggtgcctgtagtcccagctactcaggaggctgaggcagaagaattgcttgaacccaggaggcagaggttgcagtgagccaagatcgtgccacttgccactgctctccagcttgggcgacagagcaagactccgtctcatgaagttcatcttattaatttttttttgtcatttaggcttttgctattctgtttaagaaatcttggagccgggtgctgtggctcacacctgtaatcccagcactttgggaggctgaggtgggcggatcacgaggtcaggagttcgagaccagcctggccaacatggtgaaaccctatctctactataaatacaaaaattagccgggcgtggtggcgcgtgcctgtagtcccagctactcaggaggctgaggcaggagaatcgcttgaacccgggaggcggaggttgcagtgagccgagatcgcgccactgtactctagctggggcaacagagtgagatgctgtctcaaaaaaaaaaaaaaaagaaatcttggttcaattcagtgtcataaatattttctcctacattttcttatagaaatttaatagctttaactcttgcatttaggtctataattcgtttcgagttaatttttataaatgatgtaaggtaaagttcaaggatttttttccatacagctatcagttattcccataagtcttaccatttattggtaagattatcttattttcattgaattaccttgacacctttatgaaaagtcaagtgaccatataactgtggatgtgtttctgtgctctctattctgtcctattgagctgtatgtctatccttgtccagtaatgcactgtcttgcttattgtaacttcatagtaagtctcaaaatcacatattttaagtcctacaatattgtttttctttttcaaaattggtttatctagtacagattctttgcctttctatataaacgttaaaatcagctcatcagttttttttaaaaaagctcatttgattttctttgagattgcattgatgctgtagattaattgggagagagaattgccatcttaaaactgtagaattttctaatgtatgaatgtggtatgtttttctatttttatctttttaaaaattaattttattttagagacggagtctcactctgtcagtcaggctggagtacagtggtgtgatcacagttcattgcagcctcaaacttatgggatcaagtgatcctccttcctcagcctcccaagtagctgggactacaggccaccatgccctgctgaattaaaaaaaaaaattctcaagacagggtcttgctatgtttcccaggctggtcttaaactcctggcctcaagcaatcctcccacctcagcctcccaagtagctgagattacaggtgtgagccactgtacccagcttattttggtcttaaagtcactttgctttccccttttctgcagaaaaggcagctgagattttgataaggattgctttgaatctgtacatcaattttattactgtcttaatattaccaaatctttcagttcatgaacacagcacatcttttcattttatttaggtcttcattaatttttttcaatgatgttttgcagtttttaatgtataggtcatatactccttttcctcctcctaagtattttattcaccttgatgctgttataaatgaaattgtttccttaattttattttcaggatttgctggtgtgaaatagattgacttttgtatattgatcttgtatcctacgtccttgctgtattcatttattagtgctaatttttaacttcttagaactttttaaggaaaatatagatgtcttctgcaaataaaaataattataattttttctttctaatatagatgcctttctttttattccctaattgggctgactacacccactaatacagtgttgaacagaagtggcaagaatggacgtctttttgttttcctgatattagggggaaagcactcaatatttcatcattaaatttgatgtagatggtcttagccatttgatgaagttttctttacccagtttgagtgtttctaacatgaaagactgttgaattttatcagatgctttttctgcagctattaagattatcttgtgggttttgtcctttattttattgatatgatctgtttaattgatcctgtatgttaagccaaccttgcattcttgggataaatctcacttggtatataatcttttaaatatgttgctggattcagtttgctagtatttctcaaggatttgtgtgtgtatgttcataagagatattgttctacagttttgttttcttttgatatcttgttatcaaaagaataccagtcttgttatgagtgtatcttggtatgtttgcctcatagaatgagttgggaagtattctctcttttattttttggaagagtttgtgtaggattagtgttaacttttttaatgtttgacagaattcactatgaagccatatgggcctgggcttttctttattggaagttttaaaattattagttgttttgctctgttttgtgctgctgtaacagaatacctaagactgggtaatttataaaaaacacaaacttacgtcttacaattctggtgcctgagaagtccaaaatcaaggtgctggcacctagtgtctcatgaaggccttcttgctgtgtcctcacatggcggaagttggaagggcaagtgggaacaaacattgtgtcctcacttggcagaagagtggaaaaagagtgaacccagtccatcaagcccttttttactacagcattaatccattcatgagggtagaaccctcatgacttaaacacctccccaaaggcccccacctcccaacattgttgcattggggattaagttttcaacacatgagttttgggtgccacattcagaccatagcactagtttagtttctttgtttgttggagtttactcagattatctgtgtctttttgagtgtttcagtagtttttaaatttctagacatttgaccatttaatctgcattatctaatatgtaggcatatagttgttgatagtattcctttgtaattccttttatttctgtaaggtcagtagtgatgtctctttcattactaatttttgtaatttgactcttctctctttttttagtctgtctaaaggtttgtcagttttgttgatcttttcatagaatcaattttgatttcatgcattcaactttagtctatttgctttcttcagttctttgggttagaagctctttaggtagaagctcagctcttttttttttttttttttgacagaacaggaaaatatttttaattctttggttcagggctcaatatcaatatataaaaagtaataaaatctgtgagaaagactaacaccttaatagaagaatagacaacactaaggcaattcacaaaagaaacttagcctgtaaacattgagaaagtgttcaacttcattagtaatgtaagaaatgcaaattaaaatgaagaggtttttttttaaccaaacaaattaataaatatttttaaaaatcatacttatttcttagggaattgaacactatcataaactgctagtgggagtaaaattggttcaatctttctatagagcagtttagcacaatatatgtatcagaagccttagaatttttcacaccctttggaagctcagcttttcaggtagaagctcatattgttgatttgaggtctttgtttttgtgttttttttaaaattaagtgtttacagctacaaatattcctcaaagcaatatgttttgatatgttgtcttcattttcattcatcctaaagtattctgtaatttctcttgtgatactagtgatttagaagtgtgttgtctaatttccacctatgtgtgaatttctcacatttccttctcatattgatttctacttttttttgtggtcagaaaatgtactttttatgatttatatcttttaagaatttgttgagacttattttatgacctcatgtaaggtctgttctctagaatgttctatgtgcacttgagcatagtaatgtgttgaatgtcttctgttgttggatagagtgttacatagatatccgtgtagggaaatttaagctttccctctgaaactttgagtgtaagtctgtcgaaatgaattaataatagattaatgggtagaaaaaggcatatacttttgttaacatgcataaatatggggtaattgaaggactatgattactcaaaaacccaatgaggtacagatgcatcctttcttaggggtagaagggagatggggaaataggcagttcttttaaggggtcgtaaatgattattaggggaacaaatggacctgggagacagaagttaacttgtaaaggatcctctttggaatttgaatgatccaataatatttggatcattgttcagaggcagacattatcttgtgaaaaagcttgtagaggtgcgattgtattccttaggtttcttttcctcagtagataaagagatttcagggaagggatggaaggcaattaattgtgttttctttggagggtccggtcttaaggtagatcacataatatcagagtagagcctgttaactcaaaatatctttaacctgttaaagttatctgagacctgttaggccaggtctcagtctgtttagaaagtttatcttgccaaggttaaggatgcacccgtgacacagcctcagggtcctaacgacatgtgtccaagatgggcagcttgcttttatacattttaggaagacatgagacatcgatcaatacgtttaagatgtgcattggttcagtctggtaaggcaggacagcttgaagtgagggcttccaggttagaagtaggtaagagacaaaaggttgcattcttttgagtccttgatcaaccttccactgaatacacaatttagtctggctcagtgaatctgcatttttacataaacaatagggcagagaaagaaattagatatgcatttgtctccagtgagcctcagagggatgactttgagttctgtctgtcctttgtccacaaggaatttccttgtgggtaaattgtgagggaggtatgtagcttcttatctttgtagctatcttatttagggatagaatgggatcaggtttgcctgacattagttcccagcttgagttttccctttggcttagtgattttggggtcccaagatttattttcctttcacaagtctctcccagcatatgctgaccttcagtgacccttaatttaaaataatctgcacaccatggtgccatattttggggtgaaattctctgggcttctttgtctgttaggtctagtttgcttatagttttgttcaagtcttctttttcctgttcatcttctactgattgttctgtttttgaaagtgggatattgaagtctccaaatattgttgaattgtccctctctcactttaatcctatcagttcctgcttcattttatgttggaattttcagttctttggcaggcagtttagaattctgctgtagccttcccttcctgcttgcacagagctgcaaagtcagccatgggttataaattagggcctttgagaatttccctgggtatgtgcaaagccctttatatgcatacatccttttagcactccaggaatatgttagaacttttcaaaagccccgcagatctcccgttctccagtttttccttttaaggtttttggtgcaccacttattagtcccaactactaacactgtctcagcctgctgtaatgttgaacaatggcactgactgttttcacaaatgtcctggggatagtgctgttcccacagagtgagttctgagttagggcaaaaaaaaataagccctgaaaatggagcttttaagtaagctgccagataggtcaaatagtgacaattcgctgaggatggggcatttgaggggctacaagattgacacaggaattttctctcggtcctttgccggacttgcagcaggggcaccctgtcttcttggcctgctgcgctcagccccttgtgggagggagcacatgagcaagccagtgtgggatccggctggccactccaagtgctgacacaggaacaagctccatgtgaggcccgcggtcttgaggggaatgcagcagcacccagacaagggtgcccacgaccctgaagccccagatggggtgttagtgtgctaattagctcttttagttttaccatccatagcctgatggacggcagcatgttagcagctcggtcggcctctggccccattgtgtggggtggctgccctttgccagcgaaggcaaaaggccagtgtaacagcctttctaggtacccacactcggtgggtccccagctcttgtccagcatccaagaagaatgaggatatgctggcaattgaagagtgagcaaggtagggagttttattgaatgatgaaatggctttctgcagagaggggatacaggggtggtcccactacccgaaggcgggcaagtcccctcaatgtggtgagtctggggctactgtgggctcagaataggggaggggcaggctgtagcagtattggaaaaggcaacattcgattggttaaaaggcattattcagaaagaatcaactgggaaaggatgtgcagacagaaacagaagttctcactccaagttgcaggtttcatccggaccagtaatctggtctttcagccttcaggctgttttttggcttgaaggtggggtttcacaagggacccgcccctatctgcctaggcatttgactaccccctgtcgctatcaaacccactgtgttccacttgttttcacagctgcccaagttgtaaggcaatattggttttcaaaactacagtagagctggagaaagggagatggcaatacataaagttaaaactctaaaattcactggtcttcctgagattcaggcatttttctgaataaacattcctcagattatggcaaatttttagttaatttcaagagttctgaaaaagccaatttgacagtttttaccagtgtttgtattgcttttatggaggagatttttgcaggtccttactccaccatttctgaggtctgtttctctgggttttgattgtgttctgtttggtcttttttcctctctgtttttcaccttggatgatttctattgctcttccttcatattcatttgctcttaactccttcatgtcaattcaactgttaaatctgctcagtgatttttttattttcaacagttatatttttcggtctaatttccatttagttcttgtttttgttttctctgctgcaactcttcatttatctgttgaaattttcatgcactgaaaccatttcttttgcttaaggataattataatagcgctttaaaatctttgcttgttctcacattttgttcatcccaggattggacttgattcacttttaagaagaatatattttattttcttggtttttcatgctggataattttggactgtatctggatattatgaatgttacattgtgtggagagtatgggttctccagtgagtatttttctccattgctctatcaggtatttttcaccactgagtatcgtcttccattgttttatcagataattttcttggtgggcttgaattgcaaaccctctctcttgtgcagctccagtctctcctcaggtcatttctggatggctgatctgctttgattctgatccacacgcatgggtcaggggtcagacagtgatgagggtagacagagtttggggatccttcctctttctcttttctttgcaagattctcctattttttttttttttttttttttgagacggagtctcattctttcgcccaggccgttactgcagtggcgctatctcggctcactgcaagctccgcctcccgggttcacgccatacttctgccttggcctcccggcaagattctcctaatttttaaactgtttatgtttcttaacttcacgtttcccttgccagaaagattgttgctttttctgtgatggcctccagctctgctgtgcttgccacacagacagcacttagacccaggccaaaagccacagaggtggtaatttacttgtacagctaactccctatctccgcttctccaagtgaaggaactctccaccagagcccacgtgtttctctcctcactccaaaaccttcagagagggagctccattcttgatcctggttttttgtctttgactaagctgctttgagtctttttcctgcatggtggtttagtaaatggatccacttcagatgtgggcagacaatttggggatctcttctttgattctttaccttttgggattccccaactctattccatattcgtggttccctgacctcacttttctgatcgccgccgtgccaggaaggttaggggcctttccatgcctccctatgtgtgcagttcagagtacgcttacctcagggacaggccagaaggaaggacagtgtggctgcctgtctctcctcccccaaatgaggctgaagtcctcaccagttcatgcttctgctcagtcctcagcaactctttggtatcttcaggtagttactttctgtatgatgtccaggttttataattttttactgtaagggtgggggtgaatgagtcattttatagtcttaacttcccgtacctaatagtagccctgaacctaatctttttgaggcaaagttgaaaattgcctttcacatctctctctaccagaaatgaaagtggagaattaaaacgtctgaatggaattgatgatcttttataatgaaaagttgtctaaaagaagatattgggaagagaaaggttgtagaaaattaagtactgtgtcagttcatttcagcatacaatttactaattacctacgtatgtgccagacactattctcgatgctagaaatacagaaatgtcacatactctgctcataagaggctcacagtagtggaataatggagatgggtaagttaaacaaatacgtttagctctctctaggaatatcgtgagctagatatattctacctgagatttccagcaagaaaggtgtgtaaatcaaaaaatgtctgagacaagtctcaatttagaggtttattttaccaaggttgaggacacactaggagaaacatacacaagctacagtaggatcttcggcctgtgctttttccacagagggttttgagaacttcagtgtttaaagggtagagagtgggcaagagggaaaagaggaacagttaattatgcatttgtctcatgctcagtgaatctgcattttacagaaggtaatgtaatgcccaaccttgttttcactaaccctgtttttagactctcccttttgctctcgtaatcacctagccttgtttccacatgaatagactcccttagctgagaaagctggacgagctccatctggcccccttgatttacaagacattaaggactccttacccacccctctttcctcaaggagttaacctgtgtaagcagattgtcaacatatcaaaggagtccagttaactgataaggtactggaacaaaccatgtatgaagttcccagcattttgctcaaaagataacaccataaagccttcagtttgtgtccggcgtagtgcccatatctaactcttatgaaggatttagagccccgcacctggtaccttgctttttttgtaaccatttgtcttttaaattgtttgtttccctgtaaccattcgtccttttaatttttttgcatgtttttacttctgaagagttgttgcatttaagctcccctcccctttctaaaccaaagtataaaagttaagccccttcctcggggccgagagaattttgagcgttagccttctctttggctgccggctgaataaaagactcttaattcgtctcaaagtgtggcgtttttctaactcgctcaggtacaacagtaaagtaaacatagaatagaggaagaagtcaaatatgcatttgtcttgggatgggctgaggaataatttatagtcttatctttgtccagtgcctgtgaagatcagctattaatttacattgtcagggtgagggaggccagctggggagacatggccttctatcttgcagcaatctgtttaggaaccaaaggtagccaggattttcgtttgtttgtttttgtttttgttttttacatgactcaattccgaagcttaacttttccttttggcatagtgagtttgggattctgagactttatttttctttcactcgtgtttatctagttagccaataaacattaagttgttatgccatgcaggtggtgatcaccatgtgtcatacgagttgatgtgaatcaaatgacatttggaatggaagcaaaatgtagttattcatacatttggagcaattcatgtttacatgcactaacaacatcacagattttgagtatttgtgaaagattactgataaaggcatacacttgcttgcattatgtccagtattcatattaccaaaaatagaaactccagctcttcattattgccaaccacagattcccatcatctgtgcgctgtgggcgttcccagtcacttcaccctgttgatgctcctgctccattctgtattgcccttgaccccttggcttcaaactttgtcatattatctttctgatttctttagtcagagaacaggctcgtatcacaagatggcagaatcttacattttttatgtaacttagaatagaaagggccctaaagatcatttagtttagttctgttactttaaacatttgggaacaatggccttttcagccctagagcacggtaggtggtaaaagtccatattacaaataagaagacagtatggttatgccttaacactaattaattggttctgatgtacagttcatcagctcattgcctgccctacaccttcccttggccccaagttagttaggccaacagtacatagatctctaccctcagatctattccttctacatctatcttagggtagcttatattgctcttgtgtctgtgacaagaatctaatggaaactcaaaagccaataaagtggtcttaacttcctgttatttgggaatatacttacctcaccttaaatgccaagttttatttttttgtttctacataaagattatttttctgaaaaggttttgagagaaaattgctgaagatacttctctttctattttagatgaacaagttgttatgggcaataagctccttgtatatattaggtaagattgttttatttattcatctgcatgtatgttctttctatatttttcctatatttttagagatactatgatctcttatctatatagtacttttaattttgcacaattcttttatgtagagcagtggttctcaaccatggataattttgtctcctactccctggagatgtttggcaacatctagagacatttttggttgttataactggggctagagaagggatgctactggtatctagtgggcagaggccaaggatgctgctaagcatcatacaatgcacagaatagcacaacaaagaattatctggcccgaagtatcagtagggctgaggttgagaaaccttggtgttgaaacccgggttttttatgtttactagtgacacctatgtgggatgtgtattgtttctacatatgagggcaagagacttgttcaaatcatgaaaaagttagtaacagaggtaaaactagaatgtttatctcctgactcctggagcagggttcattctagtagactatgccagctcagaattgagccctgatagaacttttcggtagatgactatttgtcaggaaggtggcagaacctagcagaacatcatttgagctcatatctaatgtcagagttaactttgaaacctgtttcacacttgttacattgattctttagtgtgaaagaaatacgcatttacttagtgctttatcatctgtaccttaaactcttcaggatatgctggtgtccagttgtctccagtctaacattgaaaattgtagtttaaaaagctttaaaatttgctccctccccgccaaaaaatagaaaaaaggtagacatgttcagatgacatttgtagtaattcagctcacaaggcaagtctttagccatgaagaaggtttgatttggaggtaaaactgtagggtgaatttctcttcagattctaattctccccggtttgtcctgtcgcagacttcccagacatttagcctctttccccatctttaataccattcttagagaccctggtttaacagtatctgagaacgccaggcttttaacagattaatcatagtataatggtgccattaggcaccatctttctagacgctgggtatgaggcctttagaagtctgtcctcattccttcttgcccctttaatagagcattggtttttcttaggaaacatacgaagaaacgaaagctcccactcagtcacaggatgcattacctcacctccatatctgttgcccacattttctaaactgggtgtcatcttgacctgctttggaacttgacctaactgacaaaagctgagcctacttacaaattgaactagtatctcaagtttgagaaacaatgtgttactcgcttgaaagttatcccctttacaagtcaccatatccattctcattcttttcttctagctgttgtctagcaggtcgtgcctatccccttggtgacatccctgaagatctggttcccttggttaaaaaccaggttggtactatttttatagccttttgactgttctccgtctctggttaagacgcactgaagacaaattgcagttgaggcttacacgtgggtcaggagctatcacctgttgcaggagagagcttacacactattactaaagtcaataattagagctgagaaagaatttaagagagaacttaaaatacagtagcaatttaaactgaattcagcctgcctttattttatccaaatgagaatcactgcttcagcaagatactttgtcaggtgagaaaataatcaacatttttttcccaacttgcaggtttttgaatttctaattcgcctgcattcagcagaggcttctcctgaggaagaaatctatccttacattcggactttgctacattttgacacaagagaatttctaaatgtattggcactggtaagagacagtattattttaaggtgttttcaaagaagacagagcaataattttttggcggggtgtggtggctcacccctgtaatcccaacactttggccgaggcaggcagatcatctgaggtcaggagttccagaccagcctggtcaacatggcaaaaccccatctctactaaaaatacaaaacttagccaggcatggtggcaggtgcctgtaatcccagctacttgggaggctgaggcaggagaattgcttgagcctgggagccggagggtgcagtgagctgagattgtgcctttgcactccagcgtgggctacagagagagactctgtctcaaaaaaagaaaaaagaaaaagcaatattttttaatagaaaaatcccataattcttatgcaggtacagtttttatgcactagcagtaagtcagggtttcaaatgtttaattttgttgtgctacccatttttttctctagttccttgccttcctccctttccctcttcctccctccctccttctatccctccctcctttcctccctctctccttctctctcttccttcctctctctctaacacacactcatcaaaaagttaaggagaacttagggcctggcatacaaaacatggaagggagatgctgaaggagatgcggtagtgatgatagtaaaaatagctggagtcgaaatggaacgcggaagctttttgctgaaaaaacacctttatacgtgttcaattagagatgaacatgtacaatttgggtgagccaggttgtctgtgcaaatgcccctggggagtaattagatataatgtatcttctgaattaaatggtattgttgttttttgaaaagcttttgatattatggaaaatgcttatagtgtttagcgaaagcagcaggcacacgaatatgcaaaacacacatatacacagtatttggagaaaaaaagacaggacggaaatacacctaaatattaatagtgattaactctgtgagatgaagcaaatttccctaataagcctatactacttttataaattgaattatataaatataataaactattaaattattttaaaaaggtaagtactcatgagaaggttattatcatttgaattggtttaatttgaaaatctgacatcagaagtagtaactttaattgcatagaaagaagagagggagaaacttagaagtcagatctagttggtttaggaaattttaaatgtccagaggggaacataagggtagttggtgactggcacataggaaaaaaagaaacaagaagtgatggaggaggaggtttagaaagagtgttagagaaaacaaagaacttaatgtaatttttatttctttaagggctgtggtagcaccgaaacacatttggaattatgctgatgtctgaattatgacactgggatttatagtaaggcttcaaaacagtctctgatttggttgacaaatatttgagtgcatggtatatcccatgtattatcttcattaggggatgcagccttggcaacaagatataaactgcttttgtggaggaagaggatccagacttgtagataaataattatagcacagtgtaatatatgccttaggggaagtacaggatgctataggaacacttaatgaggggcacctactggaacgttagggaatgtttctgagataaaatggtgtctacactgagtctcaaaacattaatagaagttagtcaggggaagggtaggaaaaaacattgtaggcagagggctgaatatatagaaaggcctggaaatgagacagagcaatgagtattcaagtaattgaaaaaaattcaatatagctgcatcttttaagtataaggagaagtacagagagaaacaaatccagagaggtaggcagataccgagtcttgcaacctgcaataaaaaatttggacttccttcttttcttccttccttccttccctccttccctccttccttcatttttgagacggagctttgctcttgtctcccaggctggagtgcaatggcatgatctcggctcactgcaacctccacctcctgggttcaagtgattttcctgcctcagcctccccagtagccaggattatagcacacatcaccacacttggctaatttttgcaccatgttggccaagctggtctcgaactcctgacctcaggtgatctgcccaccttggcctcccaaagtgctgggattagaggcgtaagccaccacacctggccaaaatttggactttatactacagcagttggtagcaattgaagccttttaggaagaaaaatatattaattttatactttaaaaagattccctttgactcttgtgtcttagtctgtttgagctgctataacaaaatgcatagattgggtggctcataaacaacagaaatgtatttctcacagttctagagtctgggaagtccaagatcaaggtgctggcagattctgttggtttaggcacacgtccgagaggcttccctcctaataaccatcacattggtgattaggttctcaacatgaatttgggggcatacaaatggattgaaatgagataagatggaggcagggagatctgttagtaaattttgtagtaatctaaatagaagataatggtagcttaaattagggcagtggcagtagggataccaagaagtgtaagatattttaagaggcaaatcagcctcataaagaagaatcggtgatggaggccacatgtagccccaaagccagaaatatttactgtctggctctttacagagaatgttgacccgtggattaggaggtagcttgctatcattattttacagaagccccatagtaatttttgaagtactacaaaaatatttttttatgtccaaattcacagatgacttacaacttgggttttaggtctacctttgtacttcagaaactgtaattctccattagtacatctttgcatattattcctctagtaaacatccataattagaagcatttttgtgggatgataatggtctaacaatgtgccattttggtggcagatgttaactaccaccaaaatagtcattaagcatatcataatattcacactgtggtatatcaccacttaattatgttcacagaatcaaactaccaatatctgtttcaaaggagtgactacttgctgccaaaaggaaaatggtgaaggaaattcttttttacttgctgtcactgccgtagtttttaaatgcatgtgttaattctccatggttttgtattttagttgaatagcatttatattagtggatggtaccttccctttgtacctgcagagtatcatctcactttagcaggcagggatgggtgtctatgtatgtgtgtgtttgttgttctcatgaatccgaagatagaactgagagagactttgtagtccgtcttcctatcttcagtcagggtcatattcaacccacatatacatcagaataacttctattgagccttccacagtaagagttcctacagtctccttggtaactcgtttcagcatttcccagctacctggcagtaaagcagactagttgaaaaaaaaagttgagaatattttgtttttctgtgcatcaaacaggagaaggaagggaaggacatactaataagagaacagcatgagcaaaggtactttggagaaattgggggaaattcaggcccatttaaagaacagtaactactcttgtttgaacaggagtatgatgtagtcttgaaagttcatggctgtgaaattcctttttatttttagtctactgggacaatgcgtagttcattttcttgtttcaaggaaatagcaataaattagtgctacgtggatttaaacatttctcagaatcaaatgaactaagtgaaaaccataggaactatctttaagtctttcatcattcttattgttcagtaaaaattttcatttccattttttgatagtggacataatctcaatttcttcatatatactatatgtactaggttttttgtgacacgctgttacatatactgacaaacagaatctggtattgtaatttattttgatgcatgttatgttcaaagtattttggctgtgcttgatcagttacataaaataaaagttgctatagttggcagtgttttgagaatagtaagtaggcttgagaattttaaccttttttttaccataataatttttaaaaatgcctatctttggacatcatttttcttaattgtcatggaaattgtgaaagttatttttatgacagttaataaaatgtgtcttagttatttccaaataacagactgaatgatggctgaacatgtagtattttatccttctgttctcaaacctttgctcccaaattacctcttttcattagtgttatcgctctcttttttttgcttatggactttgccttccttcctttctcaaattcttatttgtgatttttttttaagtctcagaatactgtgcaatattaaatgccatagctttctacttgactcactaaaaataatgtcacgcaaggtgtataagacaaaacctaatgaggaatagttatcttatttgagaaattacttggattttattaacaagaatttaataacttgttttcttctacatgtgcaaataataattactttaaaaaatttatttctcccttttagacttttgaagattttaaaaatgacaagcaagctgtggaatatcaacagcgaattgtggatattttgttgaaagtaagtattcaaagaatacatgtctttatattgatatttatattaagatagttgagctgttttatagcaggttataaaataatcttgttaagtggtttcttggaatcatatcgtaaaattttattacggtgtctttgttctcaagagctgaattaagtactaattatttattttaaaaaatttttagtgtatgttggctttagactggggaccggaatagagggcactactgtgagaaaggcatatggtgataattgctatgttagtatgattacgtgtaataatagagactaacttcagagtgctttgagaaaacaattaatatggagaatcttcctgtgtctcatgccaacttcactttgttgctaaggcagtgccgtattctatcatggcactgagatgctggatgacacttaagaatgatttgaggcacacagaaatgatcatcccagtataaatctaattagattcaggagaaagctgtcttgagattgatgctgttgctaatgaagaatgcagggaaaggttctttgcttttccatctgcatgacttcaggcaggccagtttcctcttgtagttgaaagcttagagtttttatttttgttcatttggctgtaaagtggaggtttctttcttttaatgttaaattattttggacaagacaccagaattaaagtgttttctagttgtgcataacatcaatatgctacatttataatagttctgtatgtttatatacgttatttcttttgagctatcaattaatattaatttaaccttgtaagacaggcagtgatgattatgaaaataggattgctgacctgtcagatgatgccagtttgattgagttggctagtatggagaattttcacctagatttattcccagtcttgtcctcctttaatttgtgaccttgcctctcttctacctaatactcttccatggcttcctattggtcatttggaattgagttctgctgtgagagaaaactcaaaataacaatagtttaattgtgatgggaattaatttttctcatagaagtctggaagtaggcaacctggtttagtagagtgacttcataaactcagggacgcagattccttctgtcttagtattacacttagtacgtgatttccatctttccatccaaaatggctgctccggctcctgctattacctctgcattctagccagcctgaatgtagaaagagatgaagaaaatgttccctctccttaaggaaacttcttaaaaactgtgtaatacaattctgcttacaccgtgtaaggccccttggttggtgggggagatggagaaacatagtctgtattcttgtaaccatgtgcttagctaaacatgaggagttctgtttttcttcttcttcttttttttttgagactgagtcttgctctgttgcccaggctagagtgcagtggcacgatctcagctcactactcctgggttcaagcaattctcctgcctcagcctccagagtagctgcgattagaggcacctgccaccacacccagctaatttttgtatttttagtaaagatggggttttcaccatgttggccaggctagtctcgaacttctgacctcaggtaatccgcccacctcagcctcccaaagtgccgggattacaggtgtgagccactgtgcccagccctgagaagttctgtttctaagttaggagggaagactagatgttggagcataagtaatagtttctgccatacccgtctaaactgttgaacatccaagatccctctatatattctggtcctgactaggtctctataactggtcccttctgtcatccatctcgtcatcctaccccacacaccttgtattaggaccctcaaccatattaaattattagaattcactagactctctgtggtgtgttcatagtttatgttctttgcaagggttttctttcagcctgtcatgccttttcctttcactgactggcaagttcctaatcattttccaagacttaactgaaataccatctatgagaaactgttttgaacgctctcccacacatctaggttgattagttgctccttgtctgtgctcaggcaacactttatgcttcagttagcacactgtagtgtcatgtttacatattttcttatctgtcttatgtagacttgagcttcctgaaggtagagactgtgaggattattctaattattattattattactgttttggtcattgttttagcatgcctagaacagatccagcacaatgcctgtaacccagtagatgtcagataaatgtaagttggttacattgtaatttgagtttaaaactatactaagttggaagagtgatccaaatgaagagaaagctccgtaagtatttgactatttctgttggtgacttgccattcttgtatgttgtcttgatagtgtttatcttgcgtcaatgaagaatgagattttgagattatttttttcatttctagtgctagagatgtgctaattggttaaagtgtacttgtgagggatccggtgagaggaggagtataggcagtgaccagagaacaggccagtggatgttatcatgtgtgctgaatggctgcagacagaggaaacatctattaatttgtgactttttacattgcccagaaaatttgtaagcatggtctctgaaataggctaaagagaagaaatggaaaggaaatggccttttgtaggataataaccaattagacacttgctgagttgatgagggaattctcatatatatataagaatatatatatatgagatagagtttttataacttgaaatacccacatattctaataataagtttgcacttgacaattgatgattactggactaaaagcagaaagggcaaaagagagggatgcaagaagtaggtcaaaagctagggaatgttgtataatgggagaaacctggtactttatctttgaatggagggtggaaggagggaacttggaactttttatagatgtgtgagggtgctataccctgatttgttgtagagttgcccccatgaattcagctcgcccaaaacagtacatagtcttccctcctacacttctgcattctctctgttaatggcatcattatcccacctgccaatcaggctcaaaaaatgtcctgtttcattgttcctttaaccacatgtttccacacataggaatacttgtcctgtcccccctgtctctgcctctttccattttcatgatcactgccttacttaagagccctttagtctctcccttagactcctgcagtcacttgtatcttgctctccctgccttctgtttctttcttctgttaattttatcccatgtactgctgacaggataattttcctaagcacaatactggtcatgatgaactccgctggtggaacacgtttagtagctccccagttttctgtagaatacattctagattccttaggatgacatttgagacctcatcttctcttttaatctatagtttccctcttcctgcatgctgctgcattctaataaatattgttgttccccttaacaaatgtgtttttctgtgtccatgattttgctctcactcttctctttgccaggtttgccttctctgttgacatttcccccttgtcagaatttctgcacgggctttaaaacttagcttaaaagctattcttctcatttcttttcaaattccctctctaaccagttgaattaaaattttccaccgtgcttctgtaatcatttgtgcccttataatagcagtcattatattatgccttttatttaagatgttatgtcttttccttcttgttcctaattttcttaaagacacttatagcatcttacacatagtgagtacttaggaaatgagagctgagttaaagccagaggaatgactatgatttgataactgtgtgtgttgttaaaagcctgttatacaaaaccatgtcttcaaggaactgcttaatagaaagcggaagccgttcacttcattggtctgtgtgatagctgacttctctgggctaccttgactctcagttatcttactctcaaacctcaaagcagctctcttcttcccttgttgatggacagatttttagtagggcttatttaattgtacaagaccagcctggccaacatggtgaaactttgtctctattaaaaatacaaaaattaaccaggtgcggtggcacacgcctgtagtcccagctacttgggaggctgaggcaggagaatcacttgaacccaagaggtggaggttgcagtgagccaagatcatgccattgcactcgagcttgggcaacagaacgagactccatctcaaaaaaaaaaaattagttgtagaaggattctctaagaattactgagggaaacgtgattaatatttctttgaaatactacactttacatctctacctctttatcaattcaggtctcatccgaattgtgatagaaataggccaaaaatcactaaaatgttttcctctcagagtatgcaagtggttgtgcttattctaaatggcgttgaattcaattgttgcacagtcaataaaagaatctttttacgcgtcttcagtcatgaggctatcccgtcttctaattgtatttttttttttttgcatcaaaccaaatggtgtattgaataaatggtctcctttgctcttcaggttatggtggagaattcagactttaccccctcacaagtaggatgtctctttaccttccttgctcggcagcttgcaaagcctgacaacaccttgtttgtaaacagaacactttttgatcaggtaagtgtctagcagtgaaaactaaaaggttttttcctgtttactgcgcacagttccctggattacactgtttcctgatgtgacagactattgggtaaataccttatcaaggagaggcctgttcaggttttggatctaagttaggggggtatgtgtatatgggtgtatgggtatgttttgtggagattggtttacagagattgtgttctctcaattattctgttgctctgaattgcctagaattcgttgctcaagagtttcccaatttaagaatctcccccatctcactggtagtaagactattatgaccatcacctggagaaaagattacttttgtacaatctcagtttacttacaaatgactttcaaggtttcttgtaatcccgcttaaatagctatttttccacaggtggcaaagaaaatactttttgtctggagaaagtaactaaaaatgactaacattttctgagtcttcacaatggcagacattgttccaaagctttgtgtgtatgttaccttagtcctctcaacagctctaaaatagggacagttatcctccttttatagatgaggaaactgaagcctggagagattaagtaattcatgttaggtcatacttagtgtgttattattagcagtaaatattaagtcttaatagagttagtatccaaattcaagtggcctgactcctaagcccatgctttgctaggtccatggtatcgtatcaggaaacttaaagttaaggtatattgacaacactgccttatagttatgtttcttttctctctctatttttttttttttttttttgagacagagtctggctctgtcgcctaggctggagtgcagcagcacgatcttggctcactgcaaccttggcctcctgggttcaagtgattgtcctgcctcagcctcctaagtagctgggattacaggcacataccaccacgcccggctaatttcttgtattttttgtagagatggggtttcaccatgctggccaggctggtcttgaactcctgacctcaagtgatccgccctcctcggcctcccaaagtgctgggattacaggtgtgagccactgcgcctagcctcttagagttatgttgccaggccggatgcgatggctcacgcctgtaatcccaacactttgggaggccgaggcgggcggatcacgaggtcaggagatcgagaccatcctggctaacacagtggaaccccgtctctactaaaaaaatacaaaaaatgagccgggcgtggtggcgggcacctgtagtcccagctactcgggaggctgaggcaggagaatcacttgaacccgggaggcagagcttgcagtgaactgagatcgcgccactgcactccagcctgggcgacagagtgagactctgtctcaataaataaataaataaataaataaatagttagcacacctgcacctgatgttacatgtactgggttaatcagttgggaaggtagcctacacctgtggtatttgttatgtctgggtgtgaatgagttggttatttgaaagggtagttattatttttattatgagagtattaatgtctagatgctgatatcaaataaaaaatactttttcttcggccaggtccttgaattcctttgtagtcctgacgatgactcccgacactctgaaagacagcaggtatgaactactagaactctttttgctaaaaaataggaaagaagagtaagccagaaagaattcttctgtgctagacctcactacacatgaggggcaattacttgtgccaaaccctaatacgaagttagagtcagtgggaaccagaaaatagagtggatgattgttagaggtacatgtgtaagaagcttatatcaaactaaattcctaggtagactggatctgtcttgtatctaccgtgacatcaaagaaacttcccctattatatagcaacagctaggacttcttgtaccctgcattccattggcatcattaatctggtaactactgctagctgctgtggtcctgaaacaaaaaagctgcagggtcctgagtattgacatacctaatttttgagagtgccctaaaaccccactgcattagggctgaccattctggagactagaatccacctgtccctccgctaattatcatgagatagtaactgtttgagtaccacttctttctgttcatgccactttcttgaggttgccttgaggagtaggattctttaaaaagcatacccaccataattgtgggcactaagagagtcaacccattttgtattgatagccagattttgtcaggtaagtaaactactaaaattaagtaccatgagagctgtgctgaagtatggctttatggcactgtggtaatcatacgcagctgggaagttgagactatcggatagcaacagtgacccctttatccgcacagctatggcccagtgactgctgcagagtatcctaggtaaaagaacagctggtaaaattttggttatctcttaaattatattgaatacaaatagtatatgggccccctcatttcagctgcttagtgttgtaaaaattaattctatgagctccaatatttttgtttgctttttattgtggtaaaatagacgtaacacataatttaccattttaaccatttttaagtgtatacatcagtggtattcacattgtacaatcctcatcaccatccatccccagaactcttttatcttcccaaactgaactaccataccaattaaatcataactcccactccctgttttctcctccccagcccttagtaactaccagtctctatgaattttactaccttaggtccctcacgtaagtgcagtcacaatactcgttcttttgtatttagcttatttcacttggcagaatgtgttcaaggttcatccatgccgcagcatgcatgtatcaggttttcttcctactgaacagtattccgttgtatgcatatactacattttgtttattcattcatccactgagggccatttggattgtttccaccctttggctattttgaatagtgctgctatgaaaagccccaatacttaatttttaaaaaattaacatgtaaacatggataccagctgtggatagacagattgtaaagaaccgtaagacataaaagtgagataaaaattcacttcttgaaagatatatatggacattttagcttagcagagagtcagctcaatgtctaatagggctttatttgtaaacactgtggcgttctttccatgtttggaaagcagagccatttatctttttatagggcttaaatgcagtatgatcaagtttataatgtcagtctaaccccttccatatgtgacagcaagccaaaatatcatcaactaagaatacaaaagaaaaaaattaaatgttatagtctgcatggctgaatgcactcttaaagagctagtaaattctcaagtgtttttactcatttattgtaaatactcaggtccttttagaattgctgcaggctggaggcatagttcaatttgaagagagtcgactcatccggatggcagaaaaagctgagttgtaagttgttttgaggctgtatattagtttgccatagaaatattaaattatatttctttaacttaaagctcagtttattgatacattgctgcttttttaattaggaaagattatacaaataacaaaaagctaagggtgaaaatttttcccttttaattgaattctagaaattagtaaaatttgcagaaattgatagggcagatatgaaacttttatataattgtttaaacataaagtgaaatagtcttatgatgttttattattttagattttttctttaatatttccatgtttcataaattgttgatggttatcttagatatattagagacaatgcagtatttgacgtagtaaataagatgatatgatcacattgctacttacctagtatgctgtatttatatgacatgtaattctgaacagaggaactttatgtaaaatttttgtaaattatcaattaatatctaacatattcactatttcttatgtgatacactattgttttagtatttcctttgtattcagcattgaaattttttataaacataatatttagcagcctcttgaacctatagttaaaggttaacggcaaatactcatctcccttagttattcactgtaactttatttaacaatagaaatcacatctactatattaatttttcttttttttcttttgagacaaagtctccctctgttgaccaggctggagtgcagtggtgcgatcatagctcactgtagccttaacctcctggtctcaagcaatcctcctgcctcagcttccgtagtagctcagatgacaggcacatgccaccatacctggcttttagtttttttgtagagacggggtcttgctatgctgcccaggctgatctcaaactcctggtctcaagcagtcctcttgcctcagcctcccaaagtgcttggattataagcatgagccaggacacctggcccacttttcctaatactaacctgtgtgccagagcaaatgtctcaaaaacctccctgtttggtacactgaagtttttccctttacattctagctatcaaatttgtgaatttatgtatgaaagagaacaccaatatgataaaattattgattgctacttacgtgaccctctgcgagaggtgagtcaagatactgctttactcttttttcttactcaactttccctcttattgagtacaaataactgttgagtagaaatatttgcgcatgtgtatgagccaaatacacattgataattaaaacagatacagttcttgcagttttggaatgtataatttagtgatggaaactgacagtaaacaaagtcaaatatgattacaaattgggataaatgctagggaagagaaaccgagtgctactttagaggatgatggggaactgacttacacagagtagccagggaaggaatttcagagaaagtgacatataaactgagttttggaatttgagaagccagtgaaggaaagagccaagaagagtgttccaggatgggtaactgtatatgcaagagacctgaggtggggaaaattgacatgttcaaggagctgagtagagatcatatagatgaagtgaaaatcagtataggtggagcataatagacaagggcaggagtggtttctgctgaaattgggaatgtggacaatgggatccccaaaagccaaagtgtgatactccttcattaggtcactgaagattaataaattcaaaccaaaattaattagaactgattttttgcttctaagagtctaccctaaattttaaacaattactctttatttttagggacagagttttccatcagttaactatctccagataatttttcatcttcagataatagatgtttaccaagactggttcagttggtagggactaaatcttgagtgagtgaatgaataaattatattgtcttgtgctcttcaggaagaagtctttaattacattcacaatatcttatccattcccggacacagtgcagaggagaagcagtctgtatggcagaaagcaatggatcatattgaggtactgatgcgcaaaacttcacacttcaccatctgaacgatcatctaacccaagttaactttatgccaacgaagcaatggcatgtatcatattaagttgatttaatttagggttgaaatctttttcgtgtaattattctacctcatatttgtattcataaagtctgtgtcacatgcaatctattacatcatgacttctgaaactagcccatgttcaatcagccagtgacaaactattattaatgcatttttacaaagttcatagaatgattctgagagtactgcttgtccttttttcctaatatgtgatgagtgccattccctccaatcatctaatggacttttagaaaaattactgcaatgagttttctctctgatgtgtttctcttccttatataacaggatgatgattctgacctagctgtggtcagctaattcactgattttgttgatgcctgctattttacagaggatgcaagtattcacttctattgaaacaaaaagttcctattaagaaacaatgcttctagatatacaaatagactacttgcgtgatgagggctgtgatcacaatgtgttctgaaatgggacccaaaaatcacttcttactttagtttccttatgttcataacatactccttaccccagaatccaacagaactagcagttttgttgaaatctcttatttttatgttttatgttattttatctattctgtttatttctgatgattgaaaaaaagtagtaagaaaagaggtaatcctcttttggaaataacatttaaactgaggtaatcctacttttggaaataacatttatatctacagagttgctctcattcttcttatagcaagagtcaggtggtggatttggagatgtagtaaagatacgattattcaacatgtttgaacattttttatagatatgaaaaactataagaaaggatatgatgtggatactttgttttagttcccgaaggttgtaaagtttagaaagatcagaggtgtgaacaacatcttcttgtgaaataactggcacgaaaggtagtatagccagtcatgagatatgtggtctgaagtaatttccacactgctgtatataggattgagaacatggaatatgttatttagtgttgttatatttctgctaacaacaagatgaatatatcttggtaaaataacccaacaagtcattctctgattttgtgttttatattttttccctttaatcatttagtattctttttcatcctcctctttaagtctccatggttatattatgattcagttctcatttcacctcatctgcattatacagtggtttgagcacatggattccagacatcaaaaatgaagccacatctctgcattatgtgaaatgtgataaattaatcaatgagcaaacattgctcagcaaaaaactcaagctaggggagcaagaagtatttttgctacacaataattacttttgctgactagtttttcccacatctgcatattttttcaccttgaactttttaatctcttaaggccacaatgacaggtgtataagcttttgttgaaggacttctgtgtcttcagtaatgtaaatataatcaacattaaatacataggacaaaaaggcatcataatgaagttttctgacaagatacacttagtttatagcttagtggttcttaacactttttttgagactctaatgaaagattgatgcctcgtaatattgcacatgtacatagatacatgattctgtttaaagtttcagggatatacagatccctgaaagtctttcttagatgaccaatctctggttcagatggttttttgaatatgaaagatttcattagattgtgttgacatgttatattttgaaatttataaagcattcaaaaaagtacataaaacaaatgtatagcttaattaaaaatggaaaagcaaacatcctaggtcctcaacaagaaatatgatatttccatacctccgacttttcccacatattcttttctgatcacagttctttcttcccccttcccccacacagccattatcctggtttttgtgacagtttcttacctttttgtatactgttactgcatgtgcatgcatccctaaatatatgtttttgttttgcctattcttgaactttgtgaaaatgaaatcatactttattttcttatttttgcccagtattttgtttgagaagattttaccttttgttttacatagctgcagttgatttttattgtatagtattacattttataagtatatcacagtttatccattctactgctgctaggcatttcagttgtttctagttttaactattaagaacagtctgttcacaatcatccgtatatgtgcatcttgagcatagccacatacatttctctaaggcagtgattctcagtttcatccccaaaccaacatcacagcatcagctgagaatttgatagaaatgcaaagtttggacctccacctcagacctcctgaatcagaaactctgggggtgaggcccagcaatcccctacattattctgatgtatgctaactcataatctctgctctagtgtatataattcctagttagttgagattaatattttaaatttcactggatgccagcactgtatgagagttcctatggactctatatccttggcagactttaaatctttcccaatctagtggatgtgtaatgatacctaattatgttttacatttacctttccttaattactaataagactgacagccttttcatatgtttattgggcatttaaattttctcttttgtgaagtgcctgctgaagttttttgcccacttttctgtttgaaatgtctcatacttactgttttggaagatttctttatgtattgtggatgttagtcttttatcagcaatatatattgcaaatatcttctcccatctcccattctgtggcttttcctttcgatctttgtgtgtgtgtgtgtgtgtgtttttaagtggtcaaaataatcatttccccccctctttatgtcctgcttgctttcttatttctttttaatctttggctctgagttccacctgaaagtaatttttgtgcatagtatgagatggaagtcgagttaagtttttagaatacagatgcccaattttcccagcagcaattatttttaaaggttgctttttcctgttgctcagcaatgctacctttgtgatgagtatatcaaggatctatatgtgtagtctgtttctctgggccttctgttccattggtctgtttgtccatctctgcatcagtaccacactatatttaatattgttgctgtataatgagtcttgatatctttaacagaatcttggctattattgacttttgatacttccaaatacattttagaatcaacttatcaagttccaccaaaatttttttaacttcgtgattatgacaggcattgcactgaatctatcaataattttgaagataatttgcaatctttacaatattgagtcttcatatctatgactgtatggtataatcctttatttaatatcttcctataaagttttatagtgctctctgtggggaatttccatcctttgtttttgttttgttttgttttgttttttttgagacagagtctcactcactgtgtcgcccaggctggagtatagtggcaccatctaggttcactgcaacctcagcctcctgggttcaaatgattctccctcctcatcctccctaagtagctgggattacagatatggccaccacgcacagcttatttttatatttttagtagagacagggttttgccatgttggccaggctagtctcaaactcctgacctcaaatgattcacctaccttggcctcccaaagtgctaggattacaagcatgagccaccacgcccagccccatcctttgttatacttactgtcacaacttcatatttttaatgctgttgttaatggcatttttaaaaatttcatttccaacataagtatgtttactgtaaggatttttatggaagttttcttctatttctactatgccaagagtttcctcatgaatggattttgaattttatcatgttttcttccttattctgtttttgtgttaaattttattggtattaaaccaaccttgatttttgcagataagtgcagcttgatcctgatatattatttttatacattgctgaatttcatttttatttaggatgtttatatcaatatttgtgattcagattgatctgtaattttgtcctattgggtttaaggtgtcaaaatgttactagcctcttacaatgagctgaagaatttttcttttttctattctctgttgtaagaggtttagttaaggctggaattatttcttccttaaatggttgctagaacttaccagtgaggctatttgaccctacagtttttcatatggaaagtttttaaactactcactcagttattttaatggttaaaaatcaaatcagggtcagacacggtggctcatgcctgtaattccagcactttgggaggccgaggcaggatgatctcttgatcccaggacttccagaccagcctgggcaacatagcaagaccccgtctctaccaaaaaaaaaaatcaattcaggctatttcttctcaagtcagtttattaaattatactttttaggaatttattttgtctgaatttccaaattcttggcataaattcattcatcgtagcttgtttttgaatggctacagatcagtagtagtgtctcctttgtaatatttagttataccttctcactcatcaggagtattgcattaaagttatgtaaactacagttatttgtggcagctaattattatgaatctacaagtactacctaacacaataattaagagatacattgtgaatgttgcagtcatagtggtttgtctgagttttatttaataatacctattttggtctacatttggtctttgtgttttagccgtgtattgtggttgtgtttgatcatagtgtccccacagagaaggtacaattggaaaggtagaatattaggtgacagaaaccaagtaagaagagagttttaaaaagaaaaggatagtcagtagtgtccaggaaagtccaaggggaggtcaaattaaaagtcttatatttgacaaatacattttattaacaatgtttaattaaaagtggtcaacattttactctcatataaaatttaagacctgaagtttatttcttaaaatgcttgcagtttctaaatccactaggcaccagaagtaaagttttaaaattctcggccagataaattacaactattctttctcgtttcttcaagttattactttaagctccagggtgaaatgcattgacaggaaatttgggaagcttttgctccttctgtttctcctgcaggtatcatggctgaaatccagaattctatagtgctttcattttctaagaattctgaattacctttctttaaatgaaattttgatttttttttttacatggcacatttctaattttgctcatttgcaaagtgcgctttaaattgaggccctatatcaaggtctgctgaaatgcagcatggaagcttgcgactgtattgaggtaggtaatcgtgcctcacatctgtggatatgctgtttaaatgagccattagagatggctttgtcttttcctttaactccaggaactcgtgtccctgaagccttgtaaagctgcggagctggttgccacccacttttctggacatattgaaacggtcattaaaaaacttcaggtacatattgcaaatatatattggggaaaaatatctagtggaaagacaattattaaatcgtcacctaagaagttttgattgtagtgatttcttcagttgacatttattagcagtttctattaggttggtgcaaaagtgattgtggtttttgccatttctttaatggcaccaacctaatactgtgtgtgtgtgtgtgtgtgtgtgtgtgtgtgtgtgtgtgtgtgtggttgggagcagttgtatgatgatctcttagtttggaaatgagggagttcatctttgtgcatacaaatatgagcttcaaagaagcatttctggaactataatgtacttatcctagaaatcctaatccacagatcctcccttctcccattttcttttgctgtaggatccacaaccccgttttctttttttttttttgagatggagtctcgctctgtcacccaggctggagtgcagtggtgtgatctccactcattgcgagctccgcctcccgggttcaagccattctcctgcctcagcctcctgagtagctgggactacagatgcctgccaccatgcctggctaatttttttgtgtttttagtagagacagggtttcaccatgttaccaggttggtcttgatctcctgacctcatgatccgcctgcctcggcctcccaaggtgctgggattacaggcgtgagccaccacatctgggccacaaccctgttttctttgagattcatatttattcaaaactttgtcatcctgaaattgtgctgtttagaatgtttcttggaaaatcttaactggaatacagctatatgcatggtaaatattgagaagctcagttagaagtactattgaatggactgtttaaggtattccacttaccacttaccatggccgtgctgatgttgagtttgctccctgtcattgtagccacaagtgatagaggcagggaataggacaatgacagggacatgaagcaccacccagagtcctcaagtgacattaatagtggttgggaatagctgtgcaagaaggaaatcagagcagtgagtaggaggtagctggcatgagagacaaaaatatggaattcattcattcgaacacttagtgctgctctactctctaccagtgtgctaggccctagggacagaaataagaatacaaccttttcttaaatttttcctctagaacagagaagcacttgcataattatagtccagtgttgaaagagctacactagagatatgtgaaaagtactgtaggaacaagagaagagggtgatggattgcgagaaagacaagaatgcccagagatccctaatctggtcttgaatgcctaatgtcagatttccaagcagagacttgggcagggctttcttaataaaaaggttctgggtataaaagccttgaaggcataaagcagcatgcatgttcagagaacagtcaggtctgtgtgaagcatgacgtcagcagggggtgatggtggaagtggcattaggttaagctactagtgataggctggaggggaggagctaaactagaggggttgcaaaatacagcttggagacaaatacgaaacggtttcacatgtgatgctatgaaatttaaactgtcttctgtgtactgagaattattgaagttctttaaagctaaagagcagtatcattagatccattttacagaaaatgaacttcggatagcagtggggagaatggactggaaaggagagcaaatggaggagagagaagaaggtctaggcaaaagatggagaggactagcactaagtcagtggcagttggagaggacagatttaggacatttttgtgaagtaaaatgtataggatctggaaatcagttgaatgtgatgggaggagttaaaaacaactcccagatatcaggcttggttgtccagcatgataatgatgaggtccattaactcaagaaaaagactcaccgattaattcaataaatacctgctctgggccaaaaacattaagtgctgaggatacaaaaacatgtaagtgtgatcctgctctctaggaagaagacaaataagccaaaagacaattacagactagcttgattggaatgctaatggagcccaggatactgaagtagtacacggaaggacatgaaatccagtctagtgagggagggtaggaggaggtttctaccaaaactactctcaacctccagagcttctctcccctttaaaagtcagcacttctggtaaattttgcctgtggtggtggctgtgttgtcattgtcctttaagatttaaaatgatcacttgtaggattttcttttcttttctttttttctttttttttttttgtagtctctacggatattaagagacaggcccagtaggtgaatataatgtcattcatcagacaaatatataaaagtaaagtatgggcggggcacagtggctcacacctataatcctagcattttgcaaggcccaggcgggcagatcgcttgagctcaggagctcaagaccagcctgggcaacatggtgaaaccccatctctacaaaaaaatccagaaaattagctggacatggtggtgggtgccttttgtcccagctgtacgggaggctgaggtgggatgatcacctgaacccaggaggttgaggccgcagtgagctgtgatcatgtcagtgcactccagcctgggtgacagagtgagaccctgtctcaaaaaaaaaaaaaaaaaaaggtctgtttgtggagtcttagacatttcttttaaagaaatgaagtatttactttattgcatagctttataaattgtgcaagaatcccacatagatcttacaaagtacctttacttttgatggcaagaaatatgcctctgaccaattgttttcagaattcttaaaatgaaaaattgccagaatgttatgttataactgagaagaaagtcatgtaaaataacacaaagtgatagtgaaaaaatagaaaatcagactgataaaaataaatatatttttaaatcatattttatattaatctttttcatctttaagagtcccccattttttacagataaagtgtgaatttgtcaaaaaataaaaaaacaaagaaaaactaaacaataacaatttttgcataggtttcccaagaatttagaaatattcatatttttgtagtatttgaaggtttatctcatttaaccctcactactacccaatgtggaaggcagagaagatattgctgtcctctttttttttttttttttccacataaggaaattgaattgctcagaggataagtaacttacagaaagtcacgtaagtgagtaaatggcaaaaacagaacccagattttatggcatgttgattgctaacatgttgcagtttgattggcatctcttctgtagttgttgatattcatgaacttttttggtggtggttgttaacttggacctcaaactcccaccctccctggatgaactatctcacagcaacccattgccacaggaggaccaggttaaggcaaggtgaaactgatcagtgcatccagagctcagcatccacagagcagttccaagcacctgccactccgagggtccttgtgctgggaacagctcgaggatttgtctcagtagaggtctgttttgggcgataatagggtgtttgtgttccgtttacactgagaagtgaatgtgcgacagtgattagaattattgagaagacataacctccagatgattctttagaatttcttagatctgtacagagggctttgtggaaatactcagatatctgtgcataaagggataggttaaagtagttctttaccatggaatatttgaaaaatttgttttaatatttaattgtaatttttattgtttttctgttcagaaccaggttttgcttttcaaatttttgaggagtcttcttgacccaaggtatgttgacaaactttagtctttcattatatatatatatatatatgagaaataaaaggaaataaataaagttaccagcccatggtatctaaataatacaattagctcttaattttttatattagtaggagcaactgttacacagataatgtgaaaatagaagatctgaacgatagattatatcttgagataatacttttctttccatttgaacatgagcatatatggtgagttctcatgggtgtaaataaaataatgaagccatgccacaaggacatgtttcagaagagttagcttccccctcctgcccttgtttcactcttgcctactcctaacttcatgtgggtgattgatggtggctctactttccaaagttaacacttggttcccagcccacctctaaatgtattaccttttaaactctgacttaatatgtttagttttaaacaacttcctgatggtgtgggaaggaaagtttaaatgtgttttttcaacagctactctgatgtttatatcaaataaaagcaaactcaaggagatgatgaaattaataatggatttgtaggcaaagcagtgctgcatatgaggttttaaagttttgctgtaactacatagagtacattgggagttgagggcagtaatatttaatatcctctaagatagctactcttgactagtagtgtgcatcagaatcacctacgaagcttttaaaaattcagatggcttgtcccaacccacagaatcactgggagttggaatattttgatgcacacctagagttaagcatggtttacgtgtaattttccaagatgacatagctttcatatcagacatacaaactttaggtttcattataatatatgctggccattgaaaacaactatttacttacgttagcaattgtaatatcagctttggttatttccgtgttctgtgagattttaaaataccaaaataccagtaattttgttggttgtaaaatttttttgaaagctcaaccatttaaatcttgaataggctgtggtacatttaaatttagtcaaacgaatatgtatgtgtagatgtttactaaaagcagactgattacaaagccccctccacttgtgttcaagaccttttcaaagtatctgtattttaattctctgtcctcagattattactgagggtagacatcctttttttttttttttttttaaattcctattaatcatgtgtatttccctcagagtcagttcgggcccttttctactcccagaattaactgatggaaagattttagaattggagttgggagtgggagggaagaaaggaatgtgggtagaggtagggagagctgggagggggagacatgaaagtagggcagaggatggagctcaggggaggaggaaggaaacgccagccccacttctcagccctttctccagagcctgcccacctctttttctgtggcacagttccctcttttcctctcccatacttttcccagtgttagatccattcactgctctgcccttaggataatttattttaatcaagtccttttcctctgctatcctacctggagagactcaagcaagaacaacaggggaaggtcagctttgaacttggcattttctcaaatgaagtgtggaaagtgatggtgaccaagtatatttttttatttaaaaaaaaaaacagtattaggtaatgtaaatatctgtcaaagacctagtgttctgctttgagaatcctagttcttggattcatcatattttatcctcttactttatgtcttatataggaggtaggcattgatgtagattatgctctaaactttttgaatttgatgtttggcatttcaatcattttttaataaaaagcaaatacaaataatatacctgctttggtattgcggtcactatttaaaataaatattacaaaaaaaaaggcatatcacaagtatcaaaggtcttcaatggacagtcttgctcccttcttacctatatctagatttgaaagatgttagttaggtaagaccctttatgagtgctgtgaaagttgttttgttcaccagtaaaccacagatcattttacttgagaaacaggtatattttatttccctaagctaaccctaaccaggataattacctctcacacattattcctttcctgtcatatcaattcaggcgcaaggtcctttcttaccgaccttgaaaagagtcagcgtgctcacaggccttcctctccccttccccaaaaagtgacatgaccaggaatgacctcactctcacagccaaatttctagctttacgtttgtctaccagaaattaagagccttgaagtcaccagcttaccttagctctgcctttaaaaagagctcatgtttgtattgatctgcctccaaagtatcaaagaccgcgtgttctgctttgagagtcctgattcttggattcatcatattttatcctcttactttatgtcttccataggaggcaggcattgatttagattatgctctaaacttatttttgaatttaatgtttggcatttcaatcatttttatgtaaagaacattttaaatgatagtatctcaagctaatccataaaagcttctttaacccacagtgtaaataaatatataatactagtaacatattgagttccggattgagggagagaaagtaggttaagaaggttgagtgccgagggagtaaagaaaaaagaggaagttctccctttcttgctttgagagtggttgttagaaaaagttttgatttgtttaaggtctgtttttggtatcctttgaaccctacctccaccccattccgttcccttctttccagggatgcagggtacacacacttcttcaagctctttgcattataggcacactcagatatagagtgttctttatagatgtaaaaaatccaaattaccttcctccatttccccatcaaaactgttttctagttgctttgtcagtttctgtattgtatggccccttttacaatgagaaatatataaatgacatatgaaaacaatgaagcatataaaagatggggaaaaaactcaacaccttttcctaatacagttgacctcaagggtaagaagaaagcgcagagcacatggattggtttatattagtctctgattgactaacttctcattacattttagctgttttttagtgaccatgcttgttaactaacctaaagtaaaggattagagtcttttcaggtactgggaaaactgagggagtacagaatacggatatagggtcaaaacaacatcaagaataggtagactggccccggctagcagtttacttgacagccaactgtgaaatatttttgcctttgtttcttctctttttgttctttttaagcaatagatatttttaacctccaggttttttccgccatgaaactcctaaagcagcattatgaaagaaaacagttattttgagatgaggactgctggtgtgtatgtatcatctcagtgttgctttttttgctcttgccgccaacacctgagttaataggattctcattcttgtatgtatagtttatgcatatttaatttaacatttacatgtatggccaggcacggtggctcacgcctgtaatcccagtactttgggaggccaaggcgggcggaccacctgaggtcaggagttcgagaccaacctggccagcatggtgaaaccccgtctttactaaaaatacaaaaattagccgggcgtggtcacgcacacctgtaatctcaactactcaggaggctgaggcaggagaattgcttgaacctgggaggcagaggttgcacacacacacacacacacacaaacaaacatttacaagtatcaagttgtttttgagggggtagtttttattttgtcaacagcatttttaaaaggataggtcatccagttgaatttgtgtggatatttctctatgtctttacccagtgtctttatgtcatccttgttatgtaaatagtttcctcagtcaaattaattgacctgcaaagatattggtggcatctgtacatagaaagattaggtagttttagggggagaggggattaatcctccagaaggaaattacttgcctgaattaaggacaacagcttgggagagaggatttgcatcctcttccaattatttcctttgggacagctgctacgtaaagcccgactctacccccatcccctgggtgcattgctgctggccatgaattctcacaggagttctcctgatgtgcttacacccagctgcaggttccttatgcagtggggatgcttaaaggataatacaaaaggacacgtgttttttgtgaggccatgagctgcataaggagtaaagagaatgtgcaagtatatttatattctgaatattttcctcagtatgattttcctggtaatgttgatttagcctttgttaacaatattctgaaggcctctgaaacatatagtatgattttcctgtaggaaaaaaacacatacgtcacattgtatctgaaagtctttaatcaaagtaaagtaaaaattgaacattgttaagaaaatgagtaactttgtcaaggagcaagatatagattatggaaatggttatgcattggattttagttgaatctgtcagtgttgctgtggatatttttgaagggacattttaagatattgacactcagtattgaaataatatatttcaaagttaaaatacaaaattaggagattatatatgttcatgaactttgacatattaaaaaaaatacctacttcaatgagtgcctacagtggccaaggtgattgttaatttggcctggcttacccctagatcttatatctttggttagtattttgctagcaactcaaaatcaaccttttaaattgtaacacatcatcacctcctaatcaccagtcagctcctctctctctttctctctctctctctctctatatatatatgtttattacatatatatttctttattcctttaatcagtacttacctataatgaaatttttatttatactcactttttccagcctaaacctcttctctcttaacaattaatatcataaactcatttattttatgtagcaatttactgagtaactacagcataccaagcacttgacaggcatgggagataaaatgatgaataagacagggccctgccttcagagaatttacattctaatggaggaagataggcagaagcaggtaattatgtataagtatcttaaataaaatcctgagagtgatgatcaagttttcactttcctttatccattcccactctaccttgtcaccacaccgcgcagaaacagttaccaaaatctataaactctacctcttctctgtctcttatatgtgatttttcttcttgtctttacccctactgccctggtttaggcactcaacatccctcctctggtttcttttgctggtttcccaactgtaatctcccaacaggttcttcctgctacacggaaaaaccaattcactgagaccacaatattacagtagagaaagagattaattaacacagagctagccacatgggaggtctggtgtaataacttgagtcagtttcctggagaactcagaggctggggcttttatggataattaggtgggcaaggagctagggaatgggcactgctgactggttggagatgaaatcatagtagtgtggaaaatggtccttacgtattgagtctgcctcagtgggggccacaggaccactttagtcatgagtcccaggtctggttagagtcagaagatggccagaatgcaaaagtctgaaaacatctccaaagaccaatcttaggttctacaatagtggtgttatctataggagcagttggggaagtcacagatcttacgatgtctggccatatgactccttgtgcagcaagggattatagaaaggcaagctaggttacagtggctggctgccatttagctacacctatattttagcagaattcaggctcttcccataatcccaatcttgtagtctttcattagtcttacaaaggtgattttggtccctgagcaaggaaggggttagttttagggggactgttatcatccttgcttcaaagttaaactgtaaattaaattccactcatggttagcttggcctgcgcccaggaatgagcgaggacagccagcctatgaggcttgtcacaagacggagtaaaccatgctagatttctctcaccgtcatcatctttgcagtggcagcttcataaccagcctggcttccttttccgtttttgaacaggcagataatgataatgttctctgccactttcttaaagctctttcagttcccattacctaaggtgaaatccagttttcctggtatacaaggcccttcttggtacaaaaggattcaggcccacctggccagcagcattttcttctatcttcccatatctcttctctcctttattcctgagcagtgctgacctacgtgttcatcaggtacactacacattgccattcttcccttcacatacctgttcctccctcctcatccacactgttttcttgagagcagtttacttatgtgtaataatagctgtaaagtcattttagggaaaaaaacttttttttccttttcagttcttagtttagacactctactgaaagcaaaactcagattaacaaaagaaaaacaagcagaagcttattaatgtgtgatgtacccatcatgtgagacaggcctcagttcaaaagtgtctctctcaaggcagtggcttagaggctttgcttaaacagtattttaacaaaaagccttaaatcttacatagtgacaagacaggaaagagcagttccagcctagtaaaaggtggagacgtgtggagagatagtaaaatctgttcccagattccgctggtacctgctggtgctttctctgggccaataagcaagtgatgtctccagtaaagaatgttatgtcctgccatcaggcagatagaggcgggagcagagagttcccccacattttcattgtttttaacaatcctcaatattttggggagatgtattttgattgttctgtgccccctttgaaactttcctttcagaaagtttcacatattaaaagctaggtgggtagctctggagagattttgggttagagattttgacataagagtttggcagaggggagaaaatcatagattaaaacaagtggaaaggaacaaatttgggtacattgtcccataccttattgaaacagtcttttagtcctgagaattactctgttcagttgatcagttatatcttatttcaggaggtgatgttgtgggcaggtttttttttttttaaatcaaaatcaactctatgatatagacaaatatatttagcaagaggcatgtctgtgggagcaaaagaaaaacaaaggttaatgtttggggcagtctgttagcttgtttaattctggagcagtcagctgagaagatttttatatttgttttcaaaatatctacagttggagtaaaagtaaactggtgattctgacagatttttctggattgctgtttgcgtcaaaatttcagtgaacttttttccataaataatttgtatgatttctttgaagtttatatcaagttgtgtaactttagcttgcagggcttcagggaaagcacactttaaacttttaatgatttcaagtcagaaaggtaggagaaaaattagaaacattagtctgggagtcatagccagatattggaggaaactaaaaattcaggatttagtccaggtaataaaaaaactcaaaaacagtagacaggtctagaatttaataacagatgtgctatagttttcttctgaaacataagttctctttataattacccccattcttactaaagatatttacagtaattacactaatttaattataaaaaccagttttagccttattatacttggcctgatcatttgcataaagtgcaacaagaatagtgattggccatataggctctttttttttttttaaatctgctttgttggaatttattataagaaacctcagattatacctttaaaagactctacaggccaagaattcaagaccagcctgggcaacatagtaagaccccatctctaaaacaaataaaaatgaaaaattagccaggcatggtagtcacacctataatcccagctattcaggaggctgaggcagaaggattgcttgagctaaggagtttgaagttaacagtgagctgtgattgtgccacagccgttgcactacagcctggatgacagagggagacctgtctccaaaaaacaaaaaagggtcttcagggcaggaagtcaagccacggactttaccagtagtaaatcagtggccagcatagtaatcagattttaccagtagtacttgggtgaattcatttttgcttggagtccccagaatattctgaggttcctgggcctgtcagaaagtgacattctttacttactgcaaggctgggaaccatgtagacatggcaccaggctagttattctaagggcttcaatggccccttaaagttaaccttagtttcttaaagtagtctgaaaatacgacatcccagcctgtatagaattagaatgattcaaataacatttatacctgatgtggttatagagctaaattattcctcctgtccctgaaatcattaggctcttatttctattaggttataaagctcatttttccttcctacgtaggagaacaatatatactttcttttcatgactatcagagaaataacaaattttattaaaatttgaaagattagtctgggtgaggtggctcacacctgtaacctcaccactttaggaggctgagatgggtagattgcttgagccgaggagttcaagaccagtttgggcaacacagtgaaactctatctctataaaaattagcagggcgtggtggtgcacacctagagtcccagctacttgggaggctgatgtgagagaattgcttgagctggggaggtcgcggctgcagtgagccatgatcatgccactgcactccagcctggccaacagcatgagattctgtctttaaaaaaaaaaagatttgaaaagttagattttggcatttgattattagtcaaaccagggaagtggaaagtgaccaaatcccctacagccagctgtcttagatctgctgttacattaacgtgatgtgtcagagtctttgctgtcaggcagtgatgagcttgcctgctttgttctgtgcctcttaaaagtttatgagggattgtggctgttcctatatgcggaaatactgttagctatgtggatcgtggcggtcttggtggggagcaaagagaccaaggatgcactggattccttcttgccagaggaaagtttctgtctcagtcaatgcttgtcaagtttgtagagaccattgtgtttgtatgttacagtttcatacagattttatagatactgtctttactacctgtaataatcacatttaatgtatttttcaggcagattggaacattcatttatgttttgcttagttggcaaaactaaggattacatttggcatttttaactcacaatgtgtatggaaagctgaaagttcagcttaaaggccttgtgatttgaatgacaactatagggaaaataggggtttttgttgttgttgttgttgtttgttgctgctgttgttgttttttaattgagacagagtctctcactgtgttgcccaggctggagtgcagtggcgtgatttcggctcactgcaacccccacctcttgggttcaagtgattctcctgcctttgtctcccgagtaactgggattacaggtacgcaccaccacgccctaattttttatgtttttagtagagatgaggtttcaccatgttgcccaggctggtttcaaacttctggcctcaaagaatccacccacctcagcctcccaaagtgctgggattacagacgtgagcaaccacgcccagcagttttctgcttttttttttttttttttttttttttttactctagcttgttgtggatgatgtatttgcattctcagtctaaaaggtactgggtagtcaaaagggggccaccacatctaaggactggatatatgggatagagcagagaatttaagcagacaggatttaggctaagccgaagtggacctaaattgtaaaagcaatatatgaaggagattgtgaaatcctcttccttagagaaatggaagattaatctagactggcctatttagatacagtttttagagtgagggggtgggactagactagcctttaaaaaaattccaacgcaatgtttattttctttgtcaaatgttaggaagtcaaaatttgaatgttatttattttttaatttttattttactttaagttctgggttacgtgtgcagaatgtgcaggtttgttacataggtatacatgtgccatggtggtttgctgaacctattgacccatcctctaagttccctcccctcgcctcccaccctccaacaggccctggtatgtgttcttcccctccctgtgtccatgtgttctcatcgttcagctccctcttatgagtgagaacatctgatgtttggttttctgttcctgtgttagtttgttaagcatgatggcttccagcttcatccatgtccctgcaaaggacatgatctcattcctttttatggctgcatagtattgcatggtgtatatgtaccacattttctttatccagtctatcattgatgggcatttggcttggttccatgactttgctattgtaaatagtgctgcaataaacaatgtgtgcctatgtctttatagtagaatgattcatattccttcgggtatatacccagtaatggaattgctgggtcaaatggtatttctggttctagctccttgaggaattgccatactgtcttccacaatggctgaactaatttacagaatttgaattttagaataattttaatgtgggctagacatggtgactcacacctgtaatcccagcactttaggaggctgaggcaggtggattgcttgagcccaagagttcaagaccagcctaggcaacatggtgagaccccatctctacaaaaatatcaaaaattagccagcgtagtgccccacacctatagtctcagttactcaggaggctgaagtgggaggatcactggagcccaggaggcggagattgcagtgagttgaaattacagcacttcactccagccaggacgacagagtgagactgtctaaaaaaaaaaaaaaagaatttgatgtatgtttttcaaaactgatatatatttttagtcttccctagaaatggttcagtttacagagttataatttgaaatgattttcacaatctgagtaagagtggatatgtgctccaacctgaattctgtagtaggcagggtttgtgtgtgtgtttcacaaggcacacacatgctttcttctaaaactgacaaaagaaagcagtgggtgtattgcaaagcagatagttaatagaagactaacagatagctttgggaaatggatataacaaatttatgtgcaagactgataagcaacagtcagaaatggatgtaaattcattaatgctccagctaatttattaaagttttgattatattgatgtggcctgattatttcccatcagacacgttacttctctcacaaatgaatccatcaaaatctattcatctgggtgatttgcttggtttgatgcatattcacaactttgtttctcgtaaatggttgtgtcaataaattttctggaaagaattaagtactgttattcatacttatgtctggtcttaatttgctccatagtcttgcatttataagacatattaacagaagtctgatgtaaatgaaataccaacaatgtggcataaaacacaagctacaatttggcataaacctctggaaaacacactggctcatctgaatgtggggaaacattggttaacattcccattttcttttacctaatagtgttctcttgagacacaaccttgattcctctgataataagataaaccagtctgcattggtgacgtgtgtggggatttttccccacacaccaatcaagcagttctctagtgggcaccaactgggtagcctacaatttcactcatttctgacactatgtatctggagttactgtcagatccttgccaactgaagaatcacaaggttcataaattttgaaaggagagctttatttcagataaagagttgcaacctgcaaggtggccattctacgggctgggaagtgtagcctctggcagaagctgaaaataagcagttcaagggaggggtaaagggaatagtaatttacgctgagtagagtagctaagtatatatattcagtaacctataggaagagtcatgaatatttatgaaaggagaaataagcacatgcacaatcaagcttcacgcctttttgtgggacccgtgttcaaaatatggcagcattagcacaatccaaatgggctgttttcagccctctgatgtcaaaaggtgaagcagatgacacgaaaaccctcactgcatgtcctctgccattcggcaaaacagttgtggaggtggtgtttagtgtttaggaaaggatgtgttgtgaaactggtgagctgtcacattgaaacagcagaggaggagcaagagtctggtcacaacctcagacagttggctaaaggcaatgaaagaatgagccatatgttttttgttttccagagctgttttctgtttactccttaggaaagaattctggttaaaggttaataagggaggggcctactgaggcatgtcagacctgccatcctgtcatggctgggaactcaatttttaagatggggtctgttaccaaactgaacctgggtccacttacctggtgcagtaaagccaaacacccacattgaggtttgcagtgagagaacggagggcatttatttgcagggcaccaagcaaggagaattggcagttcatgcttaagaccagacatccctgatggcttacaggaagagtttttaaaggcaggggaacatttcaggaaagcagaaattacaggccaaattgcaaatcactacatggaggttttatacattgatttggcttaaaaaggtgggatatcttgaagtgggggtcctatatggcataggtggattcagagattctttgatttgcagttggttaaggaagcaaggctttgcctgagaacttggggtcagcagaaggaatattaaggtttggcttgtgggcgtgactctcttcagaccctttaggaagcaatctagagcaaacaacagcagacagagctcagtcctcaggggcccccttatctgagttctgcatgacagtggttggcattttccatctggttgtggtgcaggtttcagaaaaacaactcagggacatatgttaagatgttatctttaatttctacagggaatcaaacatcttgtggctctaacctacttgggtggctattgttgtaagctgtttctttgttatcaggttgctcatttacttctaaagactagctagatgcctggaatttccctcgaagagattcaagatttttccttattttcatgcttgaaggagggaaaggtgtgtggcaggctgctaagagaggcccctgctccatctcagtttcattaagttggttggggagcttaggattttccttttatttctcttcccacaggcttagtcccacaaaactagcccctacttcaggtgccgagcataagccccaggctgtaacctgtgcttctgaccaactaggactttaaatcaggatacccttgaccctcctccgcaggttccattaatttgctagagcagctcacacaattcagggaacaccttacttacatttactggtttataataaaggatattacaaaggatataggggaacagccacatagaagaaatgaatagggagaggtttgtgggaagggccagggagcttccatgctctctcagtgcacactgccctccaggaccctccacatgttcagtgatccagaaactccctgaacttagtccttggggtttttatggaggctttattatgtagacgtgattgattacatcgttggccattggtgatcaagtcaatcttcagccactcttccctctccagaggtgtcagggctggggtgggactgaaagttccagctctctaatcacatggttggccctcctgacaaccaaccagcccttatcctgaggctggccaggagcctccagccctcagtcatctcactagtatgtaagaagataacactttggaaagcttaaggattttaggagctgtgtgcttattatatcacaatattatattcccacatagagaactgccgtgtccctagatttatcatgggctgcttctaatttctccatgtaggactttccgataggatttattcctaattatctctgactttatagccctagtccctgtagttttcagccctctattcttcgtttttgtgggcgaaagattacctaggtgccgaggcaagagactgaaggcacaaactgtttcagtataataaagaaaatagttaaaataagaatagttataatacaaattagatatagagatgatcatggacaattatcaatcattattataaacattaatcattagcttttaatattactctttgttgctttactaatataacctaggaataaccggtgggtatagggtcaggtgttgacgggatattgtgagaagtgacctagaaggcaagaggtgagccttctgtcacgcccacataagggccgcttgagggctctttggtcaagtggtaacgccagtgtctgtgaaggcacctgttacttagcagaccgcgaaagggagtctcctttccttggaggagtcagggaacactctgctccaccagcttcttgtggaaggctggatattatctaggcctgcccgcagtcatctggaggcctaaacccctccctgtggtgctgtgcttcagtggtcactctccttgtccactttcatgttcctcccgtactcctggttcctctttgaagttcgtagtagatagcagtagaagaaatagtgaaagtcttaaagtatttgatctttcttataagtgcatagaagaaaacgctgacatatgctgccttctctatctctgcggtggctacctaaaagggaagggccccctgtcccatgatcatgtgacttgcttcaccttatcacttagaagattcatcctccttaccctgcgccccctcgtcttgtatgcaataaatatcagcacgcccagtcgtttgaggccactgctggtctccgcgtcttggtggtagtggttccccgggcccagctattgtctctttatctctttgtcttgtgtctttatttattacaatctcttgtctctgcacacagggagaacacctgctaagccccgtaggactggaccctacacgttttcctctgtttgaaggcagtccaatgtactgtctacattcatttcagttcagttcaatatatatttacatcagattactgagcactatttattatgtcttaatgatgggtaaacaattatgaatgcaataccatggactttacaatgtggttggggacacacatacttaaacatgattttcaagttgtgggtgagaactaaggtggtggtatacatagggaatggccagtcactgaacaaacttctgtattaaaggcagttataagatacaaaaaaaaaaaagaacactctttctttggaatttatagccaatttgaggagatactgaattagcccatcagcaagtattgaaagttccaagcagcagaatttttttagtttatcgtttacccacctctggtatcacaaagctcttaaattagggaaaatgccctgtgtctaaatacagtctctttttctttgacccaagcttcttattagtaaaagtagaagcactacttaccatcacttatgaataatcacaaaatccaaattgttctttctggagtccagagagtcccaccctgtggctattgatgtactgtacatggttacaagtgtgcctgcagactgtctcagctcttgggacaaccagagtcccttgtgagcaatcttacttcactacagtggaccaaacaaatatcttattttctgtgtgccacaatatgagaaaacctggaaactacttctttagaccatgtgctttaacctttcttcagaactgggctagttttccaagcaatcattgttgtatcttattaaccgtattccagttatttatataataatgagctttagttgaggaattccgaagagaagataggactctcagaaggaactaagttcttttgaagctagagagaggatgattcttaggtctccaatgaacagttgatttcctaagcagctactttcggccatcagtagttgagtgcttgagtggccagtatgatgcagttaatactctacttccaaaacttttgtgtaggcattgtgaatagcgggctatgtgagtagctggtgtactaggcaaatgaacccataaatattgtgtattttagtattactcctttatttattataacaataaccaaaaaaattagtcctcactatgtgcaagacattggttagcttcaaaaatttactactgagaagatacctggtacctacccctcacagaatttatagtgttttagagaagatagataattaaagaagtcattgcaatgtgatatgattggtgctatgaagaatataaagaagaaacacttactgagattggaagatggttatatatagttacttagagatcaaagtattaggactaaattgggtggctcttgtttcttttagaataaaacacaacttttggtatgatttagaagagtttcaactgaatgttacttccttaattattcaacataacctgagtaatattacaacttacaatgcctcttatgtaatgtacagtttgctcaagtaacctaaataacattgagactttcaattcatatttttatctgaccagcaggtagtcctagttttaatgtaatgtgctttttactggtagcttttaattatagatgtgattaaataatgctacaattgagtgttctctttatcttttatgtttttagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcaggtgagacgaacaatgtaaaagagacaagagtaaactcttcttaacattctccatttgacagatgatcaaagacaaggggaaaaaatatataatttcttttttaaaccttataaattcttagttgagacatactcctgaaaacaaaagtcagattaacaaaagaaaaacagaggtttattgatatgtgctatacccatcatgtaggagagacctcagttcaaaagtatctttctcaaggcagtggcttaggggctttgcttaaactgtattttaacaaagagccttaaatcttacatagtgacaagacaggagagagcagttccagcctagtaaaaggtggaaacatgtatgggaagatagtcagctgtgttcccagattcctcccgtgcctgctggtgccttctccgggccaataagcaagtgctatctccagtaaagaatgtatgtcctgctatcaggcagatagaggcgggagcagaggattcccctgcattttcattgtctttaacttaacaatcctcaatatttgggggaaacatattttggttttgttcagtgccccctttgaaactttacttttagaaagtttcacatattaaacgccgggtgggtaactgtggagagatttgggttagtggttttgacgtaatagattggcagaggggagaaaatcatagattggaacaagtggaaaggaacaaattcgggtacattgtcccttattgaaacaatctcttggttgtgaaaatgggtcagtttagttaaatagttgcatctcattttaggaggtggtggtgttgtaagtgtgtttccgacaaaggtataggcacataggcatttaataaaagacatttctatagaaacaaaaaggaaacaaaagttaatgtttggagcagtctctaagcttgtctctcagtctggaggggagccagctgagaatatttcaagatttgtgtttaaagtatctatagttggggtggaagtaggaaatggcaatcggacagattttcctggattgccgtttgaatgaggtgttccagtgaactttctgtccataaataagttgtggtgattcctccaaagttaatatcaagttgtctagctttagtgtgcagagcttcaggaaaagcagttttaatttcagtgattccaagtcagaaaaatgggagaaaatgttcaaatactagtttggagagttggtcagatattggaggaaactaaaaattcagatttagtcaaattgcaagtaaataataaaatctcaaaaaccgtgagttagaatctcataatgtttactgtagtttttttttctgaaatagttttttctccagttcccccatttttaccaaaaataatcagagtaagttcaattgacttgtaaaataagtttagtgtcatatttggcctgattatttatataagtactgcaagagtagtgattggccatttaggctttttaaaaatctcctctgctgaaacttacaagaaatctcagagtagacctttaaaagtctctcgtcttcaggctgggaaacgaagccatgggcttgccatcatcagattttacctgtagtacctgggtatactcttttcttgaggcccccaaatattctgaagttcctgggcttctcaggaagtgacattctttacttactgccaggctaggaaccctgtaagcacaccatcttgacaaggtaccaggccagtttttccaaggcctttattgcctccttaaagttaagcttagtttcttaaaggagtctggttatatctaaaaataatgacatcccagtcaaagccttggtaatataacccatgtttccaatttttctgctacaaacagagcaaattcttactgaactcatgaaaataactatattgccatagaatatgaatattcagtttctgaatttgggaaggatcaggtatagaaaaaagtaaatgttttaattttgccacaaaaatatactttaccaaattattgtaatgctatgaatagccaccgccccccaccaccaccccagaaaaaaaatgttttcttaactctggaaagcaacgtataaaaagtatcagcagtgtttcaaacaagtcataaaaaattttttcagtccagtgtaattattcttatttttcttaatgtcaggttagcaattttatgaggccaggtttgtttgctttttccattggggtttgggaaatttttacccaatccagtgataatatggtgtcacagttgtcagaaacctgtattcaagagtatttgttgcactctttttcttttttcttttttttcccttctattcttttatttttatttttttaatttttttattatactttaagttctagtatacatgtgcacaacgtgcaggtttgttacatatgtatacatgtgccatgttggtgtgctgcacccatcaactcgtcatttacattaggtatatctcctaatgctatccctccccactccccccaccccacaacagaccccggtgtgtgatgttccccttcctgtgtccaagtgttctcattattcgattcccacctatgaataagaacatgcggtgtttggttttttgtccttgcgatagtttgctgagaatgatggtttccagcttcatccatgtccctacaaaggacatgaactcatcctttattatggctgcattgtattccatggtgtatatgtgccacattttcttaatccagtctatcattgttggacatttgggttggttccaagtctttgctattgtgaatagtgttgcactctttttcatgacctccttgaagatgcaacactttagaatttgcaaggagatttcagaaaaaaagcgtcaaaataaagtaactgtggacaaaatgacttaaaatggctgtgattaaaggcatagttgtcaaggatatttcgttattttctgtggcctacaacagtttaacataataacccaaaatatgactgataacatataccaagacataaccagatttctaggaatctcatagaattttggaacacatattaataacactatatacaaattcaactcaaagaaacatgatttcttatgtcacagtgtttcccatataatttagcacatcagataagctggtgtattctctcttttttgtatgcttcagggaccctctgcaacatcccaatattaggttgaggttaaaaagactcaattttagaatctgaactttgattttgagaagcctgtcaaacatgtcaaaggtttaaaagattggatcagaataggatcacagttcactgtgaaataatggtaattcgtaagtcaaagtcataattaaaagggagactcacatatgaagttacctgtgtaagtttatacctactaagtggtagcccctgagattgaacccacatagtctgactctgtagtgcatgctcttaattgctgggataaactgcctttccatttattttagtaaagtcagctttatagaaattgttatcgatcaagcatgataggaattctaaccaactcaataagcatagaaaaaggaacatagtaaaaatattgaaaggagaccaaactcttgtttgcagacacagatgattagtcttgttgtgccataaaacttaatagactaaatagcagttgagtaagtttagcacattcattgccttcattctcttcccttattttctcttgtttctaaatgaaaatgtacagacacacacgttattttctataacagattagtatgtttcccatttaacatttatttttcagctgtcatgtatcgcttttcctttgctgtcaacactcctgaaacagttgcctgtattttctgcatctgcctcctgaattgcccacacatacttttaaaaatgtttaattatgaaatatttcaaatttacagaaatgtgctgaatatcaattatgtatatacccaccaaccaaattttatagttaacattttgccgtactggccttagttctttgttatcttattgtttttgtttgtttatattaaaagtagagcacccattatctgtcttattcccccctctcccctgaggtctccaccatcctaaactggtgtttatccttctgatctatgttttgaattttttctatatgtgtatgtatctataaaatacatgctagttttatatgtttttaaaatttctattaatatcatacagtagatattttattataagttgccttttttttttttttaccaatttttttgtttttgtttttgttttttttgtttttgttctttttttagacagagtctctctctgtcacccaggctggagtgcagtggcatgatctcggctcactgcaacctccacctcccagattcaagtgattctcctacctcagcctcccaagttgctgaaattataggtgcacaccaccgtgctaatttttgtatttttagtagagatggggtttcaccatgttgcccaggctggtcttgaactgctgacctcaagagatccgcccaccttggcctcccaaagttctgggattactggcgtgagccagtgcacccggccacttttactaaatttttaaaacatttttatacatgtagatctacttcattcatttaatgatcttacggtaatctatcaaatgaatgtgccaatttgtttatttccctgttggtaaacatttagattgtttccaatcttttgctgttataaacagtgttacagtgtacatccttgtatatatcttcttgtgtgcccatatgagggttctctgaataatatacttgcaaatggaattgtttagacaaccaagtagtgtagttctactgattgccaagttgatttccagattgtttctattctcatcagcagtgtctgatatttgctgtttttcacatccttgctgatacctagtatttttagtcttcttaatttttgccatggtgggtattagtgattactcatgacattaaacatctttccatatgtttgatgaccattggaattttcttttctctgaattatttattcatgtcatttgcccattttttctgttgagtttctgtgtttctcttattgagttcaagaagttttttctgatttcccagtctctaatcctttgctaattttatgtgttggaggtactttcttccaatttattatggcacatcatttaacttggcttttagtgacttctgttttagtttaccattctttaaggcttaagtgtgtgtgtgtgtgtgtgtgtgtgtgtgtgtgtgtgtgtgtcttatttcctttcctattttaatggaataaaggacattctcttttatatataaattttatagttcagcttcttacatttaggcttttaatccatctggagttaatttttgcaagctgatcaaaagaaggatttttatcttccacatgatggccagtggtccatgtggcattttattatccattcctcactgatttttaatgccatactgccatatactaaactcccaaatatacatgactctgtgggttccattctcttcctttggttgtctttccctatatccataccacatattttaattaatacagcttttcaatagatttattatttggaaaaagaatcctccctccttattctttttctttaaaatgctttggctatttttagtgtcctacatctcctagtattccacatgaatttggagatcacattctcaagtttctttaaaagatacaaactctctggaattttgatttatgaatacattgaatttatagactaattcagagagaactgacatctctgtagtgttgattcttctctttcaggaaaatgtatgccttttaaactgccttttctgctctttggtgaggttttatagcttttatataaggttcctgcacatattaaatttgttcatagttactttatagtttttgttaatattgtacaaggagatttctcaagatgacctttctatattgattgctgctgctgttttaaaatgttactgatttttgtacattgttttctatggagcaaccaggaagaattctcttaaaattcaatttctagatttttatgacaataagaagaatggcagttttattttaattccaatcttgtagttttttctttcttattggatgtctaggatctctaaggtattggcgaatagaagcagtgacagtatgacttctaaccttgttcctgatttaaaagggaacatatctaatattttacattaaatatggtatttatcataggattttggtagataatttttattaagaaaatgttatcccccgtttgaataagagtgttttgtttttgtcatgattcggtgctgtattttgccaaatgcttttcctgcatttattgagactatcatgtttttttcctttgttctgttaaactgttaatgtgttatttgttctaataaacattttttctaacctgttaatcttttcaaaaaagctacagtggagtttgtgaaatctctctttgctgtcatttctgtacttttttccttttttctccctagcctaactgatacttctttttttactaattagagattttgtttattaatttttattaatatttcacaagttgatttgtaatgttttcattgtcattttcaattttttaataattatacttgatcaagttctagtttgtattgttagtatgtatgtatataagttagcttttctccagtgtgtatacctaattcaggtgtgtaacatttttttaaaataaataaatgaaaaaaatgagtgaatttggtccagttagaactcccaaatgatctactatatgactagaaagtcagctatttgcatattgtactgtaaaatatcatactaataaggtataaattcattatttatcatatgagttttttcatcctcaatgggatcttcccactccacaaataagattggtgaataaaaatatttatcttttttatttcctagattactcagaagtatcaacttcatgaagtcaccgcttatctattggaaaagaaaggagatattcatggtgccttcctaataatgttagaggtaacactttactatgtttctttcatcatatttctgtctattcctctattcattcatgaatccatcttaattatgtttcaaagccagttgcagaccgtaatatattttacccctgaatatttttatcatgcatagcattaactagagtttaatatttctttgtggtacttttttaaaaggtaaaatgtacaacagtaaaaaaaagtcataaatgtactatttgatgagtttttgacaagtatttttatatatataccacaatctgtttgcccattcctccttcaggggacacctgggctgctttaccttttggttgttgtgaacagtgctgctgtgaacatgggtgtacaaacgcctttgagttcttgcttttatttctttgggatatatacccagaagtagaattgttggatcaaatagcaattctatttttaattttttgaggaattgccctactgttttccatagcagctatgccactttacatcgctaccagcaacactcaggggttccagtttctccgcattcttgctaacactttctgttttcttgatagtagccatcctgatgggtgaagtgacgtagcagttttgttttgttgtgttttttaatattgtcgtgtggctaggaatagattagggatatcatatttatattttaaaatgttccatattggcttctcgtttctttctagccatatgattctaaaataagccaggaagaatcatccacagaggctttgtgtaggctcttaatctcttttaatctgtaaattactcctatacctctttctttttcttgcaatttatttgttgacaataccatgaacctagtattaaggaataaataagagtatttctgacattgatgagaggagaaacaggagatctctgtggggcatgaggccatcattcataaaggtttaggaatacaaagcaaagaagtatggatgaccaagagagtgccagcagcttcactagggctccgctgtgtaatatataggcaggtcaggcgagaaacaacggctaggtccagatttggacagattttgttggacacgctaaagaattgtagctagtcttcttgtcacacaggatcaaataaaggtttttaagcaagaaacggatttgatgtttgtttcataaagactacgctggtgactgttgggggatggaaggcaggatacagagaagagggaggtaaaacaaagcagacaatacttgggaggccattgcaatggtacaggtatgagtctatgagagcttgaactgggtgtgtcagtggcaatggagagaagagggatagatttgagaagttattgatcatttgcatatggtatgaggtaactgagaggaagtagttgatgattttagcttataagctttttactcataacccagtatattacaccccttttactcacaacccagtatattagtctcttctgtgttgctctagaggaatacttgaggctgggtaatttttaaggaaaagaagtttatttggctcacagttctgcaggctgtgttagcatctagcatctgcttctggtgaggacctcaggaagccagggtaaaggagagctgacgtgtcacatggcatgagagggagcaagagtggggttgggggaggagtgccatgctcttttaaacatccagctctcatgtaaactgatagagggagacgtcactcattaccacagaggggcgcaccaagccattcgtgacagatccactcccatgacccagacacctttcactgagtcccaccttccaatattgggaatcacatttcaacatgagatttggaggaatcaaatatccaaactatatcacccaatatgaattggattcccttatccaaagtgactgtggtgggatgacagaagcagaggtgggcaaaatgagtgctacttgatctttgggtcccttttcatactgctagctgtactttctataaacagaagagtttacttctgactgacactaaaggactgttcttaataaccttgtagttttgaggggtttacctttaaaatatgttaattcaagtattgggtgggtagaactataaagtgttcctttttaactcctatgttctttttatctcctagagactacaaagcaaacttcaagaggtaacacatcaaggtgaaagtaagttcttgaaaataattacaacatttttcatccttggaccccatgttttaaaagatgtttaataaattgcatttattatgtaataattacacttgcatatatgcataattactgtttattcattttaacatggatccaaattttagctaattttcaagagttcacaacaggaaatcatagaaaccattgtggctttgtgatgttaattttcggtggagttaaatatacagaaaattatgcactgtttgttggttatctttttttttttttgacaggctttcgctctgttgcccaggatggagtgcagtggcacaatcttggctcactgcaacctccatcttccaggcttaagcagtccttctgcctcaccctcccaagtagctgggactacaggcgtatgccatcacattggctaatttctgtattttttgtagagatggggtttcacctgtcacccaggctggtctcgaactcttggctgaagtgatctgcacacctcagcctccaaaggtggtgagattgtagacataagccaccacgctaggctggttatctttttgtttatacttttgctataacaaaagtatggtttagttatgtttaaatgaggtatataactaacatcctaaaaattaatgtgccaaacaacagcaaatcagagcttctaattagtaggacattgaacatagccaatgtttccaaaccgaatttatacagttttaacccaaagcagtaaaagttgacaatttagtatcttgagtggttttgtcctcagcaaatacaaaattttcatcatattccttgatatttcaaaaaaaattattttaataaattgtggtggccaggcatggtggctcacacctgtaatcccagcactttaggaggccgaggcaggtggatcacctgaggtcaggagttcgagatcagcctggccaacatagtgaaccccgtctctactaaaaatacaaaaattagtcgggtgtggtggcacacacctgtagtcccagctacttgggaggctgaggcaggacaattgcttgaacctgggaggcggaggttgcaatgagcggagattgcaccactgcggtccagcctgggtgtcgcaacagagcaaaactccatctcaaaaaaaaaaaaaaaattaaattatgggtaaaatataccctaacataaaatttaccattttaactatttttgagtatacagttcagtagcattaagtatattcacgtaattatataatcattacccccatccacctccaaattttttaatctcccaaactgaaaatctgtacctataaagcaacagctcccctattcccctctcctcccagcccctggcaaataccgtcttactttcttttttcaccattctttttctgaatttgattactcaagtatctcatatgaatgaaattatatagtgtttgtcgttttgtgacttgcttatttaacttaccataaggttcataaatgttgtagcatgtgtcagaattttcttcctttttaaggctgaataaatgccattgtatgtatagaccacatttcatttattcattcatccttcaatggacacttgggccacttccactttttgtctattatgactaatgcctctatgagcatgaatgtacagtgtctcttcaagagctggctctcaattcttttgggtatataaccacaagtgggattgctggatcaagcattaattctgttaattttttgaggaatggccatactgttttccctagttgctgcttcattttacattcccaccaacagtacacaagggttccaatttctccacatcctttccgacatttatattctcttttttttaatagtagctatccatatgtgtgtgaggtagtatctaattatggatttgatttgcatttctctaatgattagtgatgattttcctgagtattttggctatttatctaccttatttggagaaatgtctattcaagtcctttacccattttttaattgggttgtttgttttcatattccttgacatttttaaaacagccctcctgaagatcagggaatcacttggtgggtgatttttagattatcctctttaacacacgtttcttagagactccttggtccacgcatttcactaacataccatttccctaattctctgtagattacttacctatatttttgtattaaggtcctagatgatagggtctatgttgttttatgatcatcaggtattacagtaaatctttttggaacatcagtgaacatttgattgactttgttatattgatagttcaactggacacttaattaccatttttgtactatcagtatgtgtttagtcaatttggttatgtttgttacattttgtggcaattttaaaattttagtgttataagaataactttttgtttttttctggggggacggcgtctcgctctgttgcccaggctggagtgcagtggcgcaatcttggctcactgcaacctctgcctcccaggtgcaagcgattctcctgcctcagcctcccgagtagctgggattataggtgcgtgccaccacacccggctaatttttgtatttttagtagagacggggttttgccgttttggtcagactggtcttgaactcctgacctcatgatctgcctgcctcggcctcccaaagtgctgggattacaggtatgagccactgtacccagccccacccccccccctttttttttttttttttttttgagatagtcttgctctgttgcccaggctggaatgcagtggcgtgatctcagctcattacaacctccgcctcccgggttcaagcgatcctcctgcctcagctccttgggtagctgggactataggcatgtgccaccactcccagctaatctttgtatttttagttgagatggggtttcaccatgttggccaggctggtctcgaactcctgacctcaggtgatccacccgcctcggcctcccaaagtgttgggattaccatcgtgagccaccacacccagccaaaaataacttttcaagacaatacatgaaagacagaaaaaaattaagaagagcattcccccaaaatcactacaatcatttgcaggtggtatgtttgcaaaggccagtgttttgaattccagtgaaaataaattttccagaaatagtctcatgcctgccatctactttcttacttttttttttttttttttttttttttgagacggagtctcactccgttgcccaggctggagtgcagtggcgctgtctcagctcactgcaacctctgcctcccaggttcaagtaattcttcctgcctcagcctcccgagtggctggtgttacaggcaccagccaccacacccagctaatttttgtatttttagtagagttggggttccaccatcttggccaggctggtctcaaactcctgacctcagggtgatccacccacttcggcctcccaaagtgctgggattacaggcatgagccaccacgaccggccccatctactttcctattcaattttgatagtgtgcttaagtatttgggaggatttgctaattgtgctttgttcctatgggctatacacagactactaaaacacagattcccctacccactgcacaaagaacgttagtctcctgaaggagacagataagtaaataaaaccttgtagtaccagtagaatggtgtgtcataaaaggtacactgagagtgactaaggtgtgtggaaaattacagaactatttgtaacccataaaccagtgagttttgtggaaaacctttgaagaaagacttgaaggataaataggagtttgatagaagcaggagaagaaccttttaggctgaggaaaacatgaacatggaagtgcctgactagtaatcagcgagtaaaaaagaatagggcaacaccagagcttggagggtgagatgagcccaagtctttgctctgtttacttagtgtcagatccttacttacattctatttttcagaattaggagtccttggtggtttttatggaagggactgatctgtttgaacttgtgcttaagagaaccctagtgacagtatataagaggatgagggaggcaagattgggatgccaaaagttcaactaagagactattgcagtagcatagacgaggtgatgaaaagctccaccagggtaaaagttgtggtcatatgcaagcacagaagtagaatcaacaaatattcgcaagttatctgaatgtgtggggtgaaggagagggaagcaccaaagatgaagatttataaactggttgacttaaagattatgattccattaacttggtttgtaaatggaggaggaggagcagatttgaaatgagaaaaataagttgggttttgcacatataaagttgaaagtgcttgcaggacatccatgtggaaataaatgtcttaggttcattagaaaattcaacctgtagattttgaatggaataaagattggagatgtgtgtttgaaagttatgaacaaagatatgagagttgaaacaagaatggctgaaatcattgagaaaatgaagagagacctaaaatagcatcttgggggaaatatctacatttaagaaataggcagaagaagagatagtataccaagaaaggtgaatgataatctctctagtaactaatccttagacagatgattggggattttccatatttccatagcatattgaaatgctaagtgtgatgtgctttatctgtcctacgaatgtaaaacatttctgtgggaaactcttatttcacggaataatctgttttttaatctataaaacattagcatcaggttttattaattattatatactagaaaatgaaggtgatgcaaagaaaaagaagtttaacttttcacagaggctctgagattatcagcaacatatccttaaatgatgtttacactttttctaaatctagataccaaagaggatccctcattgaaggatgttgaagatactatggtggagaccattgctctttgccagagaaattcacataatttgaaccagcagcaacgtgaggtaggagaatgactgtttaggtatttaaaagcctgtacttggccagacatggtggcccacgtctgtaatcccagcactttgggaggccgagacggacagatcacctgaggtcaggagtttgagaccagcctgaccaacatggagaaatcccatctttactaaaaatacaaaaaattagccgggcgtggtggcacatgcctgtaatcccagctactcagaaggctgaggtaggagaatcgcttgaacccaggaggcggaggttgcgttgagctgagatcgcaccattgcactccagccctgggcaacaagagtgaaactccatctcaaaaaaaaaaaaaagcctgtacttgtctgaaactaggaatcagttctgtttccactgccctctcagccacccgggtttaattcaagtggattttaatcacttcttagtgttcccaggagtaggagactcccgaagttactataaagagtgtgtggcttctttgttctcaccaaaggctttatattcatggtttggctgtgctgcaaaacttaaggtgcatgaatgctagatgtgcctgttctctttggactgagattttgtgtatgccatgtagttgcaccagagataggtcatcatttatcatcgtctctattccctgtggtgaaagtaggcatgaagaactggaggaaagccctcaagggctacagagaaagctgaagaaaggttaaagaagcctatggtgtactaattctcaaccttggttgcacactagagtcacctggggagctttgaacaattccagtactcaggctgcaccccagatcaattaaattaaagtctctggggatgaaacccagccaccaccatgttttaaagctcccttcatgattccaatgtgcagccaaggttggaaccactgctatcacagatcccagatggcacaaaagaagaaaacaaaactgaaggaggtatcgttgagcagcaggtgcaaggtgggagttacagcagtgaagcagaaactaagggggcgagatgtgatttgatagttaaattctgcaatagttttaagaagtaaagttgtatcatgatatggcttaactcttcgcctgcccttccagggctcaggcctctgacttgacactggcctctttctaatgcctgggtttttgaaatggggaacaggttaattatatatctatatttagccatacatgttacaatgaaaacaataaatcatggcatattttctgttcttctgagatgagtaaatttctcctttaagtttttgtccagaatttttcaaggtcataaattatgaaacgtctttagaatgtaaattgtgtataacaagcctagttacataaatgtgattgcttttctttattaaaagaaactgtctgtgaaatgatacatactcatcatttttaaaaatcatgaaatatagaaagttatgcagaagaatgggtttttttaaattaaaatatattcatcctgtcactcagaaataaccatcattatcatttggtgaacataactttagatattttttgtctgcctaggttgatataattttagtaaaattgcattaaataatgcttgcttttaaaaatatagtactcaaaaaatgtatgtatattactcagcttcccataggaaacttaagtaaaactaaagaatgttcttaattgatgcataataattatacatattcgtggggttaatgtgatattttgatacatgcatacaatgtgtaatgatcaaatcggttacttaggatatctgtcacctcaaacatttatcatttctttgtgttgggaatattttgagtcttctagcggttttgaaatatgcaataaattattgtttactataatcaccctactgttttgttgaacattagaacttattaaaattctatctaattgtatgcttgtacccattgacaaatctctcctcatacccccacccatccttaccagtttctggtaaccattctactctattcctccatgaggtcaacttttttagctccccacatgtaattcagaacatgcgatatttgtctttctgtgcatggcttatttcacataacattatgacctccccttccatccttgttgctgcaagtgtcaggatttcatccttttttatggccaaataccattctattgtatatatttactacattttctttatccatgcatctgttgattgacacttaggttgattccatattttggctattgtgaataagtgccacagtaaacaggggtgcaagtgtccctttgatatactgattacaatatatttcctttagataaatacccagtagtaggattgctgaattatattgtagttctgtttttagtttcttcaggaacccccatactgttttccaaaatggctgtactaatttacatgctcaccaaccatgtacaaggctttccttttctccacatcctcagcaagactcatctctgatcttttctatcatagctgttctaagaagtgtgatgtaatggctcatgatgactttgatttacactttcttgatggttaccgacgttggaagatttttttcatgagcctgttggccatttgtatggctgacatcttcttttgagaaatgtctattcatatgctttgcccactttttaattggattatttagttcttttttgctattgagttgagttcattatatattctaaatattagtcccttgtcagatgactagtttgcaaatattatctctcattgtacatgttgtctcttcactctttggatcatttccttgctgtgcagaagctttatagtttaacataatgctacttgtctatttttttgttttcgttacctgtgattttgaagtgttagctgtaaaatttttgtctagaccaatgtcctgaagtatttcccgtatattttcttccagtagttgtatgcatgtgggctttacatttaagtctttaatctatgctgagttagttttgtatattgtgagatataagagtctagtttcattctttgccatatggatatccagtttacccaacaccatttactgaagagggtgtcttttccctaatgtatattattgactcctttgtgaaaaatcagtcagctacaaatatgtggatttatttctgggttctctgttctatttcgttggtctatgtgtctgttttcataccagtactgtgctgttttggttattacagctttgtaatatattttgacatcaggtagtatgatgcctatagatgtatcctttttgttcaggattgcttttgccattcgggattttttgtagttccatatgaattttaagattgtgttttctatttctgtgaaaaatgttactggtattttgatagggattgcattgaatctacacattgctttgggtagtattgtcattttaatattcttctgatccatgagcatgggatgtctttttatttgtgtatattcagtttctttcatcagagttttgtagttttccatataaaggtctttcacctccttggttaaatgtattcctaggtattttgttttattgtttgtagctcttgtaaatgagattgctttcttgacttctttttcagatagtttgttattggtatgtagaaatgctactgattgttgaatgttgatttttgaatccagcaacttcactgaattcgtttatcagttctaacagtttcttggtggagtctttaggttttcatatctatgagataatgtcattttcaaataaggacagtttgatttccttttttccaatttggatgccttttatttcttcctcttgccttattgctctagctaggatttccagtactatgttgaataacagtggtaaaagtgggcatcattgtcttcttcaagttcatagaaaaaaggctttcagctttttcccttttggtatgatgttagctgtgggttttgttatatatggcctttattatgttaaggtgtgttctttctctgcctaatttattgagatttgtatcatgaagagatgttgaattttgtcaaatgctttttctgaattgattgagatgatcatgtggtttttgttcttcattctgttgatgtgatgtatcacatttatttattgacatgttgaatccttgcatttctaggataagtcacacttaatcatggcgtattacagtcaacccttgaacaacacaaggcatggggtgccaacccccttgcagttgaaaatttgcatatgcctttgtcctccttcctcattccccctcttgtattcatccatatctattgttcccatcattacgtccatgtatacccaatgtttagctcccattgtaattatgtgtatatgtttataattattatacatttccatttttatgatatgtatgatgccatgccaataatgaaattcccatggactcatacttgcttcctactctcctcttcacatacctactaattttaattaatcacagtgttttacctaatgaaggtttataacacattcttttctgtgtctataatttccatagttgtttaacttttatttaggtagatcataccagtctttttgttacaatttttttattcctagatttttatttttattcatcttttgattggcagcctgtatttggacttttttttttgttttttcatttaacttgctctttcttccccccaacttttattttagaatcagacagtacatgactttttgttgtgtctctgccaggttttggtatcagaataatgctggcctttgttacctagatatattgcatggtggtgaggtttggagtatgaatgaataatctgtctcccaggtggtaagcatagtacccgataggtagtttttattcaactcttatccccctccttccttcttatattccccagtgtctattgttctcatttttatgaccatatgcccaatgattagctctcacttataaatgagaacacgtggtatttggttttcagtttctgcgttagtttgcttaggataatggcctccagctccatttatgttgctgcaaaggacatgatttcattctttttatggctgcatagtattccatggtgtatatgtaacacattttctttatccagtccactgttgatgggcactttcttgagtccatgtctttgctattgtgatagtgctgcagtcaacatatggtacatgtatctttttgatagaatgatttcttttcctttgggtatattccaaatggtgggattgctgggtcaaatggtagttcaactctcggttcttttgagaaatctccaaactgctttccacagtagttgaactaatttacattcctaccaatagtatatgtaagtgttccctttcctccgcagcgttgtgaatgtccgctattttttgactttttaacaaaagccattgtcactggtgtgagatggtatcttattgatttgcatttctctgatgattagtgatgcgtagcattttttttcatatgtttattggccacttgcgtgtcttcttttaagaagtgtctgttaatgtcctttacccactttgtaatggagttatttgttttttgcttgttgatgtaagttccttatagattctagatattagacatttgtcagatgcatagtttgtgaatattttctctcattctctaggttgtgtgtttactccattgatagtttctcttgctgtgcagaagctctttagtttaattaggtctcatttttcagttgtttttgttgcagtttcttttgaggacttagccataaattctttaccagggctgatattaagaataatatttcctaggtattcttctaagagttttatactctgaggtcttacatttaagtctaatccatcttaagttgatctttgtatatggtgatacatagttccctagtttcattcttctgcatatggatacccagctatcctagcaccctttcttgaatagggagtctttttctcattgcttatctttttttttttttttttgtcaactttttcaaagctcagatggttgtgggtgtgggtcagcttttggatatgttgctggatttggtttgctagtattttgttgaggacctttgcatgtatgttcatcaggaatattagcctgatgttttcttttttcttttttttttttttttattgtgtctctgccaggttttggtatcacagtgatgctggcctcatagaataagtcagggaggagtctctcctccgtaatttttttggaagagtttcagtagaattggtgccaggttttttttatatgcctggtagaatttggctgtgaatccatctggtcctggcctttttctcattggtaggctttttattactgcttcaatttcagaacttgttatattgatctgttcagggtttcagtttctttctggttccatcttggaaggttgtatgtttccaggaatttattcatttcttctaggttttctagtttgtgtgcatagaggtgtttataatagtctctgagggctattttttatatttctgggggtcagtgttaatgtccccttgtcatttctgactgcgtttatttggatcttctctccttttccctccttccgtcattccttccatccttctgtccgtccatccgtcctccctccctccctccttctcttcttccctctttccttccttctttttttgtttttgaggcagggtcttgctctgtcaccctggctggagagcagtggtatgatcgacctcccaggctcaagcaatcctcccacctcagtttcccaaatagagtagctgggactataggcacacaccaccacaccctgctaacttttgtgtttttgtagaaacagggtctccccaggttgctcaggcttgtctcgaactcctggactcaagcaatctccccacctcagcctcccaaagctgggattacaattgtgagccatcgcacctggcctctctttttcttactagttagtggtctagaaatcttatttattctttcaaagaattatcttttggtttcattagtcttttatctgttttttcttgtctcaattgtattcagttcaactctgattttggttgtttcttctctagctttggggttggttggctcttgtttttctagttcctctaagtgtgatgttagattgttaatttgagatctttctaacttttcgatgtgggcatttagcactataaacttacctcttaacactgctttagctgtgtcccagagattctggtatgctgtatctttgttttcattggtttcaaagaatttcttgatttctgcattaatttcattgtttttacccaaaagtcatccagtagggttgtttaattttcatttaattgcatggttttgagagatcttcttagtactgatttctgtttttttaatgttgtggtctgggaatgtggttggtatgattttcatttttttaaatttgttgagtattgttttatagccagtcatgtggttgattttagagtatgtgccaggtggagatgggaagaatgcatattctgttattattgggtggaatgttctgcagatgtcacttagatccatttggtcaggtgtcacattcaggtcctgagtatctttgctagttttctgcctcgataatctgtctgatactgttagtggagtattgaagtctcccactattattgtgtgattatctaagtctcgtcataggtttctaagaacttgtattatatatctggtgccccattgttgggtgcatatgtattaggatacttaagtcttcttgttgaattgagccctttatcattatttaatacctttatttgtcttttttgttcattgttgttttaaagtctcttttgtctgaaattagaatagcaacccctgctcttttttatttttttgtttgcttggtagatttttctccatccattttctttgagtctatgggtatcattgcgtgtaagatggatctcttggaagacagcatactattgagtcttgcttctttatccagcttaccactctgtgccttttaagggcagcatttagcctgtttatgttcaaggatactattgttatgtgcagatttgatcctgtcatcatgtgtttagttggttgttgtgcagacttcattgtagttgctttatggcgtcagtggtctatgtacttaagtgtgttttttgtggtggccagtaatagtcttttgtttccatgtttcgcttgaggacctcttgtaagacatgtctggtggtaacgaatttccttagcattcattgtctgaaaatgattttatttctcctttgcttatgaggtttagtttgtttggatatgaagttttgggttggaatttttttctgtaagaatgctgagtataagcccccaatcccttctggtttgtgtggtttctgcagaaaagtccactgtttgcccaatggggttccctttgtaggtgacctgccccttctttctagcggcctttagttttttttttcatgttgaccttggagatctgatgaccatgtgtctcggtaatggtcatcttgtataatatctcacaagggttctctgcatttcctgagtttaaatgtcagcttctcaaggtcaagaacctagcaaggttagggaaatttttgtggacagtatcctcaaatatgttttccaggttgcttgtcctctctccctctctttcaggaatgccaaaggtttggtgtctttacataatctcatatttcctggaggttttgttcattttttttctttttttctttgtttttgcctttattttttatttgaagaactggtcttcattttttatttgaagaactggtctttaacctctgagattctttcttcagcttgatctactctgctgttaattctcccaattgtattacatgattcttgcagtgagtttttcagctctaacagatcagtttggttctttcttaaaatggctatttcatctttcagctcttgtatcattttattagattcctaagattcattggatttggattcaactttctccagaatctcaaacatcttcattcctatccagattctgaattctgtatctgtcatttcagcatttcagcatgcttaagatccattgctggggaactagtggggttgtttgctgttaagaagaaactctggctttttgagtttccagagttctttctcatccgtataagctggtgtatctttaatatttgaagttgctgtactttggatggcattttttgcttttgtattctttgatgcctttgaaggtttgactgtggtataatgtggggtcagtcaactgtcttcatttccggaagatttcagggggccaaggctcagctcagcactactgagctgcttgttctaaccctgagtggctgagaccaggcctatggctttgtgctctggcccctcaggcttatgtacttgctgcattggaggagctgaaatgtttctggtcagctggtagcaatgctccagtgggggctgccagctaaagcactttgttgaggcagtggctgcagagtccagagtccatccttgtgtgtgtgtgccagcagcaacagcggcatgacaggtgcacatgcttgtgccagcatggacagcagtggtgtggggtgtgctgcacaccagcagaggtggggtggcagcgtcttcatgggagcagggcagcagtgggttcttttttttttttttttttttttgagaccgagtcttgctcttcttgcccaggctgcagtgcaatggcgtgatctcggctcactgcaacctccgcctcccaggtacaagcgattctcctgcctcagcctcctgagtagctgggattacaggcacctgccaccacgcctggctaatttttttgtatttttagtagagacggggtttcaccatgttgcccaggctggtcttgagttcctgacctcaggtggtctgcccgcctcggcctcccaaagtgctgggattacaggcgtgagccaccatgcctggccattcattaataaatatttttcctaaggtttaggaagaacacagaatttagagtcaggtaattgactggctgtgtgatctttgaaaaattacttaacttcagtgagcctcaatttcatatctctagtgaagataatacctactgtataaggttattatgagattgaaatgcaaaaatgtaaatgtaaagcatttaatagtgattaacataatataaataaatgatagttttttttttaatctcttgacatggttgatcatgttaactgatacagttttaacttctatttcctggtccgtgatgacttaggaaatacaagataatgcttgatgtagaaaaaactttggataacctttactcatttttcttgcttgacatagctaaaggaaattgggtgggggacagctagtgggggtgcttatttctttatgcagcaatagtgttattttaaactttgtcagtgataaatttttaatagagtagataagaatctagcaggaagctctttcctggcttctttgaacctgccctcccctgagacacataagattgcagttccgaggcctagacttacttaacagtggcctccttacgtttcccagggcttcatgataaagatgcctgttctagctgtggtttctgctttgtattgtctttttttttttttgccccaaatatttccatttttattttttctaatgtttaccaacaaatgtatgtgagaagtacgtttcaacctgtaaaacatcatgctgatgttagttattcttttgtttttcattgttttctttgaccacttttctttttctttgattttctctgacattataggcactttggtttccgttattggaggcaatgatggcccctcagaagctgtccagttcagccattcctcatctacactctgaaggtaagttcttcagaattcaagtgactgagtccacctgtatcatcagtccaatatttgtctgcagaaactatcagtataatatctttttccaatagcatattcttatgatttttccttaatgaaaccatatagtatggttgatctcatctttcatgtttctttctgatgttccactcatataatttatcttaagtaattgtagtctttgtaacttgtcaacagttaattttaaaatatcaaagaggccttggttagctaagtttctaagaagctatataaatgcactgtttttccacagacttataggaaaaactgaaaactcttattttaaactaaccttaatgttaatattttgttataacagctctgaagtctttgaccatgcaagttttaaatagcatggcagcatttattgcccttccatcaatcttgcaaagaatcttacaggtgagttaaaaggggtgaatattaaatattgatttcaactaacattttagttatatataaataacagtgaattgggctaatatttaaatggatctcaagcataatgcagctaatttttggcaatagctaaatatctaaatatctaacttccgaccctcattcttgaatcttttctgtcagttttttggtgtgactttgcctgacataagcttgtgaccttcagttagggcgtgcggccttcagatattccctgttgccttgggattcagatatacaagtttcctattggtttgctaactgggagggagttatcagctgattataatttttagattccaaaaagataatctaaaaattaatacaggaatttcctaagcattggttgttatttaggctttctaactcatcctaaaattatttttgtcttgaatactcatccttgactctaaattctagctggctttgtgtccaaagcttttgtaggaagcattattttggtttgcttctttcaacaaaaaagcctgaaccttctcggcttcatcaaaagagaacactcaaaatactccaagatatatttttagaaaaaaacctgtgagcattcttggggaaacaacaggaattatacttagaatccattttgtctatcctcactttattcagtataggcatacatgtgcatgcaccccgcccccctcccacacacatacaaagcaaaccgtaatatgatgccattagtctttataattttcaaatgatttttattcaatgaagaatgttcctgtcagctcttttaagactcaccaagcttggccgggcgtggtggctcacgcctgtaatcccagcactttgggaagccgaggcgggcggatcatgaggtcaggagatcgagaccatcctggataacacggtgaaaccccgtctctactaaaaatacaaaaaaatagccgggcatggtggcaggcgcctgtagtcccagttacttgggaggctgaggcaggagaatggcgtgaacccgggaggcagagtttgcagtgagccgagatcgagccactgcactccggcctgggcaacagagcgagactccgtctcaaaaaaaaaaactctacttcccatctgatattaagcttctggggcttttctgataaagatgactacatcctgtagtctttgtcattacatggtatactatcatttagaatactttttttttttttttttgagacagtttcactcttgttgcccaggctggagtgcaatggtgtgatcttggctcaccgcaacctccgcctcctgggttcaagtgattctcttgcctcagcctcccgagtagctgggattagaggcatgtgccaccacgcccagctgattttgtatttttagtagagaccgggtttctccatgttggtcaggctggtctcaaactcctgacctcaggtgatccgcccgcctcagcctcccaaagtgctcggattacaggcatgagccacagcgcccggccagaacacatttttacatgtattatttcatttgatcttagcaattatcatgtgttgaataattctttgatatagactgcttcacatatccattttaaagctcattacttatgaggtttctaatcatgtataaagtaatatctccataagggcaggaatacttttccaagtaagttataagaaatgaaatcataaagccaaatgggttctctctgtgctatacattttgctttatattgagctttaaccacacattatgatatgtaaattataacaaaaacatgtttttctcttggcaaaaacatgatttttaaaattttttatatttcaagactttggaatctagaagtctcttgatatttgaaaatcttcactttattttgagttatactggcattcattataattttttcttatcattttctattttcaatggttgttaactcccactaatcaggaaggtatgctatttcttaaattcctcatttgcatgtttgtgattactgtaattatgctaccttatatatgtacagagatttttatttttcaaggtgctttcacagatatcatttcatttgaagcccacaacaatcccttgaggtaggcagggctactataaacatttctgctgaaaaaagaagaaactgaagtatagagaagttgagttcttagcctatcattagcagcagaacctggaccaccccctaagtctctcacttcctaattcacgttcttttttattatgtcatgtgagctttttttatttgtttatgtccctggtcttttgagttcattattaattaaatatattaattgtatgttatgctgtttagatgaaaggcatagttctgaacccataagagctcttatttaagagacaaaaaatgtgctgatacaactattcatagggctctattcaagtaatagtggccacctttaggattatctgctctgaatccatataggataattgccatgcctacatttctatacttaatctgtgtaagagcagaaggagctgtgggaaagtgtgaccctgcctcctgggtccagctgattgactcggggtgagcaaatggcctaaacaaggccaatcagtgtgctttccaggacattttggaactgaacttggaaaagatctataagtctctcgttaagtctctggattacatcaggtacaaatttcaggaacggacagttcctgtttttccattatatggactggaagagtgaaaaagcataatctgtagagagaaggagacgaatgtagtagacactaagaagagacacacaaatggatacaatgcataaagaggattcaagacatagagacgaggagaggagaccatgtggggagaaaaagctgatgcacatgagtctctcattgtgactcttaagacttaccagcattcctcttcttagatctgtgaaataccctagcatctttacaataattaacttttttgagtaagttagattgagtggtatttatggctatatatgaccaaaggagtaccaataaaagtatatacctgaaacagagtaggaaatttggaaagatttcctggaagaggagatgtctgagctgattcttaaaagagtctaaggaaatcaaggaaagaaaggaggtaggattattctatatacacaaagactttgaggtgaaagcatggtacttttggaaagttacaagttttttaagtgtgctcagaacataggataagaataaagaaaaattacagagctgaaatttgagagataggcagggactgtgtctttaattgctttataattcatgataaggagtttggattttattctaaaatcagttgtcatcaagatttttagcagaggaatgactcagacacaaggggaggggagtaaaacacagggctgaaaatgaggatttggggaaagtctgctgatggtattccccgtgctcctcttcccccttccagcagccatcagacgcactcacttctcatgaaggagacagaggttcattttcttgagacactgaatgatctcagaggaataaaccctaaacagattggatgcttcaggttttcctcaagaaaaaggctggctagctgtcctgtcactctccatggagctgcatcagtcagcaagcctcagttacacaaccaggcctttcattgaggtttagtatttctattattaagtactagagcagtattagatttacagagaaattaaacagaaaatacagagaattcccttttaccccttctccctcccacactcagttttgcctacggttaacatttttgtattagtgtggtatatttgttacaattggtgaattaatattgatatattataattattaactaaagtccatagtttacattagcaatcaccctttgtgttgtacagttgtatgggttttgacaaatgcataatgtcctatatccaccattaccatatcatacactgctctaaaaggcccctgtgctccacctattcatcctcctccctatgctaatcccctggcaaccactaattttttttcttttatttgagacagagtctcactctgtcacccaggctggagtacattggcgtgatctctgctcactgcaacgtccacctcccaggttcaagagattctcatgcgtcagcctcccaaatggctgggattacaggcatacaccaccgtgcccagctaatttttgtatttttaatagagatggggtcttgccatgttgaccaggctggtcttgaactcctggcttcaagtgatctgcccacctctgcctcccaaagtgctgagattacaggtgcgagtcaccgtgcccacactgattttttttttttaactgtccctatagttttacctcttccagaatgtcatatagttggaatcatagagtgcgtagtcttttcatattggcttttttcacttagcaatatgcacttaaagttcttccatttcttttgggggcttgatagttcatttctttttatctctgtatattccattgtatggatgttccacagttttgtctatccacatacctatcaaagaacatcttggttgccttccagttctgaaaattttcagtaaaacagctatgaacattcatatgcaggctttttgtgtggacttaagttttagactcatttgggtaaatacctaggaatgtgattgctggattatataagactatgcttacttttgtaagaaactgccaaactctgctccaaaatgtctataccattttacatttccgccagcgctgaatgaaagttcctgttgctccatatcttagcagcatgtggtattgtcagtgttttggattttagacattctagtagacgtgtagtagtctcatcattgttttaatttgtagttctcttacaacatgtgatattgagcttttacgtgctttttgaagtgtttgttttcttgttgttgggttttaaggattctttgtatattttggataaggttctttatcacatgcgtgtttttgcaaatattttctcccactctgtggctggtctttttattctcttaacagtgtgtttcacacagcagaagtgtttgcttttaatgaagtctagtttattgactttttcttccatggaatatgcttttgatgttgtatgtaaaaactcatcaccaaactcaaggttacccagatttttctcatttgttttttcctaaaagttttgtatttttgcattttacacttagagctatgatccattttgtgttaattttgggggaaaatatatggtcagtgttgattcatttttctgcatgtgaatatacacagttggaactagttccaacactgcttgttgaaaggactgtccctttctccattgaattgcctttgcttagtttaccatattcatatgggtctatttctgggttttctgttcttttacaatgatctattttctattccttcaccaataccaacactgtcttgattagttttatagtaggtcttaaagtcagggagtgacaatcatccaactttgctcttcttcattattgtgttggccattccttgtcttttgcctctctgctttaaacttcagaaacggtttgttgatatctacaaagtaacttgctggaattttgattaggaatacattgaacttatagatcaaatgaagaactaacattataacaatatcaaatctttctgttcatgaacatgaaatatttctccatgtatttagatcttctttgctttccctcattagagtgttacagttttcttcatacaaactgtgtatattttattagacatatctaaatatttctcttaggtactaatgtgaatagtatctttttaattttaaattctaactgttggttgctggcatattggaaaccaattgactttgtataataaccttgtatcctgtaactttgctataatcacttaattgtttcagggttttttagacaatcatgtcatctgcaaacaaagacagttttatttcttccttcccaatctgtatatcttttgtttccttttcttgtcttattgctgtaactagaacttccagtacagtgttgaataggagtggtgagaggggttatctttgccttattttctgtcttagaagaaaggcagtttctcaccattaagtatgatgttagctgcaaggttcttatagatactgtttatcaagtttaggaagtgtcccttccttccttgtttgctcacagtttgtctatcatgagtgggcgttggattttatcaagtgcattttctgcatctgctaatatgatcatatgatttttcttatttagcctgttgatgtggtggattacagtaattgatttttcttgtcttttttttttccttttttgtggagaatggggtctcaccgtgttgcccaagcaggtctcaccctgggctcaagccatcctcccgcctctgcctccctaagtgctgggattacaggcatgaaccaccacacccagcccattaattgatttttaaatgttgaaccagccttgcatacctgggataaatcccacttggttgttatgtataattctttttatacattagtggattcaatttgctaatattttgttgaggatttttgcatctctgttcatatagtttcctttcttgtaatatctgtgtctggttttggtattagggtgatgctggcctcagagaatgagttaagaagtgttccctcagccgggatgtggtggctcacacctataatcccagcactttgggaggccgaggcgggcagatcacgaggtcaggagatcgagaccatcctggctaacacggtgaaaacctgtctctactaaaaatacaaaaaaattagccaggcatggtggcaggcacctgtagtcccagctactcgggaggctgaggcaggagaatggtgtgaacctgggaggcagagcttgcagcgagccgagaccacgccactgcactccagcctgggcgacagagcaagactgtctacaaaaaaaaagaaaaaagaaaagtgttccctctgcttctgttttctggaatagattgtagacagtttgtatagtttcttccttaactgtgtggtagaattcctcattattttcctcagcagtccctgtatttaatccacgttaaatcctctctactctgtctcctagaatattttaggagttaagttttttctcccttgcctttccaccctcactgcagccccaatcacacctgtaaatataaactctttttgagccctgccttcatattagcttacccccgaggctgtgagttttgtaaaagcagagatcgtgtctcccttgttcactatgttacctacaacacccagtgcagtgcctgaaacatagtatatgcccattaaatattagttgactccctcacctaatgtccttctatagttctcaccagtttacaaatcactttagtgttcattatcttctctgatctctaactgtgcagattgagctggggatgtagcaatacctcatgtatctcatgagaaaagtgccactcagaaagatcaaataatttgtcttagtttattcagttttgaaatgggaaccactagaattaatccaggtctgctaacttcaagttttagggcttttcttctgtatctaacactaatcaaggcgtttctcatacccacctcactgtatcagatccccactgaaaaaagtagggagcagcagttacttagatgcacaattgctcagatgcaaatgaaaaaattagtttttccaaaagaagtggtcacatgataagaggttctcacagatcttcttgatcttcacgtgtttattcagactgatgcctgggacccaaattacaccgtttttttttttttccatgaatattaggtgataaaagaacattttaaaggaccatatttttgttatatacattctatctttgctgtatggctgaagtaacttttagcttctgagaagccgtttattactttctcactgaggaaaggcaaacaaattatttatagactctcctgttcagggcatcattcatattttaaagcagtgctcaattaataaagatttttattttaaacacccacatacatgatacaataggtaccagaaagcaataggaaaaaaacatggtcatcacatcttttctagtgtgtgtcttgaaaaacaaatttacctgggtacccaagtatgctcttccttcatagtttgcaaacaaacaacttaagagaaacctcagcatttattcattgctgaagaatctagctgacatctttggaaaataatttgaagagctagtgggttggagcatgctgtgctagaagctttgagctcccttttgcattctataatttatatgttgtcccagcatgaggtcattttcttgattttgcttttaaattatgtatattacagtgagatgtactgatacaaatatagaaatgacctatagagatttccttttcccagaatttaaccttttaagacctctttgttctccaaaccacccttgtcgaaaacacatgccagagctctgttgtcttattggatccacatattatagtaaatattataatagatttttctaataagatattgtaccatctgttgatatttgacaaacgtatacttattaagaacttgaccaaaagtataattaagcattaacaagggtctatttttatgcaaagaaaataaaaagaaaaaaatgtgcagtgggtatatggctttgagttgtttttctctgaaggactagtctgaaatatctgtatcttgccttttggaaatgatttccacatatttgacagatatctttagcttagtgatatgatctctagctgtgaagtagaaatttttcctgttaagcttaagtgatgtgttcaagcccaaacttgttaatttgataattactacacaaatacatagttattttgtgccttggatttcttcagcataaccctagcagttgaagagtccagagaaacctctggcagacagtctcatgctgctctagacagactcaaagcactgaaaaccaatcttagttagaaactgcacaacctattctgcaagagccatcactagaacccagaagagaaaagcaaatcctgagacaattcttatacaggtttttcctgcttccatagccttttttccttctgaactcacagtaactcttaacagtaccaagagtttaataacccttactccctaagaaatagccagacatgtttctcgtgttttccagcaatcattagtttatcatttacttacctatgttagaaacccatattttcaagcaaaaagtaatttattacttaatttattagtttttgtatccagacttgggagaccagtatagtgtgtttattaaaagcgtgatttctgaagtacctagattcaaatcccatcttatctgcttgatagttttgtgacttagagaagtttttgtaacctctctaagcctcagtttctttactcataaaacctgttgaaggaacttagtaatatgttaaacataaactgcttagtactgtacttggcatatgctactcacttaaagtagcagctacttttatcataactgtgtagttggattctcctatttggcatggaaaagagtcatttatgtcatatataacttgatattagagaaaagtaatagacttgactcatttattcacagttttaaaattataattattagtctagccaaaggtcagtgaagtgagcacatacatatgctgatggggataaaaatcctaaaataggtagagcaatttggcagtatatattgatagccatgaaaatgccctttgagtctatagttttctgtctagaaatctctaaagaaagaatcagagattccaattgagatttgcagccactagcatttgataatggtggctggagtttgggaaaggggaaaagtgaagtgttcaaagcagaaaatgaataaaacatgatattttcacatgatttatattctgtacctattaagaaatacttgtaatgtgtcacaagagtagagaaaaaaaaagaaatatttgctggtatggaaaagtgctcacaatataccattgaattaaaaaaagatataaaaatattttgtaaaatactcaaattttatacactaaaaaatacatccctctttctcttcctcttctcacctctcccagaaacaagactagagaaatatacatcaaaatatcaacagtgtttacctctagttggatttcagtttttggtgtggttttttgttttttgttttgttttttgttttttgggttttttttttgtacacttcagtgtttccaaaatgcacataataaacaagttacttggcatacctcatatgaaatgcagtggagagaacattgggtatctaggtatcttttgtttatcagtagtgaccttattgaaaaaaacttcaaaaaactgagagctgttttctcagaacctgtttgtctccaaaactgatgcaattgagttggttaggggcaggaagtggctaaatgggatcacaggaggagttgttggacagattctgggtattcctgagtacactggttttaatgtaacatatatacgagctcaaagagggagagttgctgttttatatgaaggagaggaagcttcttgcagaaacaaaataaaagtaaagtttaattagatttgtaaggattgttaagaaaggggcttggataatttaaattttgtttttcaaaaatatttgagatggtcagaggaagactatggtacatttccggtggaaagttcatggaagaataaatattttgtgactgtagaaaaatacttaaaagcatttggctttttcagataacttacattttaaagtaattttaaaatacagaattgtaacagaattgtaattttttccgattaggatccagtttatggaaaaggaaaacttggagaaatccagggacttatcttgggaatgttagatacctttaactatgaacaagtaagtaagctacttgttacatctaagtctgtcctaaggtagaaaaatgctattttttttaattttgtacctatacttaaaaaaaaattaccatctatttactggcagttaggtagactgaggtgtatgtgtgtgtatttcttttagtttttctctcgccaggcatggtaactcatacctgtaacgccagcactttggaagactgagacaggaggattgccagaggccaggagtttgagaccagtccaggcaacatagcaagactctgtctctacaaaaaataaaaaaaaattagctgggcatggtggcatgtgcctataattgtaactcctcaggacgatcaattgagcccaggagttggaggctgcagtgagctatgattgtgccactgcactctccaggtgacagagcaagacccttctctgaaaaaaaaaaaaaaaattctcttgaccttaatttgtgtacacacacacacatttcagaatgtagaaatgcatctaattcaaatttagtttattttaattcattggcaatgaaacaaatatcttttttcaaaatgaaagtgtgagaaactttctggaaaaataatttaatacaaagctatataccacatgaaaaggaaggatcaacatgaatatagaaaattgtaaaataaaattaaatgagtattattttaaacattctgaaacagatagttgtcactaaccattgtattagtttgtttttatgctgctgataaagacatacccaagactgggcagtttacaaaagaaagaggtttattggacttacagttccaggtggctggggagccctcacaatcatggcggaaggtgaaaggcatgtctcacatggcagcagataagagaagagagcttgtgcagggaaactcccccttataataccgtctgctcttgtgaaacttattcactatcacgagaacaacacaggaaagacctgcccccatgattcagttacctcccactgggtccctcccaccacacgtggtaattcaagatgagatttgggtggggacacagccaaaccgtatcaccataaatggtcattagtcttcccttaactcaaaattgtctttagctgtaagtctcagtaagagccagcttggtgtacgggcttttttcttagcgtactgcagagtaacccatgaagccacctaggaaaagtaccatttaggtctgttggagacaatgtctgcttttttttaagaatccgagagaagaaaaggaaaatctgggtgacagcttttcttagaatgttgtaagaattgcagtttggttaagcgtagcccagtgaagcttgataacccctgcagtcacagattccaggttagcagaggtatagttgtgtgcaaggcagaaaatgtttgccaattttggaactatggaagaggagaaaaagataatactgattggaaagaagtagaatagaccattagaaccaaaagtattgcattacaggcaaagttaaagagttaagctgtataacaaggagggcaggcagtacctagctctatcttccccttcgggactgagagaaaagaacccaaatacatagccagatgatatatatgaatgttaagaatgagatacagtacaaaaacaatactatataaatacatagagccttaaaatgacttaatgtgatagctgttaaaatgtctttatgtgacttaatgatagatgtcatggtcttgagtagatgcaaatgacttctaagtgctgatcaggaaaatgtgatctctctgcccaaggaagatgaaaatagagtaatggccattagctttactagtgaaaagatatttgaaacattaccacgaatgcagtttcagtaaaaaatctgggattcagacttagctgtattctttattacaacactctgagccattcagagagcagttattatataaatgtaataaatatatttgggcttatctagtcatttgaaagccatcaatactgaatgaagctgcagaatggcagagctcacatttctcaatagaaactaatgacagatttgagaatctttgtaatgtatacactcaccattactctgcacattgaggttaactgcttgaatttgggaggttttgatgtttttttgtttcaacaatgttatccctttatagtgtgtttcaattttagctgttggtagttgaaaactaaacaagtgctattcaccattcatctcctctatctctttcatcttataaccttttgtttgtttgttttttgttttggtgtttcatagaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttaggtaagaaagggaaggaaatgttacatgtatggtacatgtacatctgtggcattaccaggcaagaatccacatggatacacgggtagtcattctagcagtgaacgtgataggcaagttcctgccctcacagaccttacattctgcattggggtggaggttagggtgcccaggaaagacataaatacagaggaataagagctatggagaaaaataaaacacaggacaaatagatagaaggatgatgagttcaggacaagtgctgttgaatgagggaaagcatatctgaggacatgacctttgagcagaacgagagagggaggagcaaaggtgctgagaggtgtttggattctgagtatcctttaaaggtagggataacttgctggtgtattagatgtggagtataagagaaaaatgaatctttggtctgagcaattgggtaaacatggtaccgttgtctaagatgaggaagaacaggtacaaggaactggggaaatcaagagttttgtcttgcacgtgttaggtttgaaatgtactgttagacatcaggtagggatgccagctagacagttattcaagtcagaaatctggagatgtgttgagactggaaaattttaatttagaagttgtcagcatatgatatttaagctacattgcaaagagagaggaaccctagtgcagagtgaaggtgttggtctcaggagcaaagacagctcatctagaatgtatggatagaggtaacatgatatggccgtggatccaaacttcctgacttcaagtcttgactctactacatgccagctgtgagaccttggacaagttatttaacctctttatatcttagtttcctcatctgtaaataggatagtagggttttgtgaggattgaatgagatgatttatataaggcacttgtaacagtgcctggcatgagtaagcactatctgagtgttacatctgcaggaagattggtagacttgatggttggaaggggaagtagttctcttcacacaaagagcccattcaggcaagaaatatttattgagcacctgctgtatgcaagctgctattcaaggggataggatacaggatgaacaaaacaaaggatttgccctcatggagtttacattgtagtggcagggatagaccataagccaacaagtgaaatgccagatactgataactaccatgggggaaaaaatgttaaaggagatacagagtgtttggtggggggtgcagatattttatataggttggtcagggaaaggctcactgttaaggtgacttatgaacagacaacttaaaaattaattaatagaaaaataatagttacatgaataaaaaacaagctatgctatagaggaaaaggaatgttgggagctactaatttatagagtagtccaggaaagccttcttgtttaagtgacgtttgaggggatctaaaggaagtggccatgcaacgtcagaagagagtacaccaggcagaggagccaagtgcagagaccatgaggcgggagagccttggcattcttgaggagtagtgagtgaggaggctagtggcacctgagcagccaaggaaggggacagtgaaagagacttcagaggagcagaggccaaatcatgtaggagctggcccaagtctaactcatttttataatgaaagtgagacttttactctgagatgcgaagccactggatggttttgaggactggggcggtgacatgatctgacctatgtcttaaggattactctgactgctgtgttaagaaaggactagagagatcaagggggaaagcagatggaccacttaggctgttgtagtagcccatgtgagagatggtctaggtaatagtcatgaagtaagaagtggtaggattctggatatatttagaaggtagtggtattttaaagctatggaacctggaagtaatctctaaaggagcaaaggtagctacaacaacagagtatagaagaggaagtttatatatatatatatatatatatatatatatatatatatatatatatatatatatatatagcgagagagagagagagaagggaagaaaaaagaaaaagagtataaagactatagaaaagaaaaggtttgatttctggaatgtccgacattttagattagagaaatgaagataaatcagtgtagatggctgagaattattctcagtactcaacttctgggaggctgatttggtaatttagtgtaatcaatagggaatttctttataagaatagcgtaaggatttactacagcaatgacatttttgtaaatgtttaatcaaatcacaacccttgccttgaatttggtgagcagaccactcatgttgttatcaagctacttaaataattatgattttttccagttgcttttttttttctttttgagatggagtctcattctgtctcctaggctggagtgcagtggagcaatctcagctcactgtaacctctgcctcccaggttcaagcgattctcatgcctcagcctcctgagtatctgggactacaggtgtgtgccaccacacctggctaattttttggtttttggtttttttttttgagacagagttttgctcttgttgcccaggctggagtgcagtggcacgatcttggctcactgcaacctccgcctcccgggttgaagcaattcttctgcctcagcctcccaagtagctgggattacaggtacctgccaccacgtccagctaattttttgtatttttagtagagacggggtttcacgatgttggccaggctgatctcaaactcctaacctcagctgatctgcccacctcggcctcccaaagtgctgggattacaggcgtgagccaccacgcccagcccccagttgcctttttttcagattatctaaaaatactatccggatttcatagtttgagaaatgaacagaagttcaactcatcctctaggtagtttttagtcagagaactgtgatttgttcgtactcacaacataagtatacaaatatatgtatgaatgtggatttttaaaaagagaggacagcagcaagtacattccctttcttgtttcttaccctgtacagccatcagtgcatttctacttgttagagatttttattgcttctaagtacacttacaagcttatatttatggattttgtgataataaaaagtacaaattggttgccttcgttttgcagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaagacttgttttcgtggcaaaatggaaatggtcttttcttaccaatgtcatttgggcctggtctcatttccttcggttccataggtctcaacaaatttacctggtgggtattgggtacatgaaatgttcttttcagtcctatttagtgttcgaagagcctctcctctctactcagtatggaaaaacatgaatttgagagcaacagatgacattttctgcctttaaacggcttaagatccagttggacagatgaggtgtacacacatgagcctgcttttaagaccttttgatagagtaacagcttagcaagtacagctgagtacttgcaggtaccaatgagtacctatatgataagagtgcagaattatgacttttaagtagggctgatgatggacaaggtgcatacacatatgctctttcactgcctttggagtctgactactggactagatgataattttatgtattttacagcctttttttaaagcagacagtggagcagagtttgaactctaccgcttgatagttttcaggagagcagagcttgacaacatgaggggttcaatgtggagaagttactgggactgggacttgatcattgtgctctactcggctatacttcctctttgaggtagtatcatatttttggcttcctgttccttcctctgtgctaccctatcctatagttggccttcacattcacatcacatagtgaaaagttgggcttgttacttttctcttttcgtttcttttttttttttttgagatgcagtctcgctctgttgcccaggctggagtgcagtggtgcgatctcagctcactgcaagctccgtctcctgggttcacgccattctgcctcagcctcccgagtagctgggactataggtgcatgccaccatgccctgctaattttttgtatttttagtagagttgaggtttcgtcgtgttagccaggatggtctcgatctcctgacctcgtgatctgcccgcctcggcctcccaaagtgctgggattacaggcgtgagccaccgcacccggcctctctttttgtttcatcagccatcagcattgtattagaagcagagcctgggaaaacctcctgactaacttctctccagataacaatgtagaacttctactctccagtggtagcctttccaattataccttccccaagtttgtattgaacagtgtgataggcactgtgccaggtgcctggggatacaatggtagacaaggcaaacatggtcttgtctttcagagtatacagtcaacaaacttataaaaggatttttaacagagtactctcaagttttttctgactccaattcagttcagttctgatactagctagagttagagactccatggtttaagggttcagtcccacacgaacagtcctcactttagatgccagtcacaaacaaagtactcaggctacctacttttgtctgacttggctgcaaattcagtggtccccatgaccccctctgaggttccataattcactaggatgattcacagaactcaggaaacactttatttacatttaccaatttattataaaggatgcgactgaggaagagccaaatggaagaggtgcatagggcaaggttggggagggggatgaggagtggtagagattccatgccctttctgggcctaccaccttcctagcacatcaatgtctacaccaacccataagctcctcaaccccaccatttacaggttttttttggaggtttcgttatgtagtcatgcctgaaaattattggtcatttatgattgagctcaatctccagcccctctcccctctgcacaggttgggagatggggctgaaagttccaaacctctaaccatggcttggtctttctggcacctagccctcatgctgaagctatccaggggtctccagccagcagtcatcttattctcatgcaaaagacactctcatcactcaggagattccaagggttttaggagctgtgtgccaggaacctaagacaaaggccaaatatatgtatttttattataccacaagtacttacagatgaactatgctgtaagtacagataatgagtagatataaaatagacatgagggatcatggaaggcctgctagaagtgccctgttagcttcccttgaagggaaaagaaaaggagtaagctagacgagtttaagtgcaacaaacccagaactagaaggtaagtagaatgaaattaagagggtcagaaagagagtgaaatgaggtgaggttcattaggcaagcaaggaccaagttaagtactcatgtgtgccaatacttatggcattatattttttcattggtaagtgtaatgttaactgtaggcttttagtctgtaacctttatatcatgtttagggaattcctttttattccaagttttcttgagaaatttttcatgaattggtgtaaaattttgaaagccatttacactacattggttgccctcttcctatgttccccacacctcttgcagtgaagaaaggtaatctgttcactgaatttcttcctaccttctcgagcatcaagaaaggttcggaaaccatttaattttatttttaaattttttatttccatagtttttgaggaacaggtggtttttgattacttggaaaagttatttagtggtgatttctgagattttggtgcacccatcacccaagcagtgtaccctatgcccagtgtgtactcttttatcccttactttgctccagtccttcccccctccctgagtccccaaagtccattatttcattcttatgcttttgcattccatagttaagctcccactgataaatgagaacataagatgcttggttttccattcctgagttacttcacttagaataatggtctccatctccatccagattgtgcaaatgccattattttgtttctttttatggctgagtagtattccatggtgtatgtataccacatttctttatgcactccttggttggtggacatttaggttggttccacatcttgcagttgcaaattgtgctgctataaacatgcatgtacaagtgtctttttcatataatgacttattttcctttgggtagataccaagtaatggaattgctgcatccaatggtagttctacttttagttctttaaggaacctccatactgttttccataatagttgtactagtttacattcccactagcagtgtaaaagtgttgcctttctgccacatccatgccaacatctaatatttttttatttttatttttatttttatttttattttttctcatttttttttttttttaattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccattgtcatcatggcccgttctcaatgagctgttgggtacacctcccagacggtgtggtggccgggcagagtggctcctcacttcccagacggggtggctgctgggcggaggggctcctcacttctcagacggggcggctgccaggcggaggggctcctcacttctcagacggggcggctgccgggcggagggtctcctcacttctcagacggggcggccgggcagagacgctcctcacctcccagatggggtcgcggccaggcagaggcgctcctcacctcccagacggggtggcggggcagaggcgctccccacatctcagacgatgggcggccgggcagagacgctcctcacttcctagatgggatggcggccgggcagagacgctcctcactttccagactgggcagccaggcagagatgctccccacctcccagatggggtggcggccaggcagaggctgcaatctcggcaccccgggaggccaaggcaggcggccgggaggtggaggctgcagcgagccgagaccacgccactgcactccagcctgggcaccattgagcagtgagtgaacgagactccgtctgcaatcccggcaccccgggaggccgaggctggcggatcactcgtggttaggagctggagaccagcccggccaacacagcaaaaccccgtctccaccaaaaaaatacgaaaaccagtcaggcgtggcggcgcgcgcccgcaatcgcaggcactcggcaggctgaggcaggagaaccaggcagggaggctgcagcgagccgagatggcagcagcacagtccagcctcggctcggcctcagagggagaccgtggaaagagagggagagggagaccgtggggagagggagaccgcggggagagggagagggagagctcttttttattttttaattagggccattcttgcaggagtaaagtggtgtcttattgcggtttcaatttgcatttctctgatagtttagtgatgttgagcattttttcatacatttggccgtttgtatgtcttcttttgagaattgtctatttgcatcctttgcccactttttgatggggttgtttttttcttgctgatttgtttgagttccttgtagattctggttgttagtcctttgttagatccataatttgtgaatattttctcccactctatgggctgtctgtttactctgctgattatttcttttgctgtgcagaacctttttagtttaattaggttccatttatttatttggttttttttgttttgttttttatttatttatttatttatttttgcatttgcttttgggttcttgatcatgaggtctttgcctaagccaatgtctatacaagggtttttatggattcagggcttagatttaagtctttgatgcatcttgagttgactttgtatacagtgagagttgaggatccagtttcattcttctacatgtggcttgccaattatcccaagcaccatttgttgaatagggtgtcctttccccactttgtgtttttgtatgctttgtcaaagatcagttagctgtaagtatttggctttatacctggtttctctgctctgttccattggtctacattcctatttttataccagtaccatgttgtattggtaaccataccgttgtagtatagcttgaagttgggtaatgtgatgcctccagatttgttctttttgcttagtattgctttggctatgtgggctctcttttggttccatatgaattttaggatgttttttctagttccatgaagaatgatgatggtattttgatgggaattgcattgaatctgtagattgcttttggcagtatggtcattttcacaatattgattctacccatccatgagcaaaggatgtatttccatttgtttgtgtcatctgtgatttctttcagcagtgttttgtagttttccttgtagaggtctttcaactccttggttgggtatattcctaagtattttatttattttatttatttatttatttatttatttattcttgcagctattgtaaaagggattgagttcttgattctcagcttggtcatagttggtgtatagcagtgctgctgatttgggtatgttaattttttatcctaaatctttattgaattcctttgtcagatctaggagcttattggatgggtctttagggtttttaaggtacacaatcatgtcattggcgaacagtgatggtttgacttcctttttaccgattgggtgtcctttatttctttctcttgtctgattgctgtggccaggacttccagtactatgttgaataaatgaaagtgggcatccttgtcttgttgcagttctcaggggaaaccattttaaaatgggatctacacatcagcaaaagtttgtttctggggctatcccattctgcaggacaggagagatgacccaacattttcattaacaggaaacttcagtaagatcaaatctagacactttattgtaattgtatggaagacagaatgagaactattttgttttttcttaaattttcctctagctctctgtgtcctttgattttcttgcataagatattgtaaaaagatctagtgggttaggtaatataagaaggaagaggatatgaaatttatcaaatacatgtgttagatgtttttatgttaagttagtctttacatcaagttgtgagggtgatataatccttattttacagctgtaggaactatctgtagctcagagagtgagggccaatatttgacctcaagtttgtaagaccatcatcaccctgaattatcctaccaccaacctgttctatttttattctggctttattgaaacctggtaaagctgatttttcaaatacatccataccatattggcagtcctaattaagatttctcaccattgtgtgaaccattcacatttccagttataataaaatttaaaatgaaaatactaattctactgtgatcgtttctattaaattttgttatatgaaagttttactttgcccccttaatttcctttaaaaatccgtcatccctggttaagttcctacacagtgcatggagagcagcacaggagggcccagtgactcagacatcaagctgaaacagccaggcagcttccgcctgttgctgtctacacctagaagatggtgaatgcattggaatcccctcactgcctttgtaatgcagtccttctgtcaaatgcagtccttttgtttcatctctttccaagacttgagataattaacttttacttcttcagtttctggctccaactctacaggatgcaatagttaccctcaaaactatggtcatggcagataaagtctttcttcctgccacttctgtctcactgcttttttcataactggtcaatatatacaaccaataattcagacgtaatagttgcctgccaacaaggttacatagatgtgttgggagttattccccagaaagcctgctttctctggaataagcacttttagtcttcaaaaaaaggagaaatgacccaaattactttctttccttatctccccctcttcctccttcccacaggcttactgaaaatcagatctatagaataggccttgtaactctatctgattctctttctgatttctctacatattacccacaggagaaactaatttcagctgaagtactcaacattctagtatattttctcaagaacattactcacttacattaatacaatcaaataatttaaatttcacctttgattattcctatattaaattcatagtagcaaataacaatcttctttggcattgattagcatgagaagaaattagcttgctattaattgtttaaaaaataatatttgttagtcaacaggtaacttgatataaattcaaagaaaaatatctaagatttgctagatttcagttaacagggcttggcgttcttgagagtaggtaataagctaacacattgttatgtaccagaatattcaagttgttattccttttaaaacttcaaacccaagagcattcttagacactcagggagttttatatggtattgttcaaaaccaactgagtttttccccactacttggaattggttttatttcttggtgtttagtgttctctaggaaaacgttttgtcttttggggtaaatgtacaaataatgctaggaggaagtatgaacaacttccaagtaattattcagtaaatgatatttatgttcactagccataattttctattaaccattgcacattgcttatttattttgaattcccactacacttggagattcagtttacatgccatttaatgaaataggaacagtgatattaatgcctgttttcatttgtccatttaaaaagaatattagctctctgatataaataggtcatatcaatactatattactataattaaatatatattactataattaaaccaaatactaaaaaatgagatttcagtgttcagcagtagtgccatttttcaaaagagtatattcaacattaaacttataaattaaatgaagattaatatgtctcagaagtacatagagacgattgatcatcctaatataaatgcagcattttgaggagacttttgcccattttccaataatcttgttattatactgtagtactaagtgattcattacttcagccaatatttaatgttaagggattcattacttcagccagtatttaatgtatacctgcattgagccaaacactattcttggtatgacgatacattggtgaacaaaaaaataaccatagttcccactatcatgtatcttgccatctagtaagggagctagacataaataattaggtaaacaagcattatatcaaatatatagcttcaaattgtgacaggtacataattggcataaagggaaagaatagaatagtataagggagaataacatgagggaaacgtacgttaggtggttagggaatctttatatgcagaggtaatatttaagccaagacctgaaggctaaggcggtaccagccatgtgaaaaacattttaggcaagaaatttcaggcaagagagaacagcaagcacaaaggatctgaggagacaaatgacttgttcaaggaactgaaaaaagatcagcagctggaaccatagtgcctaaaagggaaaatggccaggaatgaggttgaagaggtaggtagacagggcctggttagccttaaagaccctggtaaacaggtaaacaagcattatatcaaatatatagtttcaaattgtgataggtacttaattgacataaagggaaagaataagggagagtaacatgagggaaacctactttagattaggagacaaatgtcttgttcggtcaagagtttggtttttattcttaggaaacattgaatggtgattgcagctgtagaaaatggatagccagatctgtattaccagcccagttctcacttattttccagagctgtatagcagtcagacttttgaagttctgtaaattcgtacatttccctttgatgcagaaaaatcttcatacagacaaagagaactaaggatgaaagtaataccaagacattgtttttagtattttatagaactaaggttttgatggaaatatgagataaggacataagaaattctgttgtccaataaaatgtgaaaaaaatgcaattttaccagtgatcaaagaaatgcaagctaaatcaactatacaataccattttttttacttattaagctggcaaatatttaaaaatacataattaaactgagacacattaaaaatacatatgcatttacattgataaggatgtgaggagacagatacttttatgcactactagtgggaatgcatatttgtataagtccacaagcccttgtctaagtcactttggccagatatgtttcagaattcagaattttttggattttataaatgtaatatgaagactttcacttcaggacaagatgcatttggagttttttgcggggggtagggaaggggcaaaatatataaaataatggttcataagacattggacaccaggcagtgaaagatagtgacccctgaaagataagaaacaaatgacataaaccctaagatttctaccaaattactccctggagaaagttttcacggcatgactcagagagggagaacgaaggcagagcttagtctctccgggtcaaggggacagggctcagagtccaggaaagacaaggtggctagagtttgcagggtggagtattaggtgagagccatacagagggctccatagatctgcagaaggtaacttttgagtattcagttgagtacttacccacttatttacccactgtgtgaggaaactacttcaggtccaaaaaaaaaaaaaaaaaaaaaggtgccacccaaaaggattagattgaacaatgtcccagactcacaaagagccagaaataatgcttgctcccaccagccagcctggaaatcttcataaatcacaaggtagcattgagagtactaagtaagttcttagcctcagtagtggggaaaaaaattaactttaaactaactgctgctttgatctcacctaacaaagcttaaaagcaaaaacctaaaaagataaaactatttgcaagtattttaaccatatcgcagaacagagtttagcaatgtattaaagaattataaaaatatccaatacccaacaagatagaatccacaatgtctagtatttgatcaaaaattactaggcatgcaaagaagcaggaaaatacaagccatgataatgaggaaaagaaaacaacccattgaaactaacacagaaatgacccagataataaaattagtagataaggacattcaaagttataattgtattccatatgttcaagaagctagaagaacaattgaatacgtcaaatggaaatatggaagttacaaagaaccagtagaacatctagagattaaaactacaatgtctgagatgaagaatatactagataaaattaatagcaggatgggcattggagaagaaatgattagtgaacttaacaatatagcaataaaaactatcccaaatcaaacacagaaagaagactaaacagaaacagggcttggtacagtggctcatgcctgtaatcccagcactttgggaggccaaggcaggaggatcacttgagcccaaaagttttagaccagttgggacaacatgatgagaccctgtctctaccgaaatttttaaaaaattagccaagcgggtggcacatgcctgtggtcccagctgaggagctgaggcaagaaggtcacttgagcccagaaggtcaaggctgcagtgagctgtgattgttccatgggactccagcctgggcaccaaagcgagaccctatctcaaaaaaacaaaaaagaaaaagaaatgaatagatcattggtgaactatggaacaacttcaagtggccaaatatacatcaaattggaatcctaaaaaaaagtagggacacagagtacaaaaaaaaaaaaactttaaagagacataatagagttctaattccagtaacagcagagcagcctatagtagatgacctttttgctaataattataagccctaggcaaaatatgaaaaaacattgtttagagagcaactggaagcaggcagaaactatagggaatgcaaaccttgaaagaagggaagcaaactagacgagctctacatttaaccagcttttctagggcacctcttggcttgccatggagtattggagaaaagagcttgaataccaagtatcattcttactgggatgaagaaacagaggtcaaagtacaagactaccaaagcagctctaagttgagggagaaaatctcagaaagaagcatgccacagaagagggagccccaagttctctttgcagttttccaaattgtgtacagacagacagtgcttccagaaagcagcatcaggtactaaagaactaagcagagatttcagcagctgcctggtgctgagttttgaatgtaaatgttgctatgttacagggattgataaatacctcaaattttgtgttgaaactgcagaagagctatggttgaggactaagggatttcccaggactaagggcaaaagcacagtaaatcctaacaaagccagagcccaaactatcataggatcagtaggaggaagaaggaaagtgtaaactataatcaagagaaaaagcatcagtagaagcagacctatgaatgacccagatgctggaattggcagttaaggactttaaaatagaaattacaaatatgttaaagtatttcgtggaaaagattaacagaatgattgaacacatggggaaacgtcagcacagaaatagaatctctgaagtaaaaccaagtgtaaattgcagagctaaaaaacatatctaaagtgaaaattttattagatgtcaacagcatttttaacactgaaaaaaattagtaaatttgaatatagttcaatagaaatgataattgtaactgaagcacagaggcaaaaataattgaagaaagtacaaaaactcttggtgacctgtgaaacaatatctagaagtctatcatatatacaaattatagctatatctatattttatagatatatattaatgtataaattagatatttataaattatagatatataatgtacatatatctataatttatatattatataattatatttataatttatatatggatataatgtacatatatctataatttttatatatgataaacataaatataatatacaacatatatagaatatatatataattggatttctggaacataaggagcaagagaatgggagctggggacattggacctaataatatctgaaattttcccaaatttcatagcaaacatcaacccatagagtcaaaaactcagcagacctctagcagaataaatataaagaaaaccatacccaaacacataatagtcgtagtcaaactgttgaaaccaaagatgatgaagaaatcttacaaggagccaaagacaacaataagaatgatggctgatttctcatttaaaaaaaaaaagaggccagaagacaataagctggcatttaaaatgctaaaaagtaagttaatatggtgcacgtattgtatgtgacattccttgccaagaccagctaagtcatggagaccctaacccagtggcactagaggaattagacacacacacagaaatatagcgtgtggagttggaaatcaggggtctcacagccttcagagctgagatcctcaaacagagatttacccacatatttactgacagcaagccagtgataagtattgtttctatagattatagattagctaaaagcatttcctacgggaaataactaaaagcatttcctacaggaaataaagggatgggctgaaataaagggatgggtctggctccttacttgcagcaggaacatgtccttaagacacagatcactcatgctattgtttggggtttaagaacaccttaagcgttttccaccctgggtaggccagatgttccttgccctcattctggtaaatccacaaccttccagtgtgggcgtcatggccatcatgagcatgtcacagtgctgcagagatttcgtttatggccagtttgggggccagtttatggccagatttggggggcctcttcccaacatgtcctccttctttgttttgcaaagtgataaaagcaaaggcagctttgcatggtgagctacttctcttaagagtcaggatccacatctgcagactatacaaagacaacacagattaaaagcacaaacatcattgaaatcacagaccttccaagtgtttttatccattttaatgggttactagctgctaatttgtctgcagctccttcaagcactccagttcctggcattaaggtcaggtgtgtctgggatactttaaatatttgttctttaattttgcaatagccgaagacaagtttgtagagtgtccttctagatgcttttttattctttcctaaattttgatcttattaagagctattcatagtttccacaaatccttatgtttagctcctacaacgggccatatcatttgaggttgaggtgccactataccgccatggttccagataataggaactcttaccgtacttcttaccatttctaccatctgaccattttgttcagaccagctgaacacagtgtggccatggcacacagacagatgtgcaatttaagctaaacatccccttaggggaccagtcaataatgattccatgggaatcgttgtgcagcacctctgccttttctgcaatgcaatcttcccaaacaagtacattcattttttctaactgggaccagtcctgtttacaaataggtttttgagggcagtatctctcacttataggaatagctttattatggtaaatcctgagatcagaaagcatgtgtaactgtgtcatagagtgattacatacaggcattattgccagccaaaatggataaatatgcccaataagtataattgttctctgtgtcagcccttgttgaaggaatactcacggcaatggtaatcaccactatcatagctaccattaagttactcattgtgactggttgtcttgctttcctcaggttttcttccaccatctgtgacagcttcttgatctgtccctaagtaggtggctgtgttcgacgggtgttgctcatgacagttggggtcctcctcagcatcagtctcgacatggctgcaaccagggggtcctcaggttcctcccagagtctcttcctcggcatctggctcatgataaggtttcaggtgtcttgatggtatccaaatcggctgttgattcggtcctggagaaacgcaagcataacctttatcccaagttattattttacctatttgccaagtttttgctatcagatctctccaccaaaccagttattctgcttctgtctttgcagctggtttctgtagatgctgttcagctgctgatagcatctggcctttagacaggctcaaaaaatttaaagttagtaatgctagattcagttgcatatgaggtgtcccatagtccctgtttctccccccttttttgtttttgtaactgctgttttagggagagattcattctttccactatggtttgtccttgaaaattacatgggatgccagtaatgtgtttaatattccatgtagagaaaaatgtagctagagcttggctagtatagcctggggcattatctgttttaatagaagctggaatgcccatcaccgcaaaacactggaaaaggtgatctttaacacaggcagaagactctcctgattggcatgtagcccagacaaagtgagaaaaggtgtccacacatacatgtacataagctagtctcccaaacgagggaacatgtatgacatccattagccaaagagaattaggttccagtcctcgaggattaactcctcttttactgtaaaagatgaggaatgcaccatttggcaagttgggcatcgctggataatagctttagcttgtttccaggtaatgctgtatctgcgtttgagaccagaggcgttaacatgggttaaattgtgaaagtgtctagcattagatactaggtgatcagccatttgattccctgcagttaatggtcctggaagaaagaggtgtatgagccctaatgtgagtgatataaaaagggtgcattctaattctaactgctgtttgcaattgggtaaataaagtcatcagttgttcatctatatgaaatcgtaactgagcattttcaattaactgtgtggaatgaaccacgtatgaagaatcagaaatcacattaacaggcatatcaaaagcagtcaatacctcaattacagctacaagctccaccttttgaggtgaagtatagggtgtctgaaaaactttacctgttgatccagaataagaagctttaccattactagacccatctgtaaaaacattctcagcaccttcaattggtttaaatgtagttattttagggagaatccaattagttaatttcaaaaattgaaagttttgttttaggaaaagagttatcgagaatacccacaaagtcagctaaatgggtttgccaagtaagaccatttataaaagcttgctgtatttctgctttcctgagagggacagtaatttttccaggatcatatccatgtaatttaacaatccgagttctcccatttcctatcatagtagcaatttgatccaaataaggagttagtccgtgaattagtatgtggaagaaaaagccattccactaagtcctgctcttgggcaataacaccagtgggtgaatgctgagttggaaaaattagcaaatctagagtcttctctggatctattctatttatttgagctttatggtcttgctttttgattagctgcagctctgcctcagcgtcttttgttagttgccgagggctagtgagactaggatctcctctaaggatagaaaatagattactcatggcgtaggtaggaatgcctagagcaggtcatatccaattaatgtcccctagtaatttttgaaagccatctaatgttttcagttgatccctacgtatcgttactttctgtggcacaatgtagtgtcatttactaaggcccctaagtaggattaaggaatagtagtctgaattctgtcagaagctatagttaaaccagtgtgagaaatcgaattttgcaagtgatcataacattggagtaatatttctcgaatggggcagcacaaagtatatatccatataatgaataatgtaacactgtgaaaattttttacgagtgggttcaattgcttgtcctacatacgtctggcaaattgttggactgtttaacatgccttgtagcaacactttccaatgaaaacgcttagcaggctgcaggttgtttactgcaggaattgtaaatgcaaactgttcacagtcctgctcagctaagaggatagtaaagaaatagtcttttaaatctatgactattaaaggccaatttttcagaatcatagcgggagaaggcaatcctggctgtaatgtccccattggttgtatgactgaattaatggctcttaaatcagttaacattctccatttccctgattttttcttaattacaaaaactggagaattccaaggggaaaatgttggagctatgtgtccgttttctaattgttcagtaactaatttctctaaagcctccagtttctctttcttagcggccattgttctatccaaattggcttatctgttaaccattttaaaggtgtaggttctggaggcttaacaatggccaccatcagaaatgatatcctaaactttggtaggaacttcgtctttctgcttgaagcggttccttcaaaccttgtaaattttttcctagtctcataccaaggacataccccatttcatgcatcatatgttgcctttgagggctatataattgttctggaattagaacttgtgctccccattgttgtaataaatctcttccctataaacttataggtacagaagttataattggttgaatagtccaggttgtccatcgggcccttcacaatgcaaaatataactactttgataatacttcaggggctttaccaactccagctatgttaaattgagcaggttgaattggccacgtggacggccagtgctatagagaaatgattgaaatgtctgctcctgtatctaccaaacccttaaatttctttccctgaatagttatttcacaggtaggatgtttatcagtaatctgatttacccaataagctgctttgtcttgtttatttgtgcttccaaatcctcctgttcgtttaatttcacctttccccatttccacatacggcacaatcaggagctgtgccatacactgtcctggctctgctttccagggaacagaagtagatgtaacaatttgaatttcctcattgtaatctgaatcaatgactcctgtatgtgtttgcactccttttaaatttaaactagaccttcctaaaagtaatcctatcgtccccgctggcaagggtccacagagccctgttgggaccttttgcgggggttcccaggcagaaggctcacagcttttgtgcagcgtaaatctactgtggcactaccggctgtggcgggggacagacattgtacgggggtgagggaatggcctgagccggaaaggtcccggtttggaatggggcccaggacggcccttcatgacgtttcccgaaatcaggttcccatctttatcaaacttagagtgacactgattagcccagtgttttccttttttacattttggacatatttcaggctcagcagttttcattttttccctcaactggtggcctgacttgctgattttttctacattcttttttagtatgaccatgcttcccacagttaaaacaagctccaggaaatggagtatttcctttatccactctcagtcctgccattgcctgtgctagcagagtagccttatgcagattacctccaataccgtcacaggccttgatagaatcaactaaatgtgctttccctttaacaggtcgcagagcagcctggcaatcgggattagcattgtcaaaagctaataactgcaacactatttcctgagcagccggatctgcaatcacctttttaagagactcctgtaaccgagccataaaatctgcatacggttctttcagtccctgctttacagcactaaaggaaggatattgttctgcacctgaagtgattttttcccaagccctaattcacactactctaagctgctctgtggcatcatcctgcatgaccacttgggcatctaaaccagcccagctgccaacccccaaaagttggtctgcagttacattaatttgcggttgggcctgggcgttgcaagcagcctgaatggaagtttcatctgcccaccaagttttaaattgtaagaactgagcaggagttagacaagctcgaataagagcgtcccagtcagtaggaatcatctgactggaaacagcaaccttctttaacagtcccattacaagaggagaacctggtccatattgattaatagcttgtttaaattctttgagtaatttaaaaggaaacggctcaaatgtagctataatatttccctgttaatctggggggtgtattctaacagggaactgccaagcctctaaatcaccttctcttctagcttgctgaattcctgcctgaatagaactgagagtggtcgctcgaggcgctgctcgaacagtcactggggcaactactttttgcccatatgtcctctggaaaagaaagatctggaggatcaagccactctttttcttcaaaataatgagggggtgtagaagggtacggatgaaccttatcctcctttgctgctttagctttagctggcaaacagacctgctctgttacctcttctgttacttcgttgtactctccttcctcctcatcattagagtgaaaaggttccaaggtggaacaaaccagagcccacacttgtcccattgttaccctgatgctcccaagctccccttcttactcaccatggggattgcttaagagtactcagtgtcctccagcttagttccacgttctccaaccatcactccggcgacccttcaacccaggtttgagcccccatgtttgagcaccacttgccgagaccagctcggtcagggagaccctaacccagcggcactagaggaattaaagacacacacacacacacacacagaaatacagtgtgtggagtggaaaatcaggagtctcagccttcagagctgagagcctctaacagagatttacctacatatttattgacagcaagccagtgataagcattgtttctataaattatagattaactaaaagcatttcttacaggaaataaagggatgggccgaaataaagggatgggtctggctagttatctgcaacaggaacatgtccttaaggcacagatcgctcatgctattgtttggggtttaagaacaccttaagtggttttccaccctgggtgggccaggtgttccttgccctcattctggtaaacccacaaccttccagcgtgggcgtcatggccatcacgagcatgtcacaatgctgtagagattttgtttatggccaattttggggccagtttgtggccagatttgggtacctgttcccaacaattcctggtatggactagtctttatttcataattaaatgcttttgagagataagtgaagactataaatagcgtcactttggttcaggccaggttttgctgccagatgacttttggtgtgaaaaatattttttaaacaatcctttggtttcagagctttttggatttcagaattataggaaagggagttgtggcccatcttacttacctgaagaaaaagtagtaatatgtatttttaaatggttacacgcttttaagcagggacttacaagaatctgtccatctgtccaacagaaattatcaagtttgtgtgccaaatattatatatgaggatacaacatcttaaaaaataatttttaaaaattgaaaataacctaaatgtcccaatagcccacagttgattaaattagttatggtatgtctaggcagtgaatgaactgctttgtagccatgaaaaatcatatcatagaagaatattgatatgtcgaagtaaacattcataatgtgcaacatagaaagatcacaaagcagtgattccaaattttaatagcagttgttgctgtgtgattggattgtgctttttatttgctttgtttgagctgttatatttcttaaatttctgtcactgaacatgtatttcttttgtaatcagtaaaattaaggctttttttttttttttgcatttaaaaaggcctcactctgttgcctagactggagtacagtgttgtgatcatagttcactgcatcctggacctcccgggctcaagcagtcctcccacctcaccctcccaagtaactgagacctcaggtgcacaccagcactccaggctaatttttaaattttttgtggaaatggggtttcgccatgttacccagactggtctcaaattcctaggctcaagccaacctccttttggcctcccaaattgctggtattacaggtataagataccattcctagccctattttaacaacaacaacaaaagccagctgtggtggctcacgcctgtaattccaacattttgggaggccaaggtgggtggattatctgaggtcaggagttcgacaccagctgaccaacatggtgaaaccccgtctctactaaaaatacaaaaattagccgggcatggtggggtgcacctgtaatcccagctatttgggaggctgaagcaggagaatcacttgaacccaggagttggaggttgcagtgagctgagatcgtgccattgcactccagctggggcaaccagagcaagactccatctcaaaaaaaaccaaaaaacaagatgataaagaagatattcatattgcttttaaacttcagctcagattgcttcattaagtcaggaatcattttattaacaaagatcacaaaaagttcaacattattaaggccctagcttcgtatatcatccgtatccccagatctagtgtctgcatacctggatttaaaatgtctcttttaagcttcattgcctggggcatttccagaaggaatcctgttaaatgaaaaaataaggcctttcatgagggatgctggaccacttccattgccacttcaaacatattctgacttaatctctagagaacaggcttctcatataaattgtccaccaccacatctagttcttggcttgtttttaaaagtctgcagattctttcatgaggtcacttttttaagcttaaatatctactttgctttgaaaatctgttttctcccttttcaaaaagagcataccagaagttaaaattggatcatttttagcaagctacatcatacatctggagtgaattccagcgtattaatgtcatggtatgttacagcaaagactgtcaagtctaatttttgcagatctgctcaatctgaaaggacagtctggacagctagcagttttgattgttgagctgagatgtgttttctaaagttattcttaaaatcagagaggttaaacaaaacctgcaacgtggtcctacttgaatagcgatggcgacagtgataggaaatagtatatttcctatagtatatatcatctgtactgtagtctcttataattaggcagagttgaaagaggcttgagatcttgtaactgtttaccagcacctcattctagtcagatagtatcgagtatccattgaactacttatagtaataattatattttgcccttgatatggtttggccatgtccccacacaaatctcatcttgaattgtagttcccataatctccatgtgtcgggaaagggacctggtgggaggtaattgaatcatgggggcggttacccttatgctgttcttgtgatagtgagtgagctctcatgagatctgatggttttataaggggcttttccccttttgcttggcacttctctctcctgctgccttgtaaagaaggacgtatttgcttccccttcaccatgattttaagtttcctgaagccttcccagccatgtggaactgagtcaattaaacctctttcctataaattgcccagtcacaggaatttcttaatagcagcatgagaatggactaacccctgtaaattaataaatagatattctggtctctgtatatttaatgtttttgctagaattcactgctgaaaccctgtcggctaggaattttcattgcagaaggatgtttgataacaaactgaatttatttaatagatataaggctattcatattttctgttttgggtccatttttgtaagttctgtttttaatgaatgtatcctttcattccttttcatttaatttgtcaagcttattggcataaaattattcacaaaaggttcttatcatcttttaaatacctgtaaatgatgttgcatgttgtaatatatcctctttcattgctgatactggtaatttatagtctccttttcttgatcaagctccatagcagattatcaattttatttatcttttcaaagagaaccaatgttgactctgataattatcttggttgtttatttttatttttatttcattgatttttgctgcttattatttacttctttcctacttagtttggttttactttgatctctttctagttccctaaattggaaatttggatcctttattttaaacctttcttattttccaatataacatatgggctgtaaattctttaaccactgttttagttatatacttcaaatttctttaaatgctttattgaggtataataactgatataaactggacatacataaagtgtacaaatttgacatatgtatacactcatgaatctgtcaccacaatcaagataatgactctacccatcaccaccaaaaatttacttaatccctctctcctgttccctggcaaccactgattatctttacaaattaattaaacagtagattagtttggattttctcgaattttagattaatgaaactataaaatagatatacttttttttatctgacttctttcactcagcatagttatttgcatgattgcatcatgtatttttaagctattaggtacatagatgtttagcattgttgtgtcttcctaatgaattgacccctttattattatgggatgaccctttttggacctgatagtagtctttgctctaaaatctagtgctattggctggacgcagctcatgcctgtaatcccaacactctgggaggccaagacgggcagtcatctgaggtcaggtgatctctactaaatacaaaaaattagccaggcatggtggcgcatacctgtaatcccagctaattgggaggctgaggcaggagaatcactgaacctgggaggcggaggttgcaatgagccaagatcgtgccattgcactccagcctgagcaacagaagcgaaactctgtctcaaaaaataaataaataattaaaaaaaaaatgtagtgctatcatggcatattgtcgccatccttttccttttaacctatttgagccttcatatttagatggtgtttcttgtaggcagcatgtagtcaggtctttttcatttatctaatctaaaatctctgtatttcagctcttcaaatatttaaatatatttctgtactattatcttttcttccttggactaaacatcctcttattatggtttggctgatactttttctaaatccttcacaattatcaaactcttctgtgcatgctttgcttcaaagggatattacatcacagtagagattttgagttgccttctgcaagaaatgctgatcattgtttattacttcatttgcttaacatcatcaccaaagatctattatctatttaatccctcaccatttggttaaaaccaatctagacccacttttcttacccaaatcatatttttttcttggttcactactgattttttgatctccagaaaaatttcaaggggacttaacacaaaatctattaatctattaatttcctctggaaatgtctgttttatcttagttataccaattctagttgaattattttgaatgtgggtcagacaaaactagactataactgaaagggtattaaaatgtttgccttttttttccaggtaaaaatgtctccatcgtatcatcagtccaaaggggatcccactgctaaaaaggtgagtttgttttaaaggcaaaaaaccagttcttccttctgtatgtttattctcctatgtggaacaatattctcaacatggcaatgatttttaatcatcttaatgctgtcaagggttatttctgattagatgctttaatgacatgtctccaggcctcctctttggcttctccagagaaaccaagttgggtttcgacatcagtctcctagcaactatcagtttctagaatgtccatcttccaggcatggtatcgtggtatcaatgagtggtagtaggtgaaagatattcacaggaaagctatatagtttatcttaataatgtgctttacttcgactgggtgcagaggctcatgcctgtaatcccagcactttgggaggctgaggtggatggatcatctgaggtcaggagttcaagaccagcctggccaacatgatgaaaccctgtctctactaaaaatagaaaattagctcggcgtggtggtgcatgcctgtaatcccagctactcaggaggctgaggcaggagaattgcttgaacccgggaggcggaggttgcagtgagtcaagatcgagccactgcactccagcctgggcaacaagagtgaaactccatctcaaaaaaagaaaaagaaaaagaaaaaatgtgctttacttctagagagctgtgcctaaaaaaactggcctgagatagtaacagcacataagaaggtcttcaataaatgctggcagaagagagctctcatgtgtgctacttcagttcctgactgtaagctttgtgaccacagatagggtatgactgacggttttacaccttatctgagtgatgcatagatgatgtcaagagaaccactaaaatccttttcctttatccagctgtaaaagtgcagttgaaacatggtaaacaaattgacatttttgcttgtttctttcatcatttttctttctctaatagtcgaagtgtttctttcccttgcccttttttgccatttcagccagcatccatatcagtgaaggactgtagaacaaaaataaccacctgctggctctgttgactaacaggaggttttagcttcaaagcaatgttccaaaaatgggtccccctcctctgacttcagaatcccctgagactttttcagaagagaagagaataaaaacaaaatatgttgtctgaaaagacctataacatactgcacataaaaatctctttcactcttgtcaaggcagtaggggcaggcgagactgaggcaatgactgttgatacttagaaccatcacactgtaacgcaaagagctgggggagcctgtcattttagtctcactcagtaagtagacgaggaaatggaaatccagagggattccaattttttgtcttagctctccaatgttagctatggaacacacttctaacatagtgatgtcaagcgtgtgccttggataccaccagacttgggttcgaagatttactcttctgcttatttatctgagtgaccttgtgtaaattggcccctctgtttcgtcttatgtaaaatggtgatgctactctcagaattgtcctgaagattaaatgaaatagtctactgcttaagagtataatactatgtttgacatatagtaagtactcaagctgttgttgacactagtattaaaatgcaggtctcccagctcctaatcagatgtcctcttactttatcatgctgcttgtataatattgttcattcagcaagtatagtctgcccttcacatttgtgggttctgcatctgtggattcaaccaaccacagattgaagatatatgggggaaaaatgataaaaaaaataatgatacaacaataaaaaacagtacaactatttacattgtattgggtattataagtaatctaaagatgatttaaaatacatgggaggatgtgcactggttatatgcaaataccatgcattttaaaggacttgagcatccatggattttggcatccacaggaggtcctagagtaaattccccacagatatcgagggatggctgtatttctttttttttttttttttttgagatggagtttccctctgttgcccaggctggagtgcagtcacatgatctcagctcactgtaacctctgcctcccgtgttcaagcgattctcctgcctcagcctcctgagtagctgggatcacagggacgcaccaccacacccagccagtttttgtatttttagtagagacagggtttcaccatgttggtcagctggtctcgaactcctgacctcatgatccatccgccttggcctcccaaagtgctgggattacaggcatgagccactgtctttttttttttttttttttttttttgagacagagtctcactctgtcgcccaggctggagtgcagtggcacaatcttggctcactgcaacctccgcctcctgggttcaagcgattctcttgccttagtctcctgagtacctgggactgcaggtgcccaccagcacacctggctaatttttttgtatttccagtagagacaggatttcaccatgttggccatgatggtctcaatctcctgacttcgtgatccacccaactcagcctcccaaagtgctgggattacaggcgtgagccaccacgcccagccagctatatttccttacactatttactgagataaacagtggactagagaaaagaaatacaatcctgttctcaaagacctcagcatttattgagaaaagtagacgggtaaactgatagttaccgaacaccttgacacataccatggaaggtgcacagggttctgtgaaggcgccaaggaaaggccctattttgagatgactaagctaacttagtgcagtttttatgttctttttttttttttttttttttttttgagacggagtctcgctctgtcgcccaggctagagtgcagcggcacgatctcggctcactgcaagcttcgcctcccgggttcacgccattctcctgcctcagcctcccaagtagctgggactacaggtgcccgccaccacgcccggctaattttttgtatttttagtagagacggggtttcactgtgttagccaggatggtctcgatctcctgacctcgtgatccgcctgtctcagcctcccaaagtgctgggattacaggcgtgagccaccgcacccggctcttacgttctttatggcagaaacctccatgaagaactttgaggaatcgttagctgctcccctacaacactgttatcagagtgagagcaaattttgccatgtatataggcatttattaaataaatactcatttagaaataggttctgcaacctatttttcaaactgagtaatgtcccagctctttgtcattttaggtgtctgacatctgtcagggatgtgacattacagaagcagggttttgttactcttagaatcggcatcaggcaaacagaagcttcctaagccaatgactggacacaagtggcccgggcagcattcctttgtgatcagatgcagacttattcctggtttatgcaaaacttgggactatctctaaaatattttattcaatatacatatctcaaatgccttttactttatcaatgagagtccatttccaatattcaccatggcggttaacaagtcatttctttcaccaataaaaatatttccattttttagctaatgaggcaagtcttagtgttggtgaacatctgaatagctgaagagctttttttagtggctgtcttgcggagttcgtgttagctggactctcctgaaatatagattcttaatttgggccattgaccatccctgagttgaagcccaaaactacatagcacatacttattatcatgctgtttatgtcgtctctagttacttgaaaacatgtatcacagtgggtcagtgggcggccatcccagattaggggtcaggaaaggcttcccagcgaagataaagcttgacctagccttaagaaacaagggaaatggtaacctaggcagatagaagtgagtaacacattgtcagaaatgggaatggttctgcatgtcttcagtataatgtgaaagcatggagaagtctggtaaaagataaacaggggttcagaccacaaagagccccagtctgtgaagtttgctttctatcttgaggataaggtttccagcaaaggtaagactgaaagcagaaagaccaattggaagagtaagacacttgtccaggtaagaaaaaagatcctaaccctaggctgtgttaatggagtaaagagattaaatagattcaaatattagctattttttctctcagaaaaccctgacaccctccttaagtctgagtaagtgtccttccttccctgagctcacagcgctctgaattagtccctaccaatacctgggtgggttgagattgcctctctacttaatgctcatctcccattagacgatatgcctcatgagggcagagcagtaacctcatcagtcttgtttacagttgtatccgtaagtgtagaacaaagtagtcactcggtcgttgttgaatgaatgagagatgcacgaaagagatttcacaggacttcctggtggtttatgagaagtgagggggaaaagaaatttctggctctgatgactagaggaaaaataaatgaaacatcattgctgtttcaggcttgtctcccaggcatggtcagttccttattgaatcaccagtactccgagtgagatttacctgaagatcaatgtgaaactcaacacctaattattacttccttagttgggtatatatttttgtgtggatatgcttgtatgctcatgtacatctatgtatatattctggttcttatccttgagctacagtctctcttcccaaagttgcattgacagatggaagcagcagtagtgtctgttgaacagagtgactgccaaagtgacatgtgtaggaaacacaaaggaagcagcagtgttcttcatttagccaaaaagtctctgttgaccgataactgaaggaagtgtttggtgactctgctgtcaatattggccctgccaagagctggattcaagtgctaaggaaaccagagtcatgttctgtaggactcagctaacttcctggggcttctttttaggtatttcatgtaggagtcactctttagaatgtcactgttccactctgccgctgcatgtcagagtgtgcatcacattccacaacatgtatctttttttttttttttgagacggagtctcactctgttgcccggcttggagtgcagtggtgtgatctcagttcactgcaacctccgcctcccaggttcaagcagttctgctgctgcagcctcccaagtagctgggacaagcacacaccaccacacccagctaatttttttgtatttttaggagagaaggggtttcaccatgttggccaggctggtctcaaactcctgacctcaagcgatcctcccacctcagcttcccagagtgctgggattacaggcgtgagctaccacgccctgcccacaacacgtatctttttactagcattttgcattatagatattctttacaaaagctttaaattggcaatatttattgtatataaaattggtatgtatttactttatttaaaatttcttcttagtgggctctaattgataatttcagtaacgaagttggaagatacacatggttccctaggacctttacagtgtttgatcatgtatgaccagaaatgtaaaaatcaggagtcattgccttcagataaaaatcgacataaaacccattgcaatgaactccccaggatagatccaaatgcaggtgttgacaacgtttaaggtacatcaggagagttagttgggggcagcatcagacaccactcagctatgatgcatctcttcttgactaccaaagaaacaccaaccaagaatgttcacagaaaagttgggtctgttacatttatgataactagagaaagcattttgtcttgtgtcttgatctcaggtacatggttacctctctgagcaacccctggttttagatccgctttctctgctggtgtgtttgcagaagctgaggggccaggtgctctggctgaagactatcctcaggctggtggtgccactggaaggtccacagctgttctcctcaaagtaacttcttccagttagggacaatgcacagggaatgagagagtggaaagcctttccaatagttctgtgagtccattcagtaaatattccgcaagcctgttaggtgccagggttcagagggacaaaggacagtgaagaaatacagttccttctctcagcacatttacatgttaatggtgactgaactggtggatatcatagccaagcctctcagaagttgattttcagtttgttaagtattcaggtacgttataagaatttggagctgatttttggagttttttaagagacgatgtctcactgtgttgccaaggctggagtgcagtggcacaatcatagcttactgcagcctcagactcctgggctcaagcgattctcccacctcagcctcctgagtaattgggattataggcatgagccaccatgcctggctgatttttttttttggtcattgttccaggtgttcttatgaagtaaggtttttataaccaattctcagtcttgctgctcatgtcagcaatatagacagctatacttgctcataatttttgttgaattacaggttggcgttttttttttttttttttttttttttttaagggaaaaagcctcacaaagccactgtttccataacaaccagaaaagctggccccagtgtctcagctcgctggccctaagaatggctggttgatagtttcacaaaagtcaagggaaatgaagaaagcactgagatagatgcagcattttctagccatcatttgatggaagcttaaataaaataaagatacattcaccttttgatgcctcacccttaactctttcctgcaaagatgcgagttctcataaacaacaaaatgatagcccttgatcgatatagatgcttctttctctagagtatttgtcttaataggactccaaatatgacttcattgcctctactgaacaccacccccaaaaaaggaaacagagaacatgatttggtctttgtttttgcatcggcagagttgaaaacctcagcaagacagatgcctttttatggatgtgaagaagctggagtctagttgcctttagacacctggagggcaatgatctggaggacactaactggaagaaagcataggcatccttaattgttgagaggacagaactggtacctgtgggtagctactatgtgaatggagatgtcagcttggtatgagaatttcataatggtagaacaaggtatcttgagtgacactacattacctactactagaggtgtttggtcggtgacagaatatctattggtcaaactcctgcctttggtcagagtttggactagttgatttttagatcccttgaagcattaaaatcttatgagtctataattgtattaaaaacaagttgcagccgggctcgatggctgacgcctgtaatcccagcactttgggaagccgagacgggcagatcacttgaggtcaggagttcgagaccagcctgaccaacatgatgaaaccctatctctactaaaaatacaaaaattagccaggcgtgatggtgggcacctgtaatccagtctacttgggaggctgaggcaggagaattgcttgaacccgggaggcggaggttgcagtgagctgagattgcgccattgcactctagcctggacaacagagcgagattttgtcttaaaaaaaaaacaaacaagttgcatgttcactgatgtagtgaatgattttagttaaaactaactaaacagcctaaactaatagaatgtgttgtctttcaaagaaaaatctgaatttatgtaaagagagacttgattcagaagaatcattgcaatagaggtgagagggctattgcagtaaggggaacgctccaaccataagatctgcaagggtctcagagatcacacagaaaggaaatttatttcataagatggggtgggtaaacaaagctagaaagaaccaggtatgaaggagtgggtggagggaatggacagttgatcagagatgcttttccttgtggtcagccgattctcagaagcaacccttaaaggagagattctgtactctgggtcaggctgagaataggtcagagttcagggtcttggggaaaggaaagaagcttaaccaaaatttggttatcagttaataagcagtttgattttgttaataatttttgtaattaatagcctttttttttttcttgagacaaagtctcgctctgtcgcccaggctggagtgcagtggcgcaatctcggcttactgcaagctccgcctcccgggttcatggcattctcctgcctcagcctcccgagtagttgggactacaggtgtccgccaccaagcccagctaattttttttgtatttttagtagagacggggtttcaccgagttagccaggatgatctcaatctcctgacctcgtgatccgcctgcctgggcctcccaaagtgctgggattacaggcgtgagccaccccgcccggcccctttattttttaagagtaccgtagttttaggtttacagaaaagtggagcagtaagcacagagttcccatatgtttgctttccctccccacccccacagttgcccctattattaacatcttgcatctatgggatacacttgttctaattgatgaggcaatattaatacattattaactaaagtccatggtttacattagggttcactctttctgttgtatattctgtgagttctgataaatgtataatgaaatgtatccaccattacaccgtcatacagaatagcttcactgccctccaaatccctgtgctccacctatttatcctgccttctccccaaactttcggtaactactaatctttttactatatccatagttttgccttttctagaatggcatgtaatcgcatagtatataggctttctaacttggcgtctttcacttagcagtcagcatttagggttccttggtgtctgcatggcttaatagctcttttctttttatcattgagtgatattctcttgtctgcttggactataatttgtttatccattcacctactgcgggacatcctagttgcttctatgttttgacaatcgtgactaaagctgcagtaaatagccatgtgtaggattttgcatgggcatctcaactcatttgtgtaaatacctaggaccatgattgctggattatatggtaagactatctttacattttttaaattgccaaactatctgccaaagtggctgtgccattttacattcccagcagcaatgaatgagagttcctattgctccacatcctcaccagcatttggtgttgtggtggtgtcagtgttttgaattttagccattctaataggtatgtaatggtatctcattttcttaaattcacaattccctgatgatataggatgttgagtgtcttttgactcatatgcttattttccatttgtatatcttttttcaaatttcattttagatacagggtgtttatgtgcagatttgttacatgggaatattgagtgatgctgaggtttagtgtgtgaatcctgtcacccaggtagtgagcatagtaccccccaccctctagtattccacagtgtctgttgttcccgtatttatctccatgtgtgctcgatgtttagctctcacttataagtgagaacatgtggtattttgttttctgttcctgtgtaatttgcttaggattatggccactagctcatctgtgttactgcaaaggatgtgatttcttttttatagctgtgtagtagtccatgtgtaccagattttctttatacagtctaccattgatggacatttgggttgattacacgtccttgctattgtgagtaatagccatcctgatgatgtgagatggtatttcattgtggttttgatttgcatttctctgatgattagtgatgctgagcattttttcatatgtttattggccacttttatgtcttcttttgagaaatgtctgttcatgacctttgctcattttttaattctgttatttggtttttgcttattgttttaactccctatagagtctggatattaggtctttgttggatgcatagtttgagaatatctcctcctgttctgtagattgtctgtttgcttcgttgatagttttgttgttgttgttgttgttgttgttgttgttgttctgtgtgtattgttgcttttgtttttgtttttgcttttgcttttttttgctgtgcagatgctctttagtttaattaggtcccacttgtttatttttgcatttgttgcaattgcttttggagacttagcaaaaaaatatttgccaagggtcaatgaatgaaaccaagacttgattctttggaaaagtaaactagattgataaaccactagctaggttaacaaagaaaaaacagaagctccaaataaatacaatcagaaatgacaaagatgacaccacaaccgatcccacagaaatagaaaagactttccgaacatcaggaacaactctatacacacaaattagaaattctagaggaaatggataaattcctggaaacatacacaatctcctaagattgaatccagaatagattgtaactctgcataaaccaatatcaagctctaaaatgaatcagtaataaaaaaacccaccaaccaaaaaaagtactagaccagatggagtcacagccaaattctatcgaattatacttctttctaccaaaagaagaactgatatcaatcctactgaaagtattccaaaatattgaggaaggactcctcctcaactcattccatgaagccagcatcaacctaataccaaaatctggcagagacacgatgtagaaagaaaacttcaggccaatatccctgataaacatagatgcaaaaatcctcaacaaaataccagcaaaccgaatccaccagtacatcaaaaagttaactcaccacaatcagctgggcattattcctggtatacaagattggttcaatatatgcaaatgaataaatgtgattcagcacataaacagaatcaaaagcaaaaacaatatgatcatctctatatttgcagaaaagtctttcaatgaaatccaacatcccttcatgataaaaaccctcaacagactaggcatcaaaggaacatacctcaaaataataagagccatctttgacaaatgcacagctaacatcatactgaacagccaaaagctcgaaccattccctttgaaaactggaacaagacaaggatgtccactctcaccactcctattcaacactgtattggaagtcctagccagagcagtcaggcaagagaaagaaataaaaggcatccaaataggaaacaaagtagtcaaactatctttcttcattgataatatgattctatacctagaatatcctaaagactctgccagaggctcctagaactgataaatgactttaatacagtttcaggatacaaagtcaatgtacaaaaatcagtagcatttctatacaccagcagtgttcaggctgagaatgaaatcaagaacagatcctcactttctatagccataaaacaaaacaaaacaaaatgaaatacctaggaagatagttaaccaagatatcttctacaaggagaactgcaaaacattgctgaaagaaatcggagatgacacaaatacatggaaaaacagtccatgctcatggattggaagaatcaagattgtaaagatggccatgctgcccaaagcaatttacagtcagtgctattcctatcaaactaccgacataattctttacagaattagaaaaaaactattctaaaattcatgtagaacaaaaaaagaccatgaatagccacagcaatgctaagcagaaagagcaaagctggaggcatcacatacctgacttcaaactatactataaagccacagtaaccaaaacagcttggtactgttacaaaacagacacatagatcaatggcacagaatagaaaactcagaaataaagcctcaaacctacaaccacctgatctttgacaaggccaacaaaaacaagcaatggggaaaggactccctatttaataaatggtgctgtatatctttttgatgaagtctttaatgattaacagtttttcagtttttttttttagtggtggcctaggatttaccatatgcatcctagattttcatattcagcttttgatttaaagtagcttaataccatttatatatatactcctatatagttttattcccttcccccacttttgtggtattgcacataccacaaaatatatttagtacctctagtaatatatagtgcatatatagttatattgttatatatagtgcatctagtaatgttacagatgcaacaataggttgttgtaatttttactttaccatctgtagtcatttccttagcttagtaaaagctttgttttcacccacctcctttgtgcaaatatgttacacatatattacatttctacatattataagcccaacattttattatacacattttatatgactgctttttaaaataagttattaaaagaaaaaagcaaatatgcatttatactgtattttataatttcttacttatcttttgcagttcctttttttttttttaacatggatttaaattaccctccatagtcagttgctttcatgccaaagaaattgcattagtagttcttataagtcaggtctgcctatcaacaaattctctcagtttttgtttatctgggaaagtttttatgtcaccttcatttttgaaagctagctttgctggatatagaaatcttagtgggcagttttttcttcaaacattttgaatatgtggcctccattgtttctgctgttagttttattggggttctttgtaaattactagtcatttttctcttgctgttttcaagtttttcacattgttactgacttttggcattacattgttatgtactttcagatatattattatgatgtatctgtttgtggatctctttgttttcatcctacttagaatttgttaagcttcctgaatgtgtaggttattgtttttcaatgaacgtaggacatttttagccataatgtattaaaatattttcactctcctttctctcctcttctggtcttctctttgtgcatatattgggctgatgataactccacatttctctgagactgtgttcacttttcttcattcttttttctctctgttgttcagcttgcatgatctctattgaactgtctttaagtcaccaattcttctgctggctcaaatctcctgttaagcctgtcttgtgaatttgtttcagttgtagttttcaactccagaattttcaatcattcttttttataatttgtatctctttattgatactgtctctatttgatgttatattgtcatcataccttcctttactttgtaaaccatgctttcctttagttctgtgaggatatttacagtgactattttgaaatctttttctgttaaatctgacatctgtttactcttccaggaagtttgtttcctgcttttttccctggggtttgatcatactttcctatttctttgcatgcctcataactttttaatggaaactggacattttagaaaaatatattgtataccctatgtactggtccccctacccccagggcttgttattggtgactggctagatgaatttagtaaagtctatttttctccacaatattaagcttctgatattgtttctcaagtaggcgtagccttgggtatgtctgcagtcaccctggaatgacagtggtattggctgggctctggttttgttgttgtttgtttgtttttctctgaccataccacactgttaagctctacaaattgcctgatgattgctctattgtttccactaacgccttaggacataaattgtttataaactaatccagtcaaattgcagtttcttttaagtaatagtttctgggagctagttttgatatttcttctgacctcacaaggtctcctgcagttgtctttttcctcagttatcttctgcaaagtagccagcctgtagtctaggttgtattttcattaaatccacaagtctcttcccagttgcatttcaccactaactccactgttcttaagaacacacttaggattgaaattctctatattcagttgcaagtgaagtcagttcctctgggaaaagattaggagttatttattttagaacctacttctttcccaaggaaaaatctctgagctggggctctggagctgaggatagggacaatggcaggcttttctctgaatgtcatcccccagtctagttgttgaatgctgttggaagcacggaggggcagcagcctcaggtgagagcctaagcagccccctggactgcctctcctggactcataatccagggcaagggtgatcagagaccgaagattttcagtgcacagcctccagggtagagcttccattccatgagtagaggcttccagaagaagggaacccccattacctcttgactgcgctcagctaggacttagccccagcaacatggatggcaggatgaaaaataccaatgtcctgctcctactgggaagaaagccttccaactgtgatcttgggataaagagagcctgctgttcttggttgcagtagtgtggagttctaccttactgagttctgaaggtggggaagggagcagtcagttcacaaaccatagtcatcaaaatttcatagtgtagggaggatagtttcttcatttggtctttaaatacttggagttttcgttttatagttttcaccagtttttatttggagtttatcttaatccacttgtattgctataaaggaatacccacggctgggtaatttataaagaaaagaggtttattttgctcatggttctgcagtctgtacaagcagcacgtaccagcatctgctttcggtgggagcctcaggctgcctccactcaaggcagaaggcaaaggggagccaacatgtccagagatcacgttgttaccaagaaaaaggggcattgctagcctgatacgttagaagccaacgctatgacactgtggggttttttttttggaaaagaaatgctttttattataaattgactaacagggagacaggagtccagctcaaatctgtctccctatgctggctttaaggcagtaattttattagaaaaggttcagggggtagattctgggattagcaggtgattagtagaagaaaagagaaggtctggaaagtcctcagggatgcatgtttatctctgcatgctacctcatgggtctcatgtgcaaatttgggaagaattagtatgaaacatgcagtagaaattgggctggctgtgacatcagcgagctcattctgcacaaactccagtcagccatgttgcttctagccaatttcaacctgttttttaatctcacaagcagaggaagtttcagcattttagcaaattgttccttatctgctatcttgcaaactcaagaatttctgttagtcgtagattgtttttaactctttgggcattgtttcaacatggcaagaggagcaccaggagagggaggggagggaagtaccaggctcttttaaacaaccacctctcatgggaactaatagagtgacaaatcactcacctcccaccctcagggaaggcactaatctattcatgagggatccacctccatagcacaaacacctccattaggcccctccaacattggagctccaatctcaacacgagtgttggagggaacaacatccacactatagcagagctcctcaggctgttgtgctagaagaagcctctctcctcatccattttaacaagcagtgttctgcctctgcttgaaaaccaccttcttaaggcaggatattccatctttggaagctctaactaagataattcttccttgtagtaggtgatgccaattgatcctggtccttcccctaagacctaccaaaaatagcttaatccttctgttagagaacagactttccagtccttcatgtagctgaggtcctgaatctccagcccttggtggtctcttgtccaggcagaacatccacaatccatttcctctatctactccaccctatcataccacatctccttgagtattaccattgtacttcaggtgaggtcattttagaacaaaatgacatcatcatcttccttactctacattctgtttctgtaaatggaaccaaagcacataaacttttttagcagccattttgcatggttgattcacagctaacatactgatatcaaactcccgattctgttcacatgtgctattcatgcacatacccttggtttctggagccaagtgcaaggcattgcttatattgtttcagtttctgacccttgggaatcatttttttcctcccaaggataggcctcttttccctttaagccattgataaaatatttgtatataaaaaagccaaggttggccaggcgcggtggctcatgcctgtaatcccagcactttgggaggccaaggcgggcagaatacctgaggtcaggagttcgagactagcctggccaacatggtgaatccctgtctctactgaaaaacacaaaaaattagctgggcatggtggtacgcatctgtaatcccagctattcgggaggctgaggcaggagaattgtttgaacctgggaggcggaggttgcagtgagctgaggtcatgccattgcactccagcctgggcaacaagagcgaaactccatctcaaaggaaaaaaaaaaaagccaaggatagagccttacagctcatcatcagagacttagctaacatcatttattagctcccatgctaatgcaactgagagctaatggctgtgggttttgcgcttgttaatatgacacttcagcttgagtagttgtctgttcccactcagattgtcatatgtgtgtcttattatggggctgtgtgtgagaccatctcggtgccagtagttctctatactatcctatgccctctatggaagggaactccctcagcaaaacaggagttgcctcacggctaccgtcttcttggatgttgagattattgatcgagttacaaataggcctttcccctccaacatgtttcctgatgaagcttttaggcacttcccaaaatacatggcagttatcttctttctcttcagtatgtgtgacagagccactagcagcctgttactgtgcattaaaagaactcagtaggccgttcttaattgtgctgtgctgaattatcacccgtttgtaaaggtcatggaatttgaacagagcttcgcagattgtgctgctctaatgtgtgtggtgttttctgatggctgacattctgtcactgcagagcgtagccttctgcctggacctctgtctcaaatcaattgtgccagccctgaaagctcccacttcttcatacagtatcaaacattggattgggcatgtttgggaaacagtgggactctccattggctaaagcagaagggaaggaggaggagatgaatgtgaaatatgggcaggtgcttggtgcagtctgctggggctgacaagtcacagccttgggacttttatgttttgttgttttctacaaatatcctaggtgtgttctagttagaatttacatttcttccatcctaatattgaaattttgctccccggttttccatgaaatatcaactgatggtgggtattattccagacatcataacacctccttaaaagagagcccctactctgtgttgttgagcatctggattgtgttgtcttcctttagagacttttgaggtttttttctggcaagctattactattaaatcagccacgtatttttgaggcttattttgaagttctgctagggcagatccccggagtatccctttccctagtacatgccctgtaacaataaatctttctggatttttttaagatcttcctgtactgacaaaaggaaaacgtaattatggaatggccacagtatgccacgtggcaagactccaggtttgcacaggagagtggcccctggaagggggtcagtctcactgtcatccatcagtgtccccgtttgtaatggtcctgctctctgtcctggcatctcaggataatgatgactcaggaaaatacctccgttacattgtgggtggcagcatccggcagtgattttttaatgtttgggaatttgagcttcccctgcctgtgaagtagatacactgagatggccacccctttccaaccctgtcaagaaaacaggaagcctctcatgaatttgaccaaggagctacattcgttctctaaaaattcaaactgtattctacattttttaatccatttttaaaaaaatatataatgagatgatcagcttttgtcaccacagattttcccccaagctgttgcctttcaaagcaggttgggcaaggaataccaatcctgtgtgggaacagtatgtgggtttcaaagactttaaaccaattgggggacattttcttttgtgagggagcaaaaacaggtgaccaacaccaaacagaagatacttaggttccctcatctaatgacacagccttcacctagtgctaaccttatgatggcaccacacaggatcccggtaggcactcgggcagatgtagcatcagcccctacagacacagaccaggcaacccagggtgtccgcgagcagcccatgaaaccgtatacattcagagcaccttatgtttgtcactaacatgtcatagtgggctttagggttagacctgttatcaagagttaccctgtctcttacaagctgtattttaatatgtctaaacttcagtttcctcacaggtaaattagagaaaataatttctccttcattgggctaatgtatacattaaacacaaacgcagctagcagaaggccagagactaatggacaacaggaaatgagctttctccatttcccttcccagcccttccctcacaagaaagagccttgtaaggtaggctgtgcagagatttccctgtttgtagttgagacaactgatatgagggatatcaacacaactaattagtgtcagagccaagttcagacttttttctgtgatggcagaaggcattcgtgaacgcctagtgtgtacccaaaactgtcatgacattgtatgtgaaatgtctcactgcagaatgaagcttagttcttaacactgggctttggtctaggcttccaaagtcatttttaagcagaacactagtagctatatttatttccattagctgctctctcgttctctctcatgggtcttttgtttatactttatagaatgatgggatgagttttgaaattaaagcagaatcatgaaggatccccagaaggagggcaggtgtccgtcagtttcacaggagcttgattaggcaaattgacccaggcaagtcctacactgctcctcacacaaccttttgggtcccttgaaagtgactttcggctgggcacagtggctcacacctataatcccagcactttggaaggccgaggcaggcggatcaccagaggtcaggagttcaagaccagcctgactaatatgatgaaaccccgtctctactaaaaatacaaaaattagctgggcatggtggcatgcatctgtaatcccagctacttgggaggctgagacaggagaatcacttgaacccaggaggcagaggttgcagtgagctgatatcgtgccactgcactccagcctgggcaacaagagtgaaactccgtctcaaaaaaagaaagaaagtgactttcgtcaggcttcttccagactgctgccgagagaatggcagacgaaaggcatctctggaactggactgtcccaattcagatctgggctccaccaccaaccagagtgaccttggcatatcactgaatcccaggacctgagtttcttcacctgtaaaataacaataagaaaagtacctacctcgtagggtttttgagatcattaaatgagatgatccatgctaagtacctgtaacagtgactggcacatggttattacacgatcgataaagtgagccgctgcagcaggggagggagggttgtcgcatctgagaaaacgtaaaccagtgtttttcccctgtgctgtgaacggtcaccatgttgtttctttttaattgtggtatcgaagggcttgggtttttaaggttatttttcactgagcctttcagtctgtctctgtggcctcaagcactcgcctcccttagaactgctcattctagggtcatgactactactctaaatgaatctcctgcagagactttctgccacattttcccctcctctctctaggcagcttagcaacttgtctgcctgttgtagtatttcattacctaattcattattagctgggacctactgagagttttgaggcattggagaatgagggtctatgaagagtcaggttcaatctgagagcaaactgtgttgtggatgggaatttagaaaaggtatttcctggttgcagaggggaaggaggtgtgtggcttttcctttatctctgaagccaaactttgatttaggcaaaacttttaactattaaggacctccagtgtgaaacagcttaggtggtggcaaaagactggctgaggctataagagatacaaggaaagatttgaaagtgaggtggagggcaggcagggagaaaaggtggaaatatgcttctcagtccactcgtcctactccatctccaccttcattgccaccagtgtcaatacaaagtggcccgtgtctctcgcaaactaggtttgatcttctcatgtgttagtgtagaaagataattaggaaaggaagtgttagggttttgatttcaggatcttagtaattgtagagagtaagaaacgaacaagccgagctcaggcttctgtgactgtccgtgtcttcaagtatgatttggaaggcttcgtgtccagtatccctaggagtagtaccatccctgttcttgagaacttgccctgtagggtggcagtggatcatggttgttttcctatatcagagcttgatatgtttgttaagaggtctgtgaccgggcacggtgactcatgcctgtaatcccagcactttgggaggccgaggcaggtggaccacctgaggtcaggaattcaagaccagcctgaccaacatggtgaaaccccatctctactaaaaacacaaaaactagccgagcatggtggtacatgcctataatctctcctactcagctgaggtagtagaattgcttgaacctgggacgctgaggtttcagtgagctgagatcacgccactgcactccagcctgggtgacagagcaagactccgtctaaaaaaaaaaaaaaaaaaaagaggtctgtggatcctgaaagccctgatttgttttcttccttccagcggatgtagttactgctcccacttccacatctgtgagtcactgagctttgcaatgtgctggcaccccatgttagcccaacacccctctccctggggctctcagagatcatcaggacctcgttttccacaggatttcctttaatgctgagtactacaaggtcatttccagggttgccactgtttcttcctctcgtattcactacagtttaatttttagctcttaacactggactttgttacatgggaagaaagaaatttgctctaacagacagcagcaaatgcatttttccttctcttccagttggaaaatcactcctaaccagttttatccttggggaggtttagtggtctgagaatacttttatgtttttggagtgaacagagattatgttcatatttggttgcttcccctttattttttgtctgaccttaatttggcatctgtagacggaaactgttacttatcttcagggctgccatgtatctttgtgacattgcccctaatttgcttctgaatatgcagtaaaagataaaagccatgattaggctcagtaaacattactgtttttcttgaaactttcatgccctaaatgcctgttaatctcatggtgcccacctcttccctggatggtggagtgtggcctgaggtggcattgccctttgatcaattggaacaaagactcagaggagagatgtgacctcctcaggttatacagggagctggtaacaggattggagcccatgtttcctgatttcatcccattgttctttctagggggacacttctctctgggagtataaacaacacaatcgcagtaattactgccattgattgaacatcaaatagatgccaagcccatacattatgtctaattttcataacaattctgcaaagtagagttttacagataaagaaactgagactgagagaagctaaattccttgcccagagccactcacctagtcttgggcagagtccagattgagcccaagtgtgtcagagccctgccctgtgttcttactgcatggcgagggttggtcacaacgccagtgataaatagtaagaaatcagaaatctgcatgccggccctcccatcccttcatttgatcagcagatgatgactctgtggctgctctgtgcaagcacagtactgggcactggtgagcaagacagagggagctgaccttagcagctctcatttccataaagttttccctctcacactcggcataccctctcctgcacatcccccaacctccttcattacccagttttgcctgtgcacgttgctctgatgtccccttcctttctgtttctgtagccacatcaggacgagggccacatgatgttgcttcttggagactggctctgtgcgcagtacctgcgggccttcctgtgctctctagttagtagcgctcagtgagaacttgcagagtcccgtgcatctgctacgtgttctgtgtgcattaccttcttgaatcttcatagccactttatgtgatgtagctatagtcattatccccatgtgagcaaaaacaaacaaacaagcaaaaagtacccaactcggagaacttgcctaagattatgctgctagtaattgctaaagccagggtttgggcttaggctgatgaactctgcagtgcaggctcttacccaccaacctgtgcagtgcagacgcttgggacaggttcatgatatagggcaaagaaaaacgtccttttaccaatcttatacataaacaaaaacacttctgaaatcaacttttaactatgggtatctctgaattgtaagaaaagctagcgtatactgagccctcgcctggtactaggcaggcgacactttaaatatatatctcatttaatttttggtaatctcaaaaggtaagcattaccccttccttcccacaggtgaggcaattgaggcttagagaagtgaggtgacttgcctaaagttacatagcaggttactgtcagaactagtatccagattctcctctgactccaaagcttatggccgcctcccccaggatcccatttcttctctctgcatatgagctggatcaggtccactgagagaagaaccgcagtttggcaggtcccaccacaataacaggtggaacaaaacatggctgctgtaagagcaggctagaccggcccttttcccaaaagcagcagacgaatcttgcaaccccataggtggcgaccagctttataatgagacagggatgagatttttaaatgacagtgcgtctcctgttaccatgacagagaaaagcggtatctttgctggccgtatgaagtgatggacatgggaatgcaaggctggaaggaactaactagctctgcataatggtgccaaagagggatcaagaaacctgaaaggaacctatacatacgggacatttggagactccattgggaaaagggtccacagacaggtcaacctgcagccacaccaaggagggatcttaggggacgtgccgatttctaactcatgttcagtatatatctcactaatagctggtagcatggattgttttcaggagaatgaaggaagcaccatgttatgcttcagcatcgtgtagagcaagttgagaggctgcctagccacgtgatgttgttaatcgtatcggtttttatttttcagggaacctcagaacctgttctggatccacagcaaatccaagcatttgatcagctttgccgtctctaccgaggaagctccagggtaatgtttgcgtggttgtttatatttttatttccctatttatagtttactgctttagacaggcagtgtcttggaacctccctctagcctccttctagcctggaaggtgccctggcatccctgttatggctacatggacaacagaccctggccccaaggagcactcagagcttggcaaagagagcaaaggaagtagaaagctgtctgtcccctacgtaccatgagctgtgaggacacagaagggcctctgtgtttgacctccctccagagagagcaggccagaaggttgatcccaggagggctttgcttaggatatggataggtgcccaatctgtccgaagccctagaccctcctgggcatctgcactggttgaattagttttggccatgaaagacaaatgcaaagtagtagtggtttaagcaagagagaagtgtaaatgcagccagccagggcacatccacgtacctcccttcagctttcttctgtcctgttgctctgccttccttagcacatgacttaaactcgtatggttcaacatggttgcttccacttacctccactgtctagaatttagacccatgaccatacctcactgcaatggagactgggaaaattgatttttattccaaaagaccttgggctacaattcttggtctaatctaactgtggaagaagagtacagactggagggcttctatcagtcactgccaccacatcagaccgggtgtcccccaggcactttggacatgtactcatcgctttctcgacctgttcttcatgcctggtgcctgcctcaggaatgatacctctgtcatccaaccacctagagcagagacctggcagcactaggctcactcctcaccttcctgccacctgactggggacatcctgtgggatcttgtctactaatccctcttttaccactaccccgggtggggcctccttatcactcacggaggccactgcaggtcttctgattggctagaaacccttctgtcccctctccatgctgctgcctggctaccctttctaaaaccaagtatgtcatgttactcccttgcttataacacattctggatctccaccacctaaagaatgagtccaaaccctaccatcttcttcactccccaaatcacacctcaattctaggtggtcccatttgttcctgagcttgtctcgagcttgtgcaaactgctgtgtcctctgcttctctacctgggcccccttcacgcactcccctttcttaggcagaacctactaggttacttggcagccggaggaaagagtggtgctccttctttgagagttggtgtgggcagaggttgttattccaggaagtttctctaggggtctcctggatgcagtccagcagctttattgaactggcctcacccccatccctttccagcctcagctaagctctgccccaggagttgggtttctgggccttccaaggaggttcttctgcttcaaactgttgagcccttatttaaggctcattgatttccggatcacaaagttaccaaagtggaacacaaaaatatctgttttcctgggaaataattttttttttttttttttgcaattgatcttcccacctcacagtgtcaggatgtgaaagcattgagttgagcgtctgtggctcattctgttcaaggcatcgtacataacagtcattgcagagaacgtcgcaggctgatgggcaactgagagggttacggaagaaggaagtggcacgaagtggactcttggcccctggagtagtgcttgagtcagagttactgagttgtgaatgagaccatacatgtgtctctgggccaggacctggaccacttttgataaattgacacttagaacttaggggccttcagatgtcttcccagttaccacagccactggtactgagttttccacagaagtgacacatggacacgtgagcttgtgccaccattgcctgtgtgagggaaaaaccctttgccagaggtcggagggcacctcgaagacatggtgcctggcgggtgaatcccacaccgccactcactgctggtgaccgagggcaagtcactgtgttgtgaaggatgagaaataacacacatgtcaaggatctagcaaagtgcctgtcatggaaagacacttgatacagtcaccagaggttgttagacatcccctcggactcctggagtgtttggtagacacagacagggctgccctgaggagtctgatggccccctcgtctcagctgtacactccccatggaccaggctttcactggcctccatgtgagcctacacagggtcccttagagtgttggtagtggacacagtggcccatcccacaggtcccaactactgttattagggaccattttgacctgggctctgagttctccttcacattagctctgtggggtggaagttaactcacaatgttctgggaagcaacaggcaaagaccctaatcaggcaggaagtctaaggaccttgggtgtagaattcgtctctcctctgaccatcaagggcacctcaagagccaggctgccagctccctactttcgcagaaagcctctttaggtgaaagggatggtccccctgagtggcagagcactggcttcccaacaggccgacattagcatctcctcctacccttctgtcctccttggcaggtcttccagaattgagccactgacagaacgagggtactgctagtgtcattggtgggaataaggaagctgggagcaaagaggactcacttgaaggagaaggtagaatccaggggttccactctggaacccctgagtttgagttggcagctgggtgtctgtttgaggccttccaggttacagaagagaggtcagagccagtggtcataattagtcattcaccccgaggagagtgcaccaagatggagaggttggaacaagcagagctgagaacagagctcctcagcccagggcgcgtccacagggagagaagggtggcagcagggccatccacagcagctggaggagccctcagcacagggccagcccagggtgggagagctctccagtgccagagagagcacagtttgagtgcccttgggagcaaaccagtccagtctcattattgaatgaggaaatttagaccctaaaaaatgaagtgaacttgcccaaagtcacactgctcgtttgtgatatatggacctaagattcaaaccctgcatgttactactcctgcaacacagcactgtctctcatgtatctgaagcagtggattcaggagcctctcttccctctgctccccacaaaccttagctgatgtgtgtccttcctttgcagctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttctgcaggtctcctggctggctggctctcagtctgtcaagtcatggaggacatttcgagccctgttgtcacaattttattagctcaaagtcaggaatcctgcctgtgacaaccctccttaattcagataagcagctccattgtcagctgtattcagagcagcccagccacccatatgctcccgtgacaggcgctgggctgccaaagagaatagtactcagtttttggccatgggacttcgtatatcattgaaccaactgccacaggaggtcgccacacccagacacctaggtttccaccttacatactcagatgatccttttctcagtgcaatggaatcgtcaggctctcatggactgatactaaccaaacccacaggaaatagatacataaactaggtagaaatttttttttttttgagacagagtttcactcttgctgctcaggctggagtgcagtggtgctgtcttggctcactgcaagctccgtctcccaggttcaagtgattctcttgcctcagcttcccgagtagctgggattaccggcacccaccaccacgcccggctaattttttaatttttggtagagatggggtttcaccatgttggccaggctggtctcgaattcctgatctcaggtgatccgcctgccttggcctcctaaagtgctgggattacaggcatgagccaccacacctggccaatagaaatttttaactcttaaatagaaaatagatcttgtttctgccatgtactacgtataatcaacaaatcagttaacctctctaagcctctgtttctttataaacagaactgttatgaagaggaaataatacatgtaaacatttgctatgtgccattgaggcacatggcaaataccccagaaatgctagcttagcttttattatataacttctcccaagacctgggctacaagggtactgcttcctgatgaaggtgtcaggagataaaattgagggaagtggttgaaccattaagtcatcattgcttggatgcctgccgcagctatatgacagtctcaaccccagctgacagatgagaaagctgaggctcagaggtgataagtaatttcaccaaggtaacctaccaaagaggtagcagagcaggtggaattcagagttgtgattccagagccagtgatgctacctgccccaagttatgtatcaaaaggtttctcattgagcctaaaataaggccaaaggaacttgatgttctcaaagcaaaactcaattattccttttcttcttttatagtgtaaagaactaaggcaaaggagtattcaatataaaaaagcaaattgtgacatcaaaaacatgaaatgtatgtgggaagggtgaagtaaaagcagaactttatgcaatcaaaataaagttgtaataagtttaaaatagcctgttataactaagatgttggccgggcacagtggctcacgcttgtaatctcagcactttgggaggccgaggcaggcagatcatgaggtcaggagttcaagaccagcctggccaacatggtgaaaccctgtctctactaaaaatacaaaaattagctgggaatggtggtgcgtgcctgtaatcccagctacttgggagactgtggcaggagcatcgcttgaactgggacctgggaggtggaggctgcagtgagccgagatggtgccactgcactccagcctggggtacagagcgagactccatttcaaaaaaataagtaagatgatttatgtaagcctgatggtaaccacaaagcaagaaattatagtaggtagataaaaagcaaggaataaaaagtataccactagagaaaatcatctaatcagaaagaaagcaagagaggaggaaaggaacaaaggatctacaaaacaatgaacaaaattgcagtggtaggtccttacctatcaataattaccttgaatgtgaatagatcagatttgccaatcaaaagacagagtggctgattggattaaaaataagatctaactatatgctgcctaaaagagactcacttcacctttaaggacacacgtagcttgaaaatgaaagatggaaaaagatattctgtgcaaaggaaaccaaaagagagcaggagtacctgtacttcaataaaatagactttaagtcaaaaagtgtcaagtgagacaaagttatataataataaaggggtggattcatctagaacataaaacagttgtaaatatatatgcacccaacatcagagcacccaagtctataaagcaaatattaatagagctgaagagagaaataaactgaaatacaataataggggacttcaacaatgattttccagacagagaatcaatagagaaacactggatttgaattacacattagaccaaatggacctaacaaacatacacagaacattccattcaacagcatgagaatacacgtttttctcaagtgcacattgaacattctcctggatagaccatatttaagccacaaaacaagtcttaacaaatttaagattgaaaatcataacagtatcttttctgaccacaatagtatgaaactagaaatcagtaataggaattttaaggaattcacaaatctgtggaaattaaacaacatgttcctaaagaacatgggtcaaagaagaaatacaaaaatttttaaatatctggagacaaatgaagatggaaatatcccataaaaatatcatttatggtatgtggcaaaagcagttttaagaggaaagtgtatagcaatgaagtcctacatcaagaaagaagaaaaactccaaataacctattggcataacaacctaaagaactataaaaagaacagactaagcctagagttagtaagaggaagaaaataataaagatcaaagcagaaataaatgaaatagagactagcactagaaaaataattttaaaaaatcaatgaaattaagagggttttgtttgtctgagacaggctcttgctttgtcacccaggctggagtgcagtggcacaatcactgctcactgcagcctcacccttctgggctcaagtgatcctccctcagcctcccgagtagctagaactacaggggcacgccaccatgcccagctactgttttttgtttgtttgtttggtagaggcagagtctcactatgttgcccaggctggtctcaaaaaactcctggctcaagcaatcctcccacctcagcctcccaaagtgttgagattacaggtatgaaccactgtgcctggccaaaagttggttttttggaaggataaacaaaatcaataaacctctaactagactaagaaaagaagaagactcaaaatcagaaatgaaagataagacattacaactgtaaaaaggatcataagagacgactgtggacaagcacatacacgaacaaattggatagcctaggtaaaatagataaattccaagacacatataccacctaccaagactaaatcatgaagaaatagaaaacccaaacagaacaataacaaataattagattgtatcagtaatttaaaagtctcccaacaaagggaagtccagaaccaaatggcttctccacggagttctacgtaccatttataaaataattagtaccaattcttctcaaactattccaaaaaattgaagtagagggaactcttcctaactcattttacaaagccagcctaaccctgacaccaaaaacagcaaggacactatacaaagaagaaaattataggccaatatcccttatgaacatagctgcaaaaatcctcaacaaaatactaggtaagtaagctgggcatggtggctcatgcctgtaatcccagcactttgggaggccaatgcaggtggattgcctgaggtcaggagataaagaccagcctggccaatgtggtgaaaccctgtctctactaaaagtacaaaaattagctgggcatggtggtgcatgcctgtagtcccagctacttgggaggctgaagcaggagaatcgcttgaacccgggaagtggaagttacagtgagccaagactgtgccactgcactccagcctgggtgacagagtaagactgtctcaaaaaacaaaacaaaacaaaacaaaaaactagttaactaaatccaacaatacatcaaaaagattataaagataatacaccatgatcaagtgggatgtatcacaagaatacaaggatggctcaacatatgccaatcaatatacatgatacatgacatcaatagcatgaaagacaaaaactatatgatcatctcaatacctgcagaaaaatcatttgataaaattcaatatcctttcatgataaaaaaaaaaaactctcaataagttaggtatagaaagaaagtacctcaacacaattaaggacgtgtatggcagactcacagctaacatcatactgaacgaggaaagactgaaaggttttcctccaagaaatggaacaagacagggatgcctactcttactactcttattcaacatagtatggaagtcctagccagagcagtcaggcaagagaaaaaaggaagtcaaattgtcactctttgcagacaacatgatcttagaaaaacctaaagactcttatcaaaaaactcatagaactgataaatgaattcagtaaagttgcaggatacaaaatcaacatgcaaaaatcagtagtgtttctctaataacactagctgaataaccaataacaaactagctgaaaaataaatcaagacaatcccatttacaacagctacaaaaaataaaaacaatctaggaataaatttaaccaaggaggtgacgggtctgtacaacgaaaactagaaaacactgattaaagaaattggaggtcaggtgcagtggctcttgtctgtaatcccagcactttgggaggccaaggtgggaggatcacttgagctcacaagtttcagaccagcctgggcaaatggtgaaacctcatctctgccaaaaatacaaaaattagccaggtatggtggcacacccctgttttcccagctaaaagggaggcagaggtgggaggatggcttaagcccaggaggtggagattgcagtgagctgagatggcaccactgcactccagcctgcataatagaaccagaccttgtattgggaaaaagaaagaaagagaaaagaagttggagaagacacaaacagacatctcatgatcatagactggaagaattaacatttctaaaatgtccatattacccaaagcaatgtacagattcaatgcaggccctatcaaaataccaatgtcattcgtcattgaaatagaaaaaaaaatcttaatatgtgtatgggacacaaaagaccctgaacagccaaagcaattctaagcaaaaagaacaaagttggaggctcacactaccagacttcagaatatactacaaagttatagtaaccaaacagcatggcaccagcataagaatatacatagacagaatagagaacctagaaatcaatccatgtatgtgatttttgacaaagccaactgatttttgacaaagacaccacatacacttattgggaaaaggacaccctcttcagtaaatgatgctgagaaaactggatagtcataggtagaagaaagaaactagaccccacctctcactctatacaaaaatcaactcaaaatggatcaaagacctaaatgtaagatccaaaactataaagctactggaagaaaacataggagaaacacttcaggacattgatctgagaacagattttatgactaagtcctcaaaagcacaggcaataaaagcaaaaataaataggattatttcaaactaaaaagcttctgcacagcaaaggaaataatcaacagagtgaaaagacagcctacagaatggaagaaaatatttgccaactgttcatccaacaggagttgaatatctatatccagaatatataggcaaggcgtggtggctcacgcctgtaatcccagcactttgggaggctgaggtgggtggatcacttgagtccaggattttgagaccaatatggtgaaatgctgtctctacaaaaaaaatacaaaaagtttgccaggcattgtggtgtgtccctgcaatcccagctattcagaaggctgaggtgggcagatcacctgagtctaggaggttgaggctgcagtgggccgtgatcatgccactgcactccagcctgggtgacacagtgaggccctgcatccaaaaaaaaaaaaaagaaagaaaaaatgaaaagaatatacaagaaacatgtcaacagaaaaaaaattttgtaatgagcaaataatatgaacagggatttctcaaaagaagacatatatagccacagatagatgatgaaatgctcaatatcactaatcatcagggaaatgcaaatcaaaaccacagtgtggtatcatctcactccaggatgactatgatcaaaaagacaaaaaatatcaaatgctggcaaggaaagatgtggagaaaagggaactcttatacactgtcgggaatgtaaactagcacagccactatggagaacagtatagaggttcctcaaaaaaactacaaatagaactatcatatgatcctgcaatcccacaacgtggcatttatccaaaggaaaggaaatcagtatattgaagagacatctgcaccctgatgtttattgcagcattattagcaatagccaagatatgaaatcaaccttaggtgtccaatgacagatgaatggttaaagaaaatgtggtatatatgcacaatggaatattagccgtgaaaaagaatgaaatcctgtgatttacagcaacacagatggatggagctagaagacattatgttaagtgaaataaggcaggaacagaatgtttaacaccacatgttctcactcatatgtggaagctaaaaaagttgatctcatagaagtaaaaagtagaacagaagataccagagactgggaagggtagggagaagaggggaatagggagagattttttaaaggatacaaaataaatagcaggaggaaaaagttctagtgttcagcaccactgtaggatgactatagttaataatgtagtctcaaatagctataagaaggaaattggatattcccaaaacaaagaaatgataaatgtttgagatgatggttatgctaattaccctgatcagatcattgcacattatatgtattgaaacattactatgtacctgatatggtttagctctgtttctccacccaaatctcattgaattgtaatccccagtgttgggagaagggcctggtgggaggtgactggatcatgggcatggattccccccttgctgttgtgatagttctcacaagacctggttgtttaaaagtgtgtagcacttccctcttcacactctctcctgccgccatgtgaggaagttgcttgcttcccctttgcccttctgccatgatcgtaagtttcctgaggcttcccagccatgcttcctgtaaagcctgcagaactgtgagtcagttaaacttctttttttcataaagtacccagtctcaggtagttctttatagcagtgtgagaacagactaatacagaaaattggtaccagagaagtggggcatgctataaagatacctgaaaatgtggaaggaactttggaattagataacagacagaggttggaacggtttggagggctcagaagaaggcaggaagatgagggaaagtttggaacttctagagacttgttgaatggttttgaccaaaatgctgatagtgatatggacaatgaaatgcaggctgagatggtctcagatggagatgaggaacttattgggaactggagcaaaggtcacctcaaaggtcacttgctgtgctttagcaaagagactggcagcattgtgtccctaacctagggatctgtggaactctgaacttgagagagatgatttagggtatctggcagaagaaatttctaaacagcatagtgttcaagatgtggcctgggtacttctaaatgcctatgctcatttgcataaccaaagagaacttatatttaaaagggaagcagggcataaagtttggaaaatttgcagcctgaccatgtggtggaaaagaaaaacccattttctggagagaaattcaggtcagctgcagaaattttcataagtaaagaggaactgaatgttaatagccaagacaatagggaaaatgtatctagggcatttcagagaccttcacagcagcccctcccaacacaggcctggaggtctaggagggaaaaatggtttcctgggccaggcccagggccccctgctctgtgcagcctcaggacatggcgccctgcattccagctgctccagccatggctaaaaggggccaagatacggcttgggctgttgcttcagagggtgcaagccccaagccttggcttcttgcatgtggtgttgagcctgtgaggcttaggaacctccacctagatttcagaggatgtctggaaacacctggatgtccaggcagaagtctgttgcagggtttaggccctcatggagaacctctactagggtggtacagaggggaaatatggcgttggagcccccacacagagtccccactggggtactgactactggagctgtgagaagaaggccaccatcctccagaccccagaatgatagatccaccaacagctcacaccatctggaaaagccacaggtactcaataccagcccacaaaagcagccacagggatggagctgcccaaggccatgagagcctgccccttgcatcagtgtgtcttggatgtgagacatggagtcgaaggagattgttttggagctttaagatttaatgactgcctgttgggttttgggctttcatggggcctgtagtccctttgttttggccaatttctcccttttgatgggagcatttacctaatgtctgcactccccttgtatcttggaagtaactaacttgttttttattttaaaggatcataggcagaagggacttgccttgtctcaaatgagactttggacttggacttttgagttaatgctggaatgagttaagactttgggggactgttgagagcatgatcggtttcaaaatgtgagaaggacatgagatttgggaggggacaggggcagaatgatatggtttggttctgtgtccccactcaaaactcatgttgaattgtaatcctcagtgttgggggagggacctggcaggaggtaattggatcatgggggcagatttccctcttgctgctcttgtgatagtgagtgagttcttacaagatgtgtttaagtgtgtatcatttccccctttgatctttctctcctgcaaccacgtgaagaagttgcctgcttccccttagcccttccgccatgattttaagtttcttgaggcctcacagcctgtggaactgtgagccaattaaacctcttttcttcataaattacccagtctcaggtagttctttatagcagtttgagaagggactaatacagtactccatcaatatgtataattacatgtcaattgaattttttttttaaaaaaagatattacaactttcatatgggttgtgcatctgctagtgctcttttctctctctctctgtccctctctctctgcctcccccatctccctctccacccccctccccctctccccatcctttcccctctctccttccctccctccccttcttaactcacccaggaggaagccagttgccattttgtgagcagcccaatgtacaggcccataagggaaaaactgaagcttcttgccaacaaccacaagtaagctgggaggcagatcctgcagtctcaatcagacatccaagtgactggtgccccagttaacagcttgactggaatctcatgagagaggttctgagccagaatcactcagctaagatgttcccaaattcctgaattctgaaaactgtatgagataatacatgtttattgttattttaagcaacaaagtttgggagtaatttgttatgtagcaataaataatactgtttgcttcctagggggaaaaaataaaaaaacaaagctctaggcatcatactacctgatttgaaaactaactacaaagctataacaaatcagtatggtactggcacaaaagcagacatagaccaatggaacaggacagagagcccagaaataaatccacacatttacagtcaattgattttccacaaaaatgccaagaacacacagtggggaaatgataatatcttcaataaatggtgctggaaaaactgaatatccacatgcagaagaataaaattggaccttcatctcacaccacatacaaaaatcaaccaaagtggattcaaattttaaatgtaagacctgaaactataaaactaccagaagaggccaggtgcagtggctcacacctgtaatcccagctcttttgaaggccgaggcaaatagattacttgagtccaggagtttgagaccatcctgggcaaaatggtgaaaccctgtctctacaagtaatacaaaaaaatttatccgggtgtggtagtgtgcacctatagtcccagctactagggaggccgcgatgggaggatcacttgagcctgagagattgaggctgcagtgagccatgatcacgccattgcactccagcctgggtgacagagtgagaacctgtctcaaaaaacaaacacctgtcaaaagaaaacacaggggaaaaactccatgacattggtctgagcaaacatgttttgaatatgatcctaaaagcattggcaacaaaggcaaaaatacaaacacaaatgagattacatcaaactaaaaagtttcagtgcagtaaaggaaacaacagcgtggagagacagcctatgggatggggggaattatttgcaaaccatacacctgataaggggctcatacccaaaatatctaaggaactccgtagcaagaaaataactcggtttttaaaatgtgcaaaggacctgactaaagatttctcagaaaagacatacaaatggccagcaggtgtatggaaaaaatgctcaacatcactaatcagagaaatgcacatcaaaaccgcaatgagataccacctcacacctgtcagaatgcctgttatcaagaagataagagaataagtgttggtgaggatacaaaaaaaaaagggaactcctgtacactgttgataggagtgtaaatcagtatgggcattatggaaaacagtatggagcttccttgaaaaattaaaaatagagctaccatatgatccagcaatctcacaacggggaatatatccaaaggaaatgaaatcaatatgtcacagagctgtctgcattcccatgttcactgcagcagcattcttaataccaaagaaaaggagtcagcctcggtgaccaccaacaaatgaatggatgaggaaaatgcagtctatatccacgaaggaataccactcagcctttaaaaagaagcaaatcacactttgggaggccgaggtgggtggatcacgaggtcaggagatcgagaccatcctggctaacacagtgaaaccccgtctctactaaaaatacaaaaaaattagctgggcgtggtggcgggcgcctatagtcccagctgctggggaggctgaggcaggagaatggcgtgaacccaggagatggagcttgcggtgagctgagctcgcaccactgcactccaggctgggcaatagagccagactccatctcaaaacaaataaataaataaatagaagaaacagcagcaaatcctgtcatttgtgacatcatggatgaagctggaggacattatgttaagtgaaataagctagccaaagaaagataaatgctgcatgatgtcacatatagggaacgtaaaaacgtcaaactcagaaacaaagagtgaaatggtggttactggaggctgggaggttggggagctgttggtcaaaggacacaaaatttcatttaggaggaataagttgagatctatcatgtatcttggtgattacagttaataatatattgtatatttgaaaattgcaaatggagtagattttgtttttaccataaaaatataagtatatgaggtaatacatttaaatagcctcatgtagccatcccacaatgtatacatatatcaaaacatcatgatgtgcgccataatatgtcaaattgtacttgtcaatttaaaaaataaatcaaggcagtttatgggattatcaggacctctgttcaaaccaggaccagcacacaccaacaaattattcttcctcagcccctttcctattttatcagtccccaagagttcctttagttgtcattcaagtcacagcacaattgagtaaattgcagcatctttacattcaggtcatgcctccctaagcatatgctttggattgggtttgaagagccctctcgtctcatctaatggtagatgagacacaggcttgagagctgggcagtgctaggccctggggatgtggcaggcctgagctgagccccagttcttgccatcaggaagcctgaccctgtcccatcttgtggcacttagcgcacgttctactagcaggtccctgggagcaaagtctcttatctggaaatatctttagactcagcaatagcacctggttctgctgatattgacttgggagcttggaggatcacagagcaggctaggagccaggcccaggatatgaaaacaagcagctgcacctgccttgctccagccccagggggctccagctgtgttttcaggtcacatgcccaccacttggctatgatgggtgataaggaggatctgggaagacccttcctattaccatttggggaaggcaggtaactggtctgaacattctcctgccatcctgccccctgcgatgaggagatgatccctggataagggcactgacgggagaggggagggcatttgagttgtccaaaaaacagcagtgtccatcatagctttgtttctcctttgtacctggtgatatggtttggctctgtgtccccacccaaatctcatctcaaattgtaatccccagtgttagaggaggggcctggtgggaggtgattggatcctggtggtggagctctggtgaatgggttaacaccatcccttcgccactgccccccccaacccaacggccccaggctcccttggtactgtatagggagtgagttctcacaagacctggttgtttaaaagtgtgtagcactggctgggcgcagtggctcatgcctgtaatcccagcactttgggaggctgtggcaggcggatcacctgaggtcaggagttcaagaccagccctggtgaaaccccgtctctcctaaaaatacaaaaattagctgggcgtggtcgcgggcacctgtcatcccagctgcttgggaggctgaggcacaagaatcacatgaacccaggagacagaggttgcagtgagctgaggtggcaccgctgcactacagcttggtgacagagggagaatctgtctcaaaaaaaaaaaaaaaaaattagctgtgcacggtactgtgcacctatatagtcccagctacccaggaggctgaagcaggaggatcacttgaacccaggagggggaggttacagtgggccatgatggtgccactgcattccagcctgggcaacagagtgagactccatctccaaaaaaaaaaaaaaaaaagtgtgtggcccctccccacctctctcttcctcccattccagccatgtgaagtgctggctccgccttcatcctccaccttgattgtaagtttcctgaggcatccccagaagctgagtaaatggcgtcatgctttctgcacagcctgcagaatcatgagccaattaaacttcttttctttataaatacccagcctcaggtattttatagcagtgcgagaatggaccagtacacctgacagaatctgaatgtgtaaccacccagtggattcttcctgccctcttcccagagagagctgatttatcaagacaggggaattgcaataaagagtttaattcacccagagccggctgaacaggagattggagttttattattactcaaatcagtctccctgagcatctgaaggctagggtttgtctaaagtagactgtgggaaggggtggggataggtagccaacgggtgcttgctgatgactggttggggatgctatcataggggtatgggaaatggtcctccacgctgagtcgagtggcttgctaatctggacgaggccacacaagaggctgtgggtccacgtgggaccatttgttgtcaggcatgcaaaaaacccaaaaagatatatctaaaggccaatcttaggctctacaattgtgatgttacctgcaggagtaactggggaagttgcccatctggtggcctctggaataacggctggcaatggtctatatcaacaccttagcagacagaattcaggctcctctatcctcctagcctggtggtctctcattagctaacgagagaccaagttgactgtacaaaggcagttgagtattggggaaaggctattatttaaactaaagtaaacatcttccaaagttagcttggcctaagcacgggaataattaagggtagcttgaaggccaaagacaaagtgagggttggcaggcgagatcttctacactgccggaattttctcactgttaacaagttttgcaaaggtggtttcaaatggatgcgtctatatcacacctgaagatagttacagtcaatttccagcttcacggaattctcccctgcgcctttttcttccctttgagcctccaggattgctcaatcgttcccttgggcaagacactgggctggctgcggtgaacacaaaagggagccgtacacagccctgccctcaggcacctgccggctggggaaggacacgttcagcaggaaacgctcccatagctctttaagcatttgtttctattgttatactttagttcttaaaaaagatggcctagaggttctttgctttcaggttatacatttgttcaggtgggatgtattgtcccaacctacctctatgtgactttgttcatttattttgggcacttttagaagagaatctgggcttcgacctttgtgaagattcactcttaccaggtgctatttgtcatagcctctgttttccattctgcttttttcacattttattatccaaagggaggttttttggtttggttttttgagacgaagtctcactctactgcccaggctggagcgcaaggctcactgcaacctccacctcctgggttcaagcaattctcctgcctcagcctctcgagtagctgggatcacaggtgcccaccagcacacccggctaattttgtatttttagtattttcaccatgttggtcaggctagtctcaaactccttacctcaggtgatccacctgcctcggcctcccaaagtgctgggattacaggcatgagctactgcgcccggtcaggtttttttttttatatatgaaaactctgaagtcctcttactaggagcattaccttcctcctgatggtataaacgagcacaggttttcatgttgctatggtttgaatgtgtctcctccagaattcaggtgttgaaacttaatagccaatgtgttaagaggtgggggctttaagcggtgattagagtgtgagggcacctccctcgtgaatggtaataaggccctcataaaagaggctgcacatagtattcagctggcttgcctgcagccagctggccccccgttccggaagatgctgcaatcaggcgccatcctggaagcagagagcaaccctcaccagacaactgaacctgctggcacctggatcatggacttcccagcttccagaactgtgagaaattgagtttctgttctttataaatcacctagtctcagatatatattcttgagagtcttgctctgttgcccaggctggagtgcagtggtgcgatctcagctcactgcaacctccgcctcctgggttcaagcgattctcctgcctcagcctcctaagtagctgggattaccggtgtccgccgccacgcctggctaatttttgtatttttagtagaaacagggttttgttgtgttcgtcaggctggtctcaaactcctgacctcaggtgatctgcccgccacagcctcccaaagtgctgggattacaggcgtgagccactgcgcccggccagtctcaggtattttgttatagcagcacaaaaacagactaagacatgtttttatagatatctgcacatgtttctcaagtttggggtttattgaagggcctgatgggcggtgtacgtccaagttcctggtctccgtgacgtgggctaactgtcctaacattaatcaagaactgagccagggagggtgagtggaggtggggaaagggcctcggagggcttttctggcaggaggggtgccaggctgtgtggttccttcaggacttggggccgctggcagagtttctggcttatgtggctctcggtccaggggcatgtggcagggacggtgggtggggtggcatctggacaccacaactggcccaggcttctgccccacctggaacccgtgtgtgccagcttctgggtgtgtgtgcaggctctgttcaacttgctgggcttccaggcagggcccggggcgaggtttctgaaccagcagggttgagaatcactgtggttatcagtccagctcggttacacaccccacccggcctatctgtgtgtaaatggcctagacaccctttttacaagctgtaatgaaggataatagcagccaccagctgcaaacaccactatgcacagccactttattctcccccagtcacctgggagggtagctgctattatctccattttcctcagaaggaattggcttcagagacctgccagctaacgagttgtatttggagcttggggtgtgcgacttccaatttacctggaatgaacagtaaaagccttaccgggaaagcatgtattcccgcagaatggctgtgtgtaagggtgtttaaaagctcctgcctagttcccagggagcagctccccacgctcgctcagtgcccgctcagaggtgtggctgcgcaggggccatccaagggcagcaggaatccacaacccgctttccctgaaacgaggcccgcagaacttgtgagagaggcccgctagagtgcactgccagggaccagtttgtaacctgtgctgtgtgtgtgggaagtcagaggcgctgagaagggcctgcaggtgggaaagggctgattctgccagacgagggtgccctgcagggggtgctggttgtctaggaggacgcccaccgtggagggcttctcctgggccacgtgtctcgcgtgccctcttgcagctgctttcccagcccctgaagtgtgtgacgtactaaaagaagctgacccctggggttatgcaggtgcggtcacattcccagagtgaggaccggggaatcctggaaaaaatgaccagcctgtctcctactctgtttaaaaaaaaaaaaatgtgtgttggggaggccggtgctccccgctgcgggctgcagtgaggatctgcagccactctgttgaattcaggcccacagtcagagcctgtcggtcagtggttatttcctgagtgccaagtatatgccaggcgctgtcctttgcaatggggacaagcagggagtaggtcagacatggtctcccctctggaggggacagaggtgacaccctgcccacacaacacagcctgagacattgtgacgtggagggtgtgccggctgagggcacgggagggacctgaacctgtgcaaaacttttcctatttttaaaatttggactcctccatcttgcttctgatctaatctttcatttctttacccagcaaaggaatagaaagaaaacaaagttctctgcaagtcaccattccgcagaaatcagagcagatccctgcagaagttgagcagcagcttagaatgttggagtcagtgaattctagcatccaggtgacctcagagttcacggtgcccccttctcccacccaaacacaggcaccagacttggccccaggggctgggaaggagtgggagggaggctctggggtgagtgttccaggaagcagaggacaggaagcattctgtgtccagcagagagctctgcagccaccaggggcagctacgttctcaagtgctgtgtgctcagggaagagtctgcccagagtagagatgggccctgctcagcatctggccgggcatacagaaggcgaggctgaattggcagggctgacacggtgggtcagtgcggggacgactcaatcagcaggggaagggcttcatggagtaggcggcactgtcctccccgctgagaaggtagacagggaaggagaggcgacagcctgagctgagcccatcagtggggagtcacctgcagatgacaggcccatcctgtacccagtcagttctgactttacggaacccttgtcatggcgctaacgttgctctaattcacgattgtcctgctttattctacggagctctgcaggagacatgtttgtgggagagggtggagcaactcggccttcacaccctagccagtggcgtgaaggaggcggtgcttggagggacccctggtgcccctgcatctgcgccttcctcctgccatcagggggatggaaactcgcccagctctccaggaggggcagtgtggcccactgggaagagcgaggcacagccccatcatggcccctgtgtgagccgaacaaggcactgggcctctgaaaaatacagaacataaaagtgatgtttcatctgcagcaaaggtcccagcaacgtgtgggaaaatgctttacaaaggtcacatgttacttgtggaagaggaaagcccacaggggcctcatcaatgaacactgcagtgaataaatcattcagagctttgggaatccttctagaagcagtgtatttccactcagctctgcttgctgaaagtgtttttccaaagatgcagctccagaatcagatgtccgtgacttgcccagagctgcaggaaaggcttcctgcggtgccatcttctggccaggcggggcggactccaggcccccggggtgggggtctgagctcccaatgggtggccccagctgatcagaggctccatcccaggggcctcctctctcagggccatccatggccatctttctgccaccagtctcctcacaccacatcctgggtcctctctaaagctttccccaaggaaaacggcagtttgacacctgtccacctgctccagggacacaccacacctatgccgaggaagcgagttttcccatctccactcctcctgagggcaggactgtgtctggctcactcctgtgtcatccctggcacagtcaatagttaccgagtgccaagtatatgccaggcgcttggtgagacagagtgcgtgttgctgtcctttaagtcactatcgagtaaacttatgaacagagcgttcacaaaccatacgtg

SEQ ID NO: 1771 - DNA, 52226 bp, Homo sapiens
  HRG gene - 187866500 - 187878725 of chr3; NCBI Entrez Gene ID: 3273; Build 35; sequence includes 20,000 bases upstream of initiation codon and 20,000 bases downstream of termination codon of the gene
gccaccgtgcccagcctcaaatcttaaagaagagaagaaaggtgtgagattatgttttcttaataactaaatcatggtacatggtttgatcagtgtggggatttgcggaacaacagatatgtgccttgacaatgcctctggtgacatattgtttctgtagatataacgctgccaaacctgagtcttttccctaggcagaaatgtttgatttttatgtctcaactcttgtctcataacagtgggtggtcggcccttcttactttgtggaatacttaattaaagaatcaccatgtactaaatcccaggccagcagctgttcacttcagtcctccgactctgtggtgagttttcctgaatgtcttcataatttgagtgttcacagatcatctctaagtgtttgtggagcataaattacatatgaggtgtcataaggcatgagatgcttttcttcccctcaaggagcatctgactagttagagattagacagatccagactgcattcaattgtaagtgcaactttcatcagtagttgcaaaagtgattatatagagctgtaaaatatagacatctcagtgatgggtaatggccctgcttcagtctaacacaatccaattacgtttgtaatatagcatggtgttccattccttggaccactctttaagaaggacaaagtcaaataggccttcattcaaagaggcatccaagagggaaagtatgccttgaagtcatctgaaatacacctggtgggaatttaacttggcacaatgtgttggagtgcaactgggcaaaatgcaccaaaatacttttcctctcatttacttacagtaacagctttattaagaaataattcatacgttgtaaaattcatccatttaaggtgtacagttcagtagtttttagtatgttcacagagttgtgccaccatcaccactttcttattttaggatattttcatcagcctcagaagaaacctcatgcccactaacagtcattccccattgccaccttaccaagcccctggaaaccacttacctactttctgtttctatggctttgcctattctggacatttcatataaatagaatcatacagcatatggtcttttgtatctggcttctttcacttagcatagtgttctcaaagcttctccatctataaataaatgtagttttacctctttgcataatttattatgcaaataatattttattgcatagatattgtttattgtttatccatctatcagttgataaacatttgagttgtttcctgctatgaacaagtgtacaagtttttatgtacacatatgtttccatttctctcgagtatatacctcagagtggagtttttgtcatatgaaaaacaacaaaaaaatgctccatgtttaaccctttcactgctatactgttttccactgtgaatgcatcagttttgcaatcccatcagcaatgtatgagggtttcaatttctccacatctttgccaacacctattatgatctttcttttggttatagccatcctactgggcatgaattggtacctcatcatgatttttatttgcattttcctaataactaatgatgctgagcgtcttttaatgtgtttattatccattagtatgttttctttggaaaaatgtctacataaatcatttgcctacctaaaatccagttgcttatcttttcattgttgaataataagagtctttacatattctagatacaatgtccttatcagatatatatttttaagtatttttctgtcattctctgggttgtctattcactttcttgacaacgttctttgaaatacagaagttttaaattttgatgaagttctatttatatatattttttcttattttgaatatgcttttaatgtcatatctaagaaaccattgcctaatccataatcaccaagatttacatgtgtaaaaatgcaagggatccagaatgccaaaataatcttgaacaacaacaacaacaaaaaaataggaagacatacttcccaaactcaaaacttactacaaaggtacagtacttaagacagtgtcttggtggtataagaatgatatgtagatcaatagaataaaattgaaagtaaagaaataagcccctatatgtaggcctatgacacattttgagtttttgtacacggtgtgaggcagggagttcaacttcattcttttgcatgtgaacttccactgtttccagcactatttgttaaaaagactattctttcccccatgtagttgccttggcatacttcttgaagatcaattgatcataaatgtaagagtttatttctttaatctcaattttattccattgatctacacttctaagcttatactggtataacactgtcttgaatactatataactttgtagtaagttttgagattggaacatttaaatcctcctattttgttcttcttgttcaagattgctttgggtatcctggatgccttgaattctcatgctgattttaggaccagtttgtcaatttctatttttaaaaaggcagttggaaatttgatacatttgattgcattgaatctgtacatcaacgttgaaagtactgtcatcttaacaatattaagttttcaattccatgaatatgtggtatctttccatttgtttagaactcatttaatttctttcaacaaagttttgtagttttcagtgtacaaaactttcatttattttggtcaatttactcttcaaatattttgttctctttgatgcttatgtaatgaaactgtcttcttaatttcatttttggattgttcattgaaagtgtgtagaaagacgattgattttttatattgatcttatatattataaccttgatgaactcatttattagttttaatagtttgctagtggatttcttaggattttctatatgatcatgtcacctgaaaagagatagctttttacttctcccttttaaatctggatgccacatgtgttcccagcctctagggctcacatgttcagcacacttataaagtccctttgtgatccactccagtgtcagcgccaggtaggcctatgaactttggtagctcagcaaatcctagctagggtgggagtggccagatctccttggtgcaagtacctgcagtttctccagaaggttctctgagagcccctcctctttgtgacttggtgatgaagagaaggaaaaggctgaagcaccattccccagacacttcatactttaatggcttttcccactttaaggaatttctagtctttttttcatatgctctggagctgagtgacaaagtaatatttaggcaatctgtttagacactttttttctttttgtagatttagggatacaagtgcagttttcttacattaatatattgcatagcggtgaagtctgggcttttagtgtatccatcacccaaatagtgtacattgtattcagggtggtttttgttttttgtttttttttctctttttgagacagaattttgctctgtcgcccaggctggagtacagtggcgcaatctcagcttcctgcaaacctccacctcctgggttcaagcgattctcctgcctcaacaacccaagtatctgggactacaggcacctgccacctcacctggctaatttttgtatttttggtagagacagggtttcaccctgttgaccaggctggtctcgaactcctaacctcaagtgatcctcctgcctcagcctccaaaagtgctgggattacaggcgtgagccactgcgcccagctcaggatgatatttcatccctcaccaccctctcaccttttggagtcttcagtgtctgttactccactttgtgtccatgtataccctttctttagcttccacttttaagtgagaacatgtggtttttggctttctgtttctgagtcatttcacttagaataacggcctccagttccatccatgttgatgcaacggacatggtattattcttttttatagctgagtggtattccatgggtgtgtgtgtgtgtgcacacacacacatgcacatcacattttaatctaaccatccattgatggacacaacatcggcttcacatatttgctattatgaatagtgctgtgataaatatacaagtgcagttgtctttttcttatagtagtttctttgttggcgggggtggggggggggggtaaatcaccagctgtgggattgctggatcaaatggtagttctatttttagtttatttttagataaatttagtaaattttatgtggatatacttaagagctcttctttagaaattgaggcaacattttattataacattctatttatgcttgaaaatgtacatacagtatgactctaaaattcctcttctaggaatttattctaaggaagtaactaggaatacatgaaaagatatagcttcaatgtttaaacaacagaaaaattagattcaatctagctgtccaacaaaagagagcttgttaaacatcacagaggaatactatgtagccattattttaaaaaccctagaagatcattcaatgccataagagggtttttacaatatattgttaagtgacaaaatagagttataaagtaatatatatataatatgactctattttgtagaagaaaaatgtatatgcatagaaaaaaagactggaaggaaggaaatcaaatcactgcaggtaacaaatatatttcatgcaatttacaggtctttattttcttttgtttatctatattctaactattacatttgtaataaggaaacaaagctactttacttttaagtaaagagaaatttaaggagctgagagtggttttgtctgagaagagaaatgtcaggtggaacgcacttaaagggctgctatataaaagatgaaaacacgttttctaattgacccaagggtagaactaaggccaagaggtagaagttgtatggacataactttccactcaacacaaagaatttttttaacaaacagagtttcattcctcaagaaatactgagtttctcattattggaggcaatttagcctaatttggatgatttcttggtaggggtgatctagaaagaattgactcagagtctacctgttacatagtagaagcataaaaatgttgattggctgtgtatctacacaagtagaaagctagttgatttccatctgtgatcactggtaatactcacatgacattgtattttctcttttagcctgttggtctttgcaaaggttctctgactcgaacacactgggaaaagtttgtctctgtgacttgtgacttctttgaatcacaggtatttttcaatctaattgcctgtctttctgtgaagaagagcagattatcgatagttacctgccactaccttaccccctcctttgattttcccaaccaccttgctcaccactttgcgcaggctagcctgagtccacatccacaggatagccagtcaaagacctgttatgccttgtttcagtcgcaatatggtcctgcagaataagcaagacaaattcagaaacagggaactgctggcttggatgtgattcaagcctctgagacattaaattcagcgtcccaaagaaaccttacctcaagccacagggagaagttatttccatgaaaatattcaatccctttccagaagtgtttattgcgcacttattataaggtagcctggtatatttgagaggcagtttatatttgaggtgtatttgtgcctggtatatttgaagcagttgaaacaggacacttgggatccagttttgctctggtacctgtgagctgtgtaacaggcacacacttacctgttcgagttttggttgcctcatttataaaatgggattgcgacactgcatcattcagatccctgtgagaagcaagtgaaaggacctgaatgaagggtgctgtacaaggcctggtgcagaataaacaagcaaggaaaggcacctgctgcttccactactgggaacagaaagagagcttgctggagacttcgagtgagtcattgaacctctctgggccattattcagctctgaaattgtgagacttacagtctcacagtcaagcttctacaggtcctggttccccctggcccttatctgttttgttttttaaccctttcaccaggaggcccatccctctacctagtctccctttgaaatgttccaacagaaaggcacagatcagcttaggctggtactaggcatgggaggactttccctgtggaactctacattcaaaaatgttctcattccaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgagccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggaggcgtgagcaactaatgcccagcacagtttcagtccctaaattccctttaattccaggacaggtattagctgcgtagggcccataccatttccaaccctctacctcttttcatctgtctggaagtctccaggtctcaacagtggggtaattcacttagagctggaggcacatagaagggaagtgcacatgtggcctgtgctagacactgtgggagcagcagaccgtgacagttctcatcactgttacaatttctctaggacagttagaggagggctcatcacagcattcaattacagtctacgttttccttctttcaaacactgcagggccaatttcccctcattcagtgatacctatgtgcacacgcacacatgcacagcagataagactttggacattttgacagagaatttgcagatgcagctattgtcctctatcttggtggctgttagaagaggcacacaggcctcagcataatttgcataagagacgtagacaatgttcacactctgttcctcttatctgcttctcataagaaggaagtgattatgtgggggtgtcatgtggggtcttacaccgtgttggtcagggtctgaaagaagcagaattgtactcaggtggctcaactaaaaagacttcagttggctcagcgtgctggctcatgcttgtaatcccagcactttgggaggctgaggcggccagatcaccggaggtcaggagtttgagaccagcctggccaacatggtgaaaccctgtctctactaaaaatacaaaaattagccgggcatggtggtacatatctgtaatcccagtcactcgggaggctgaggcaggagaatcgcttgaacctgggaggtggaggctgcagtgagctgagataatgccactgttcgccaccagcatgggtaacagagctagacgccatctcaaaaaaagaaaaagacttcagtgaagggacctttagtgaaggcttgttgcccaggctaagggaaggccaagggatgctgaggcacctggacagcctttgccacccgaggctgagcaggagcaggagtggctagcttccccgctctgttggaactatcctgtggagaagccgccctgcagaagccgccctggtggagggatgcagcccctgcagaacccggtgctggaacgagaaggagcagggaataagcaccctcccctctccctcccttcctgtttccttccaatctcctcctcccaatggctctttgaactcaatggtaaactagccagcagggagagcctgggttattcaattccctggagccagcctgggagacaagaccaggcagagaaaatcaaaggatgggcctgaggcaaacagagagaaaccattaggagccttagctggggtttcccaaggggtgttctataaggcccttctctactggtaaaaggatggggaagggcctcagactttgtttctccttctatctaccacctcctttgtctttccatggcttaattcgtgaaaaactagattgttcccatgcttgccacttccccaccacctcttcattccttaggtcacagtaatgtgaatctatctcttttcccataacccactgacttggtgttccctaacaatcttttattttaaattaaaaaaaaaatttctgttcacttttacttacactttcaagcatctggcaatgctgactttgcttgctcttcagattttttcaaggagattgtgtcccacagcctccaggtttttcttctagctttctgaccactccccctcatatcccaccttgggctcctcttctctggctcatctcttagatgctgtttctctggctttcagtccttgatctttttttcttactctgcagactcagtgcagacaagctaatctgcatccttgtcaatagttgcaaaatgctgcatttattactgatctgaggctgttgtgttcaagtcatcagtagtttgcaaattgctaacactaatcttctacgacaaaatttcaggagctgagtatttctagttatacaatattaagagttacctcagctgaatgtttaaaaagaacatattcaacaataggaaaatgagcaacccaatttaaaaatgggcaaaacatttaaaaaaaatgagatcgtgtctttcgcaggaacatggatggagctgaaggttattatccttagcaaactaatgcaggaacagaaaaccaaatatcgcatgctctcacttataagtgggagctaaataatgagaacacatggacacatagagggaaacaacacacactgggacctactcaagggtggagggtgggaggagggagagggtcagaagaaaatgactgtttggtagtaggcttagtacttgcctgacaaataatctgtactacaaacccctgcgacatgagtttacctatataacaaatgtgcacatgtacccattaacttaagatagaagttaaaaaaaataaaaataaaaatgggcaaaagatttaaacctcaccaaaaaaaaaaaaaaggtaagtgaacatctgaaattctgaacttcagtgaacttcatatgtcatcaaagaaatgcaaattataacaacgagatatcactacatatccgtcagaatggccaaaatccagaacactgacaatactaaatggtagcaaggatatggagcaaaaggaacttctcattcattgctgctgggaatgcaaatggtacagccactttggaagacagtttggcagttactttcaaaacttaacatactcttatcatatgctccagtagtcacactccttggtatttacccaaatgatctgaaaacttatgtccatagaaaaacccacacatgaatattcacagcacatctgctcataattgctaaaatttggaagcaacaaactgtccttcaccaggtgagtggataagtaaatcctgacaatggaatattatttggcacgaaaaaggaatatgaatatcgagccacaaaaagacatggaggaaacttaaatacatattactgagtgaaagaaaccaatctgaaaagattaactactgtatggttccaactatatgacatttggaaaaggcaaaattatgaagacagtaaaaagatcactggttgccagtggttagcaaggagacagggatggactatgtggagcacagaggatttttagtcagtgaaactattctgtatgctactacaatggtggatacatttcattatacatttgtcaaaacccatagatgtacaacatcaaggatgcatgctgatgtaagccatggactttaggttataactatgtgtcagtgtaagttcatcggttgtaacaaatgtgctgctagtgttcagaggtttatagcaggggaggctgtgagcgtgaggggcagatgtagggactacataggaactctatactcgccactcagctgtactgtcaacctaaaactgctctaaaaattaaagcccatttttaaagtaaattaacaaaatggatacattaagcctgataaaaactgcattttctttaaaaagtgactcctattacaaaaaaattaaatgtcataaaattctgtcaaccagtctagtgattctcaaagacatagtcagagatttacaaagaggtccactgtagcattacttataagaacaaataattggaaacaatatacatggccaaaaattggggaatgttgaatacattaacacgtacataacatccaatattatgtaacctcaaaaataatctttctgaagaatatttaatgatctgagaaagtcctcatggtataaccttaagggaaaatacaatatttaagccatatataacaagggatttttaaaagtccttctcttgggaaagagtttgggaggtaaagaatggaggaaagagacttaatttttattttacaatattctaaaatattgtttgcttttttactttgtgcagggattgtgtttatgactaaaaactgtatacttaaaataacaaaattttaaaatcctataaaaacacaaaaacatttataaagcttatatggtttctattaatacctgaaaaaaatagaggttataagtaaatacatgctcaactacagtggagggaaagaaacacctgtatgtacagaataattctaatgatgcaaaacatatatattacatatattcaaatagcaaaaagtgtatgaagcaattatgcattataaatagttggttttccttatggttgtagaattagaggtgaattttctttatgcttttcgtattttccatattttttgcaaaaagcatgtgttctattatgagtcaaaaaggtttaaagaataaaaattctgttagctaactcttttttctgatacaatggtcaggacacacagaaataacctaaatgcagaatgaaaatgtgaagacggcagggcgcagtggctcattcctataatcacaccactatgggaggctgaggcgggtggatcacctgaggtcaggggttcgagatcagcctgaccaatatggtgaaaccttgtctctactaaaagtacaaattttagccaggcgtggtggtgggcacctgtagtcccagtactcaggaggatgagacagaagaattgcttgaaactgggaggtggaggttacagcagtgagctgagatggcaccactatacaacaacctaggcaacagagcaggtgagactttgtctcaaaaaaaaaaaaagaaagaaaagaaaaggtaaagatgaagattctacctgcccagtctgcccagatagtgtcaggcctctgagcctaagctaagccatcatatcccctgagacctgcacatacacatccagatggccggttcctggcttaactgatgacattccactacaaaagaaatgaaaatggcctgttcctgccttaactgatagcattatcttgtgaaattccttctcctggctcatcttggctcaaaagctcccctactgagcaccttgtgacccctactcctgcctgccagagaacaacccctctttttcctttacgtacctaaatcctataaaatggccccaccccatctcccttcactgactctttttggactcagcccacctgcacccaggtgattaaaagatttattgctcagacaaagcctgtttggtggtctcttcacacggacacacatgaaatttgctgccgtgactcggatcaggggaactcccttgggagatcaatccctagtcctcctgttctttgctccgtgagaaagatccacctacgatctcaggtcctcaggctgaccagcccaagaaacatctcaccaatttcaaatcccgtgaacagcctctttttacactcttctccaacctccctcactatccctcaacctctttctctgttcaatcttggtgccacacttcaatctctcccttctcttaatttcaattcctttcattttctggtagagacaaaggagacatgttttatccatggacccaaaactccaatgccggtcgtggactaagaaaggcagccttcccttggtgtttaatcattgtggggatgcctctctgattattcactcaggtttcagaggtgtcagaccacgcaaggacacctgccttggtctttcacccttagcggcaagtcccgcttttctaggggaggggcaggaaccccgacctcttatctctgcaccccgatcccttatttccatgccccaacctcttatttctgtgccccgatcccttatttccgtgccccgacctcttatctctgcgcctcaaccccttatttccgtgccctgaccccttctctgcttttctggagggcaagaaccccccaacccttctccatgtctctactctcttttctctgggcttgcctccttcactatgggcaagcttccaccttccattcctccttcttcttccttagcctgtgttctcaagagcttaaaacctcttcaactctcacctgacctaaaatctaagcgtcttattttcttctgcaatgccgcttgaccccaatacaaactcgacagtacttccaaatagccagaaaacaacactttcaatttttccatcctataagatctaaataattcttgtcgtaaaataggcaaacggtctgaggtgcctgatgtccaggcattcttttacatatcggtccctccctggtctctgttcccaatgcaactcgtcccaaatcttccttctttccctcccgcctgtcccctcagtcccaaccccaagcgttgctgagtctttccagtcttccttttctacagacccatctgacctttcccctcctccccaggctgcttgtcaccaggccgagctaagtcccaattcttcctcagcctctgctcctccaccctataatccttctaccatctcccctcctcacagccgttccggcatacagtttagttctgtgactagttcttccccacctgcccaacagtttcctcttagagaggtggctagagctgaaggcatagtcagggtacatgtacctttttctctatcacgcctctctcagatcagtcagtgtttaggctctttctcatcagaccccactaaatgtatacaggaattctgatatctaactctgtcctacaagttaacctggagtgactgaaatgtcatcctaacttctaccctctccccagatgaacgggaaagagttttttctctagcccaatctcacgctgataaccgccggcttcacgagccagacctccaggaaggcattagagcagttccccgagaagatccccaatggaactatcagacaaattccccaggtatagctaggtgagattacatgattcctgcctacttgaaaggcttaaaaaggcagcttacaaagctgttaattatgacaagcttgaagagactacccaaggtagagacgaaaacccagcccagttcatggccggcttagcagcaacctttggacgctataccgccctagacccagaagggccagaaggccgccttattcttaacatgcattttatcatccaatccactcctgacattaagaaaaaacttcaaaaattagaatctagccctcaaaccccacaacaggaattaatcaatcttgccttcaaggtgtacaataatagagaagaagcatccagacggcaacgcgtttctgagttacaattacttgcctctgctgtgagacgagacccagccacacctccagcataggagaacttcaaaatgcctcagccgcacacgcctaagccgcagcagtcaagcattcctacaggacttcctgcatcaggatcttgcttcaagtgccagaaatctagccactaggccaaggaatgcccacagcccaggattcctcctcagccgtatcccatctgtgtaggactccactgaaaatcagactcttcaactcacctggcagccactcccagagcccctggaactccggcccaaggctctctgactgactccttctcacattttctcagcttagcagctgaagactgacgctgcccgatcgccttggaagccccgtaggccatcacggacgccaagcttgaagtaactctcagagtagaaagtaagtccgtccccgtcttaatcaatacggaggctacccactccacattaccttctttccaaaggcctgtttcctttgccttcataactgttgtaggtattggcagccaggcttctaaacctcttaaaactccccaactctggtgccaacttagacagtactcttttaatcactccttttagttacccccacctgcccagttcccttattaggccgagacactttaactaaattatctgcttccctgactattcctgggctacagccacacctcattgccgccttttcccccagttcaaagcctccttcacatcctccccttgtatctccccaccgtaacccataagtataagacacctctactccctccttagcgaccgatcatgcaccccttaccatcccattaaaacctaatcacccttaccccaatcaatgccaatatcccatcccgcagcatgctttgaaaagattaaagcctgttatcactcgcctgttacagcaaggccttttaaagcctataaactcttcttaccattcccccattttacctgtcctaaaaccagacaaggcttacaggttagttcagaatctgcgccttatcaaccaaattgttttgcctagccaccccatggtgctaaacccatatactctcctatcctcaatacctccctctacaatccattattctgttctggatctcaaacatgctttctttactattcctttgcacccttcatcccagcctctctttgttttcacttagactaaccctgacacccattaggctcagcaaatcacctgggctgtactgccgcaaggcttcacagacagcccgcattagttcaatcaagcccaaatttcatcctcatctcttacctatctcggcataattctcataaaaacacacatgctttccctgctgatcgtgaccgattaatctcccaaacctcaatcccttacaaaacaacaactcctttccttcctaggcatggttagttcggtcagaattcttacacaagagccgggaccgcaccctgtagcctttctgtccaaacaacttgaccttactgttttagcctagccctcctgtctgcatgcagcagctgccgctgctttaatacttttagaggccctaaaaatcacaaactatgctcaactcactctctacatttctcgtaacttccaaaaccgattttcttcctcatacctgacgcatatgctttctgttccccggctccttcagctgtactcgttctttgttaagtcccacaattaccattgttcctggcccggacgtcaatccggcctcccacattattcctgataccacacctgacccccatgactgtatctctctgatccacctgacattcaccccatttccccatattttctcctttcctgttcctcaccctgatcacgcttgatttattgatggcagttccaccaggcctaatcgccacacaccagcaaaggcaggctatgctatggtacaagccactagcccgcctcttagaacctctcatttcctttccatcgtggaaatgtatcctcaaggaaataacttctcagtgttccatctgctattctactactcctcagggattattcaggccccctcccttccctacacatcaagctcagagatttgcccccacccaggactggcaaattagctttactcaacatgccccgagtcagataactaaaatacctcttggtctaggtagacactttcactggataggtagaggcctttcccacagggtctaagaaggccaacacagtcatttcttcccttctgtcagacacaattactcggtttggccttcccacctctatacagtccgatagcagaccggcctttattagtcaaatcagccaagcagtttttcaggctcttagtattcaatgaaacctttatatcccttacagtcctcagtcttcaggaaaagtagaatggactaattgtcttttaaaacctcagccaccaacttaaaaagggctagaaaaacttttacctctttcttttctcagaagtcaggcctgtcctcagaatgctacaaggtacagcccatttgagctcctgtatagaggctcctttttattaagccccagtctcattccagacaccagaccaacttagactgtgccccaaaaaacttgtcatccctactatcttctctctagtcatactcctattcactgttctcaactactcatacatgtcctgctcttgtttacactgccagtttacactgtttctccaagccatcacagctgatatctcctggtggtatccccaaactgccattcttgaagtaaataaataatctttgctggcaggactacgctgaatctccttaggcactctaattagatgtcctaggtcttcccaattcttagacctttaatacctgtttttctccttctcttattccatttagtttctcagttcatacaaaaccatatccaggcaatcatcaataattctaaatgacaaatgtttcctctaacagtcccacaatatcaccccttaccacaaaatcttccttcagcttaatctctcccactctaggttcccacgccgcccctaatcccactcgaagcagccctgagaaacatcgcccattatctctccataccatcccccaaaatttttgccatcccaacactttaccactatttcattttatttttcttattaatataagaagacaggaatgtcaggcctctgagcccaagctaagccatcatatcccctgtgacctgcacatgcacatccagatggccggttcctgccttaactgatgacattccactacaaaagaaatgaaaatggcctgttcctgccttaactgatggcattatcttgtgaaattctttctcctggctcatcctggcttaaaagctcccctactgagcaccttgtgacccctactcctgcctgccagagaacaacccccctttttcctttacctacccaaatccgataaaacgtccccaccccatctcccttctctgactgtctttttggactcagcccgccggcacccaggtgattaaaagctttattgctcacacaaagcctgtttggtggtctcttcacacggacgcgcatgaaagataccatctgtgtaaagtcagcacttccatctgaggccactctctagttcccataatgctaataggaaccatccccaaagccaaatatcacttactggatcagagttctcaggacagaatgtctctcttactaccattcagcttcctcccaaccattaccatcccagcacccttaatgtgctctctcccctgaagctgctccagttgctagaatggcatcattagtactgtatcactctttaagattcagtaaagcaacaggaagaggatgcatgactccctgaggtactctgtagtctcagcagaacagcactgtaggaaaattatattcctgttcttgatgcctcttcccatcccctcaacattcccattcctttccctacaccagcatttggttcacccaggacaccccatttagggtgcagccaatatagccataatagaaaaacttcattaaggagctcaactcataataacaaaaactcaaaatagtttttgttttaatcaatagctttccccttccccactgggttggagcctcttaacaccttgaccagattccatacattcctgtcattttctgttgcactggactggtcccattgggtatttaaaagccagggttactgacattaaaagttcaattgcaaacattattcaaaacctgttgcactcattaaccctgtgacttgtggaaatgagatctacttttcatacacctcccttttctttctgtcttcaaatcctttccctctcttcagttcactctagaatcccagtaattctcaaccttgactgcacacactggattacctaggagtttaaaaactaccaataccaaagtccactcccagagattctgattaaattgtcctggaggagtccttgacatcaggactttttaaagctcctggggtgattctaacatgaagccgagtctgagagacatgactgcagactctcacagacactcactgcggatagaacagggaggaatggagatgctgcctaactggctgtttcttggcagtgaggacggaacctaggctgattccctctggtcccttctgatgctgctggctctgctggtctgagggttgcatataggtatacgggtttcttctgaagtgtgaaggtagggggtcagctgtatcatagcccagtccccccctgctgatcccttctaacagtgggatgggcatccaactatttgactcttactctcaccaccatcctcttccacgtgaatcaattctttttgcagggaattggggtggcatgaggtgtccccaacttctttgcaggcacactaataataaatagcatcacttattcagcatctactctatgccaagaattatactggttgctttctttttttctttctttcttttttagatggaatctcacactgtcgcccgagctggagtgcagtggcgcgatctcagctcactgcaatctccgcctcccgggttcaagtgattctcctgcctcagcctcccaagtagcggcgattacaggcatgtgccaccatgcccagctaattttttgtatttttagtagagacagggtttcaccatgttggccaggctggtctcaatctcctgaccttgtgatcagcctgccttggcctcccaaagtgctgggattacaggcatgagccaccgcacccagcctgatttcttatttaattatcacacaagcctgccaagaggtatcaatccatatttcgtaaatgagggaactatcagagaagttttgttgcttacccagcattacacagtaagaaagtaatagagccaggtgagaaattcagatttgacttcaaaacgacagcctcttcattgttctattttacctgaagtcattccttttataatggtacctgtttaacatgttcccccgcttagataatgcagctgccttctactgaggagttttagtgccatgatccatcagtccactgactgatgatggagatttccagctgagacaggcaggcagatggaggaaaattacccctagccccaccccctacaccaacataggcactgcttatattcaaagacgtactttagatctgctatctactagaaaaatccagatttgtgcagatcacagttccacccactcatcagcatttctcagctttctgcccccaggacccactaatcatttacagcttgttgatggttatttgaacccagggtcaaggtgaacaccctcagttacacaacaaaaatgtatcaaggttttgtttaatcaattgcgtgtgtttcagaaagtctgtataaaattctctgcagtggcagatcatagcaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggtgaggaattgccaatggcagagctgagttgggagattactcacgggggcaaatgtgactctaccccctaggcttactgctttgcacaatgaatggctttggtcagagttttttgtttggcttctgcggctgctctaaattgttcttttttccttcaaactaatatttgttattagtgtacccgcaactatgattcgatttgtgggtacatataagcatttatgctgagcccagttacatgctaaggactgccagagaaacattagaataagctatgggccttggcctccaggaaataataatacactggcacatacaggcaaacagtgtaagttactaggataaactagagagaaggaaaagttttctcaaccctcctaaggctcctaactgagcctgaaataaaactggtagacaaggccaggcgcggtggctcacgcctgtaatcccagcactttgggaggccaaggcggacggatcatgaggtcaggagttcaagaccagcctggccaacatggtgaaaccctgtctctactaaaaatacaaaaactagctgggcatggtggtgcacgcctgtaatcccagctactcagggggttgaggcagaagaatcgcttgaactcgggaggcagaggttgcagtgagtcgagatcatgccactgcactccagcctgggcaacaaagctagactccatctcaaaaaaaaaaaagaagaagaagaaaacatacaaatttatttaatccaaggtttacctgacactggagtcttcataaatgaagactcagatatccaaagaaactggccacttgcatacttagaattcacaaaggctgtgcagaatgcagaagtgtgatgggacaaaaggctgtaatctaagagtcatagactgaaagaaggacccagcaaggcctctctgtttgagttcttcatggcctctctgtgtggcatttcttgctcccaagtatgggacaggatccctttggaatgcggatctgaggacctactatcaaacagagtaggtcagagaatgtctttatggccagctcctacaaagaaagacacagggggaaggttagattcatattttaggatttatggatgctttcggggagagggattctaccatctgtgactgtcctggagaagagaaattttagtttctatggcttgccttgggggagaaagcagagtaggagaacaaagggcagaaggtcagacagatctggcttctgaggcccttcccattttcttcagttcaaaggactcagcacgccaaaagtaccatactttgagataccatgttctgagccccaacaatagccaagtgaccaaaggagtggtaaatgtactggagcaatttaatgaggggagatctagtaagactggatgggaggaggcttctgctgtgtaatgatgcatgggtaggatttgaacaggtctgggtaaatgtgttcctggtgaattcctggcaccaccacttctaggtgggtatggaatcaggaagaagggtgttagggagccattgaatataagcaggtgggttccagaagttccatgtgggctctggagcaggcatcaggtaggagccaagcctgtgggcttgtcttgaggtgaaacaagcttactgtcttcgcttagattacacgcctacctaaactggactagaggagccgatagacattatagagagacatgaagcctgcctctaagctccccaaataacctactctccctctgatggaaaaactgaaattagggaggccagacaaggagtactacagaggacaatttacccttctgaaagtatcacagagggaggcactgtgggttgcagagaacaggtgtgcaggagtttaggattcaaccagtaattcagtgaccattagtcccatgccaggctcatcaacacatgttagggcataggatgcatcagcacagagctgcctctgagagctagcatagagagcgggtggatggggaggggtcctgatgtgcctggggaaactgaggcaagagacagggacatgaagtagaaagctatttatgtattcaggaatgaaagaacaagggtcagacctgggttagtgggagtcagggcaatgagactgaggaatagacatgagagacgttgccaagaaagaccattcagggcctggtactggatagcaaaagcaaggacaaggaaaacatctcgtaggtttacatgttttaccccagagtctaaggcaatatgttgttagtggtgccactgacaaagacgagggaagtggagagggcagctagtttgtaagagaagagagaggatttagctttgggcaaagcaacatcaaagcagaaaatcccatgatcagtaatagagctgggcaagaggacacaactacaaggacagattggaggccctgatgaggtcgtcatgacttatacttccaggcatgcgtaggtgatgatgcctccgctaaaccaccactgccgtttagtgatagcttcttcaagtttatgggcagaagacaaatcaggaccacttaaaaagatttggaaataactcattgaagctatgtattggaatcaatagatcaaatgacgcaaaggtagagcatctgcaaagacagtgagaggaacaggaattctgtttaagtaataaatatatagctttaatacataaaaaaaaacccgctaggtttccatgtgctactcacatgttgcttttggcattcctcaggaaaatacaactgtatattacttagtcttagatgtgcaagaatcggactgttcggtcctatccaggaaatactggaatgactgtgagccacctgattccagacgtccatctgaaatagtaagtaaagagggcaccttcactctgctcttttcattcttattttccatctactctgttcactcagccaatgcctgggctaacacagtagaagagaaagggcagcttttgccttgagattcatgaagatgatgttaaccttgagcaatactcttgagagtctttcctgggaacccagttcaagacaactcagcagggtgtgtggtcccatcaaagagcataaccagctgtgggtccttgggtaaatcatctaataacatccctccactttggtgttttttgactgtaaaataagaagtgggtttaggaattcatggactctaagggccttccactcttgacagtctacaggtatcagaatctatgaacttgtaattgtgtcctatgaacaatggtcctattttcaggaatggccaaagtaattacttgcagtgaggaattgggtcttgctcagcacctaggatatacactgaggaataagatctggctttgcatgtgggaggtgggtattgacatgccaggctctctgacacaggtggagaacatgaagatgaataagcagagattcaagatttcatttccagaaaatgagaggttcacactcctggaactttcaccactttttcccttgaaaatgtttggggtatggccatgatgctttaaatagtttctcgctggttctcctgaggattttgagtgccaacaggatgcagcacacagaaactgactaagaaaatgcagggtttgagacaagctttgatgaaagaaatgcatttttaaatgaacagtaggaggatgttgcatcacctttttgctctttcatatctgacctgaggaaggcaggatgcaatgactcagcaagtcctcaagagcctctttcttacaggtgatcggacaatgtaaggtaatagctacaagacattcccatgaatctcaggacctcagagtgattgactttaactgcaccacaagttctggtatggtaatctgttaaattgctaattaattcttgattaatacaaattcaatcatacagtggtatttgtctcatctatgtacatatgtattcatatatattcagatgtattcatgtatatctatgatgtacatgaaagaaaagccttcatagactccattattattcattctccagagaatagaattgagacaaatttccctggtactggtacaccttcttttaaagaaattcaacacataaaaatagagatttaggagaggtaggttagcctcattatagatataggctttggagtcaggcttgctttagcttgagtcatcatctgccagttgtatagtcttgggaggaagtaaagtcttgggactatgaagtaaaggttatgacactttctatttaagacaaaataattgatgctcaaagaagttaaatgacttggcctcaagaacaaagccaagatattgtgaagatgtgacacaatcccaggagtattaactctaaattccacagcttttttatttatttatttttatttttgagacagagtgtcgctcttgctacccaggctggagtgcaatagtgtgatctcgggtcactgcaacctccacctcccgggttcaagcaattctcctgtctcagcctcccaagtagctaggattacaggcatatgccaccacatccaacaaattttgtatttttagtagagatggagtttctccatgttggtcaggctggcctcaaactcttgacctcaggtgatctgcccaccttgacctcccaaagtgctgggattacaggtgtgagccaccacgcccagcctccatacccttttaatttacattttcaaatagaattatcacaggattcctttttaaaatagcaaatccaaatatgatattatatacaaaaatgcaagatactgccacaggagtttgcattgaagaaaggatgatctgtatcttctcctctctctgggcaaaactctatgttaatgctctgtcttcccccttggcaacaacaggaagaacttattaaaatattagtggcctggtgcggtggctcacatctataatcccagcactttgggaggttgaggccagagggttgcttgagcccaggagtttgagactagcctgggcaatgtgactcaaccccatctctattatttaatatatatgttaatatatatatcatattaatacctaaatatatgattatataatataaaaacatatgatatattatataatatataaatatataatagatattatataatagataatatatatttatatattaacgaatgtcatagttgtcatatttatatatatatgttagcactttatcagtggtactggtgaaggcatcatgagtaggggtcacaacatagacatggggatcagaaagactcgaaggaagaatcagcagtttagttcggttgccaaatggctgattgatcttgaagcagttactcagctcttcccaccctcaatttgcccatccttaaaatgaaagttattgtcattcttgccaccaagccaccattaacatttccagccctttactgtgacactgctatcttctttctccagtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtggtgagtctccactaaggttcggttggagtctgaaggcccaggctccaacctggcagcaggaactgaatggcataccctctccacctgcctcaattgactagctgccttttaatttgtcacttttgaggccataaaagacaggcagcaggtatttaaaaaatacaaaaaaattgctttcctcaaacacttttttttttttttgaaggatgggtaggggagtagacatctgacagagtagggagaaaatctaaagaggaaacagggaaagacaagaacatatgagggttgtgtcattgcaaatcatccaatactaacattcttgtactatgatggaaaactgaagttcagagaaattacctcaccacacccagtaatgtgcctatagttagatggttccctgctctctctacaaggacccaagtactttcacccagagctgtcttgtagagcaactggttgacatttgctatgcattcagaaaatgcagcgttaaatagattgtgttgcatacaagtaaggaaatgagtaccatgcagttgctcaaagaatgtttggacccatgcgcactggagtttgaaaacatattggtataggaaaatgcaggttatagaacagtacttagactatggacccatttatatgaaacacttagatctccctgtgtatgtgtaacacatctaggaaaacactcgaagaggaaacacatcaaataaatgagaatgaaaactctgggaagaagttggagtgcaggagaggtgatttttcacactctactttatcatatatttattatttgaaccttttcagtgaactggtattcaccttatcacttaggtgatacatttttaaaaggcagaaaccattttaaaaaatgacacatactggtgattttgaattctcatactgccttaaaaaatattgaatggtagttatctactgcttttttttcctttttctttgtctgttcttgaaactattttgatcccatctgttctagagaggaggggaaggaactggttacttcgtggacttctctgtgcggaactgccccagacaccatttccccagacaccccaatgtgagtataagaaatgtctgtgatcgttgactagagtcacagagaaaaaagaaagagaagaaggagaaggagaaggagaaggagaggaaggagaagaaggagaagaggaatgagaaggagaaaatgaggaggaggagaaggaggaagaaatgtctgtgaaatacaaagtatcatctgggaagcacttagtacctgccaggcactcttctaagtgatttacacatcagataacttattgttttgttttgtttttgagatggagtttcgctcttgttgcccaggttggagtgcaatggcacagtgtcggctcactgcaacctccgcctcccgggttcaggcgattctcctgcctcagcctccggagtaactgggattacaggcatgcaccaccacgcccagctaatttttgtatttttagtagagatggggtttcaccatgttgatcaggttggtctcaaactccttatctcaggtgtccacccacttcggctgggattacaaatcaaagtgctggggttacaggcgcaagccaccatgcccagcctatgataacttattaaccctcacactaccatatgagatagataccatttttaatcccaaattagcagataggggaactgaggcacagagaacataagcgaaccataagaacatgattttataatatacatgatatatacctaaacttaaaactaagtttctaactgattaggattaaaggcttagttagaactatagcagttcgtactaagaccctacgccaagtggttttattaattccacatcatcacactcacaggaatcccacttgacaaatgaggaggtaactgaaaatcagcaaaggaaaggtcttgccgatgttcacaaccaagctgagattaaaacttagttattctcatacaaagtccagtgggatttttcctctaatcatttacaaatagattcccatgtacctgccagaagacattattaataccacctggcatttgcatggtgacctacagttaaagaaacacctccacatctgttattgccaggagagcctcatgaaaatcctgctgacaaggaaaagcaagtatctgcctacatttcctgtgacaaggggacctgaaattaaaaccacttacctaaaggcacttagctagagagtgttaggaaatggaattttaattatgatgccaagtccaggatttttctgaggtttaacaacacattctccctggtcaaaagggagaaaccatccattagtacctttgttagctcttctaatgtccacactgaaccaggtctagaaaccttcttagcgcccaccagaaaagacacctccctcccctactcctatggccaacaaacccttcatgatcttggtgtggataatgtaaacccagagttgaagcaccagagctgaagaggaggctcaggggtaagtgttttacagcatcctcttgtttaattaatccctcccacaacctgtgagtacatagtattatccccattttacaatggctgactttcagaaatcttttgtaactttcccaaactcagacaactaggaaatggagaagccaggattaacataggtctctctgattcccaaactgtactcagaacctcaatgcttagcaatttcttctagcagacagccgtcctcttgtcctagtcgatctttcacaggtgggtttaggagcatctggagcacaggagtggcagccagttgtagccctggcacttgggtggagtcagcagacacttgccttgacaatgtccatgaaaacccatctttatgctatacagatgccctcctgtccaacactttcctccaagggaccagctgaagttgtaaaaatccctctttgacaccattcctcattgtcctaggcacaggcaactgaggtctccagtgcagaagggttggcctaaaggcaaggcagcaatgatgtggttttcctcatcatttccatcacccatggggaagcccagtgctggtgcctgctcatgaaaaaaaccacagcaactttagtgatacccttcaccacctgcactttccccaaagtgttaacaaggaaagattgctgaacgactggtgggaatatctgatcatattaccctgatttttctaaagcacttcttccttttctgaatgtctggaagctaactctggctggtcatcttcacaccacctggacacacacactaacagctcctcattcctttgtaggtctttggattctgcagagcagatttgttctatgatgtagaagccttggacttggaaagcccgaaaaaccttgtcataaactgtgaagtcttcgaccctcaggtgggttgtctaagcagactttgtcatggcagtgccagattaagtgacatacgtacacaaatagtgttgttgcttcctaaagctctatgagtgggtgtgtgtgtgtgtgtgtgtgtgtgagagagagagagagagagagagacagagacagagacagagagagggagacagggagagagagaaagagagagacagacagacatgcaagaaaaaagatacagagagtatcccacaactggggaaaggagtgcaattgccagattacacaaaaagtatgaaaacttttccaagaattgaagaggggtaacaattggcagaaaattaaaatcatgtccaattcaaccaaacttgaaggaatttgaaaatgctctttgtagtcgggactctagtgctgagacttagtcattcctaagcttatattattgggcatagaatctaagaggaatatatcagcctcaaatttattatgtaaatgtatataaaataagatgcaaaaccatattttgcatctgtctcagaaatctttggtctattttttacatgagtacaaagatttgcttcacgaaatttttcatatcagaaacaaaacttaaaataatccaaacatccaatcccaagttaaaaaaaagaaaaaggaacaaagggcaggattgtcaccatgaacatggctctgtctttttttttttttttttttttgagaaggagttttgctcttattgcccaggctggaatacaatggtgccatctcggctcaccacaacctctgcctcctgggttcaagcgattctcctgcctcagcctcctgagtagctaggattacaggcatgcgccaccatacctggctaattttgcatttttagtagagaaggggtttctccatgttggtcaggttggtctcaaactcctgaccttaggtgatccacctgcctcagcctcccaaagttctgggattacagacatgagccaccgtgcccggcctctgtagctattttttaaaaaattaaactctgaacaaggaagagagagaagaggtcaagtgttcagcctttaggagtaagggatgttgataccatcaagcctcagttaagaatatcagttataaggcactagttttccagtgttggtctacagatgggtgccaggtcataatattgtttcaccactctgtgtagtaaaaatgaaaaaaaaataaggataatgaagttttttatatctaacatttatccatctaaaggacaatcctttactctgatattgtgtttctggctctttcttttttttttaaatcaaaatttcattccaggctgggcatggtggctcatgcctgtaatcccagcactttgggaagctgagatgggtggattacttgaaacaaggagttcaacatggtgaaacctgtctctactaaaaatacaaaaattaggagtctgggcaacagagtaagactatgtctcaaaaaaagaaaaaaaaaaattaggtgggcatggtggcttgggcgtgtagtcccagctacttgggaggctgaggcaggagaattgcttgaacctgagaggtggatgttgcaatgagcagagatcgcaccactgcactccagactgggtgacagagcgagactcagtctcagaaaaaaaaaatagtttcttttgtgaaacaatgatggtggtaaatgatagttattgttaatattttaaatatcaactgggctagataacaatttgagaatcttttttcgtaatactttttaaattgatttgtggaatctatgatctgggagccattggtgtaaatcaagtcaagtatctaacatcttcttttatgttacatgatgataggcacttttctgtgaccttttccaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccatggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccccgtcccttccattgcagacaaattggatctgtgtaccgactccctcctctaagaaaaggtgaggtgctgccacttcctgaggccaattttcccagcttcccattgccgcaccacaaacatcctctaaagccagacaatcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaactattgttatcatttatttcattttattttctaagttccagggcacatgtgcagggtgtgcaggtttgttatataggtaaaagcatgccatggtgctttgctgcacctatcaacccatcacctaggtattaagcccagcatgctctagttctttttccgaatgctctcctgcttcccaccctccccctatttattattattaaagtgacctaaattctctcctcgtgattattactaggcatctaaattttcttttggaaaaataagttctaaattcagtattgaagcaaacaaacctctggctataaattgcaaagaagcttgctaacatgaatcatgaccataaattcaggtgcataagaaatgtcactttatgctcagaacaaattaatttctatttgaggatgccatcctactggcttagtggaaatttaaccccagtccttcttggagtcccctttccctgccctgctactttccacacaaagttgggccacagttctaggatctcacaccatgccaagctgtccaggtggtaggaagcaggatagtgactatccctcagccagggtgactgttggaccaatgatcatcatcatgagtgatagccatcctgctcagggatagtcacaaccctgttcacatcactctttcagtctgatttatctgctacttctgtagaaaactgggggtgcaggaatgtctgtacactagccatggacatgactgccaaggtatggcatatggctgctctctccctgggatcttgctgtcttcccagctgcatgcccagaaagcagggcagagatctcctctgcctcagagaccccttacctcactcttctccctataccttctccctcagctaacgactctcttgctagtctcaggtaagttcactttatttatttttagggccagaagactttttccacactatactcctctttctttttcctcctcaaatcaggactcaatcatttgaaacaaactaaaagaattcagattctgtctatcttccaactgcaatagtgatactcaaagtatttcataatcaacatgacccaagcactgaccaatcagaccagaaacaacaacctatcagaacagtcaccatccataaacaaccagcgtgaccacactggcaggtgcagctgaatgtggccctgcagaatcacattcctcctggaggcatggacaccaggtcagctgcttgaacagggagaggagaaaggtgagacccatggagggcaaaagatacagaggttaataactcagaatgtatcctcccacagaagcactggagtaggattcaataatttacaaagtactttcataaactttgcttgagttaatgaaaatattccttggaatacagaggagttgaagctctcaattcacttcagttaagggcattcttcctatgcacacccgacactgcgagggaataatgggataagaaaccattcccacctcgggatggtacgttctactagaggttttagacaatacaccatgcttttctagacttctttttgtttgtttgtttgtttgttttcacagagtcttgctctgtcgcccaggctggggtgcagtggcgtgatctcagctcactgtaacctccacctcctgggttcaagtgattcccctgcctcagcctcccgagcagctgggactataggcttgcgccaacacacccggctaatttttgtacttttagtagagacagggtttcaccatattgtccaggctggtctcgaactcctgactttatgatccacctgcctcagcctgccaaagtgctgggattacaggcgtgagccaccgctcccggctgcttttcttatgtcatcccagctaaaaagtgtatcagtatctgtttacaaatatttcataaactttcaaaggtgacattcacagaggcaacataattaatgcctcttcaaatgtctaaagcccaaactcttcattcttctccagaaaagctctcccacttcctaacatcagcctttctgtcagtggcaataccattcttaaaatccttcaggctagaaatatttattgattttccctttttcttcatccccaatttatgctataacagaaaacactttgtctgctttgttcattaaagcacttgccacacaataagggtttaagaaatgtttgtataataagcaggtacattaaacatttactatgagtctgaagatacggctgatcacagtggctcacgcctataatcccagcactttgggaggctgaaacaagtggatcactggccaacacggtgaaaccccatctctaccaaaaaatacaaaaattacctgggcatggaggctgaggtgggagaaatacttgaacccgggaggcggaggttgcagtgagccaagattccatgaccgcacttcaacttgggcaacagagaaagactctgtctccaaataaataaataaataaataataaaacttaaaattaagttgtttaatatattttgtaatttaatctttaccaacagctctctcatgcagaaaatgtcattgtatcagaataggccagttgctggaacaaactcaagtggcctaatgatggagaatttgatttctctttcatgttacaggtcaatatgggttatcagcagatggccatccaaatggtgattcagggtaccaggctccttttgtctgggggctctgctctccccttgacctcagaattgtctcttggatcctctgcatccagcccacatggggagagagtggaggatcatgaaggtggtttctgtggcccaggcctggaaggtgcatgcatgattcatgctcacatttcactgcctagaactcagtcatatggccacacctaatgcaagggagatggggaaatgaagtctgcctgtactccaaggaggaaagggacctaggtagggaaaacaggctgtacaatcaaccatttcttagggaaagaagagaaccaaagaggctgaattacttgcttaggatctcgcagtcagtaaatgtgggactggaattagaaccttgattggcctccgccaaagccacatgctgtcttctttatgacactgccggtgatggtgcccaggcctgtttctgagtcttcactggaaacgcttgctggtcagccgctaccattctggtctacttccccctggacagtgctcccttatgcatttcttcatcctcccagtgttcagcttccacatttctgcttctcctccttcctctcaacctaagaacttcacaaaatctcttccatttttcatattttccacacaactccccattaaaatctgccttctcccatgactatgcacttgaacctatttcagtcaggcagggattcttagacacctttccctagtattagagatagcttaaaagaactaatcaccaggtcctgcacaggagtgaattattcacaggagtgaataattacctcattcactcctcagaaacaccctgttaagatatcatgattttccaccattacaggtgagaaacctaagcctcagaacatttatgtgaccctgtcttccttgggatcacctaggtaagtaggcagaactacattagaatccaggttggacttactgccaagttcatgttcctgccccacccctacaatagccccactggctcctattgccccttcttctccagggactccagggagaatcagttggcaagttagattggcaagagatcctaacagcaacagaacttcaatcttttatgcttgtaagacttgaagatacacgtttactacaggaaaacacatgtctctaacctacctttaaaattcctctctccgaatagtctaacattatgaaaaaggttgcttaggcttggtgaatgcaaaacaccatatccactgtaggggcaaaaagtgcaatgcccttcctcacccatcctcagggtcacagctgacttacctacaacaaacgacaggtgggcaagagaaagcagagcatatttatttaatccaagtttctataacatgagagccttcagaatgaaggcccaaagacccaagggacaactgcccattgctaagcttagattccatgaagactggacagcagcgtgatccaacaaaaaagaaaagatatgatagtaatagactatcggggaaaccccacaaggccttcagttggagttctccattggcctctctgtggcatttcttgctcccagttatggtgcaggacccaattggcatgcagatcttaggacctactagcagacagagtagattagagaatttattttatggccagctcctacacagaaaggcctggatgaaaggtgagagtcatattttaggtttcatggctgctttgagacagagagattcctctttctctgacctgcctgttggaagaggaattctagtttctatggcttgccttgggagagaaaggggagtaggaggacaaagagtgggagcaggtcagacagttcttgcttctgaggtccttttggtttccttcagttcaaggggcgcagcatgccaaggcacaatactgtggggtatccttttttgagccctaaaatattcaagtgaacacaggagtggtaaatgtactggaaccatctaatgaagggagatctagtcggattgcgtgggagaagccttcagccaatgtattagtctgttttcacactgctgataaggacagatctgtgactgggcaatttacagaaggaagaggtttattgacttacagttccacgtggctagaaggacctcacaatcatggtggaagatgaaaggcatgccttacatgacagcagacaagagaagagagcttgtgcagggagactcccctttttaaaatcatcatatctcatgagacttattcactatcatgaggatagcacaggaaagacctgcctccatgattcaatcacttcccactgggtccctcccacaacacatgggaattcaagatgagatgtgggttgaaacagaaccaaaccatatcattctgctcctggctttccccacatctcatgtcctcacatttcaaaaccaatcacgccttcccaacagtcccccaaagtcttaacttatttcagcattaactcaaaagttcaaagtccaaagtctcatctgagacaaggcaagtcccttctgcctatgagcctgtaaaatcaaaagcaagttagttacttcctagatacaatggggttacaggcattgggtaaatacactcattccaaatgggagagattggccaaaacaaaggggctacaggcaccatgcaagtccaaaatccaacagggcagtcaaatcttaaagctccatgatctttgactccatatctcacatccaggtcatgctgatgcaagaggtgggttcccatggtcttgggcagctctgcccctgtggctttacagggtacagcctccctcccagctgctttcatcagctggcattgagtgtctgtggtttttccagccacacggtgcaagctgtctgtggatctaccattctggggtctttaggatggtggctgtcttctcgcagctccactaagtggtgtcccagtagggactctgtgtgggggctctgaccccatatttcccttcgacattgccctagaagaggttctccatgagagccctgcccctgcagcaaatttctgcctggacatccaggcatttccttacattgtctgaaatctaggttgcagttcccaaaccccaattcttgacttctgtgtactcacaagctcaacatcacatggaagctgccgaggcttgaggcttccaccctctgaaaccacagcccaagctctacattggccccctttcagcaatagccggagtggctgggatgcaaagtatcaagtccctaggctgcacacagcatggggaacctgggcctggcccaggaaaacactttctcctcctaggcctccagatctgtgatgggaggggctgctgtgaagacctttgaaatgccctggagacattttccccattgtcttggggattaacatttggctctgcagctggcttggatttctcctcagaaaacggaattttcttttctattgcattgtcaagctgcaaattttccaaacttttatgctctgcttcccttacagtactaaatgctggccaggcacggtggctgatgcctgtaatcccagcactttgggaggccaaggcgggcggatcaccagaggtcaggagtttgagagcagcctggccaacatggtgaaaccccgtctctactaaaaatacaaaaatgatctgggtgcagtgacaggcacctgcaatcccagctactccagaggctgaggctggaaaatcatctgaacccaggaggcagaggttgcagtgagcagagatcatgccattgcactccagcctcttgaatgctttgctgcttagaaatttctttcgccagaacccatcattctcagcaaactaacacaagaacagaaaaccaaacaccgcatgttctcactcataagtggaagttgaacaatgagaacacatggacacagggtggggaacatcacacagtgggtcctgttgggaggcgggaggcaagaggagggagagcattaagacaaataactaatgcatgcggggcttaaaacctaggtgacgggttgattggtacagcaaaccaccatggcacatgtatacctatgtaacaaacctgcacattctgcccatgaatcccagaacttaaagtaaaataaaaattttttaaaaagaaatttcttctacccaatgccctaaatcacctctctcaagttcaaagttccacaaatctctagggcaggggaaaaatgccaccagtctctttgctaaaacataacaacggtcacctttgctccagttcccaacaagttcttcatttccatctgagaccacctcagcctggactttactgtccatatcgctatcagcattttgggcaaagccattcaacaagtctctaggaaggttcaaactttcccacatttttctgttttcttctgagccctccaaactgttccaacctctgcctgttacccagtactaaattcacttccacatttttgggtatcttttcagcactgccccactctactggtaccaatttactgtattgatctgttttcatgctgctgataaagacatacctgagactagacaacttacaaaattaaagaggcttattgaacttacagttacacgtggctgggaagaactcacaatgatggtggaaggtgaagggcacatctcacatggtggcagacaaaagaagagagcttgtgcagggaaactccccttttgaaaaccatcagatctcatgagatttattcactatcataagaatagcatgggaaagagagcccccatgattcaatcacctcccacctggtccctcccataacacataagaattcaaggtgagattcgagtggggacagaatcaaaccatatcagccaggcagtgatgcatggtaggaaatgcaataggaagagggtctgggtaaaggcatttctggtgaattcatggcacaccacttctaggagggcagggaatcaggaagaggggtgttacgagccattgaatacacaccaagggattgcagaaggtctatgtgggctctggagctgccatcacatgggaggagagactgtggacttatattcaggcaaagcaagcttactgtcttcacttaggttatttgcctacctgaagtggatttgaggggctgatggacattatggagagaagcctccctcctccatcctgaaataagctaccctccctttggtggaacaattgaaatcaggaggacagaccaggagtactacagagggcaagcagagcaattcacccttctacccttcttaaagtatcagagaggggggcattgaaggttgtagaaaacaagagtgcaggagtttaggattcatccagtaattcagtgaccattagtcccattccaggctcgttgacacatgttagggcacgggatgcaccagcacagagctgcttctgagagctagtgcagagagtgggtgggtggggaggcaacccaatgtgcctggggaaactgagtcaagagacagggaaatgaactaggaagctattttatgtatgcaggtgtgagagaatgagggccagacacaggcagtgggattcagagcaatgaacatgaagaatagacaagagagacattgccaagaagtctatacagggtctggtactggatagcaaaagcaaggacaaggaagacatattatagccttacactttttaacccagagtctaaggcaatatgttgttagtggtgccactgacaaagacaagggaagtggagaggcagctggtttgtaagagaagagagaggatttagctttgggcaaggtgacatcaaagcaggaaatccacgatcagtgatagatcagggtgagaggacacaactgcaagaacaaactggaggccctgatgaggccgtcatcacttatacttctcagtgtgtcccttcaacacttccaccaaaccaccactgccatttagtgatagcttcttaaagctcaagggcagaagaaacatcatgaccacataaaaagaagatttggaaataactcatggaagctatttattcaaattaacacatcaaatgacacaaaggtaggacatctgcaaatatgtggagagccgtgagaattctgtgtaagatataaacatggacattacctttattaaaaaaaaaaaaaaaagaattgggaggccaaggcgggcagatcatgaggtcaggagatcaagaccatcctggccaacatggtgaaaacccatctctactaaaaaatacaaaaattagctaggagtgttggcacgtgcttgtaatcccagctacttgggaggttgaggcacaagaatcgcttgaacccaggaggtggaggttgcaatgagctgagatcgcgccattgcactccagtctggcgacaaagtgagactccatctcaaaaaaaaaaaaaaagaaagaaaaagaaaaaaaaaagaaaagaagaaaactggactgccacatgctactcacgtgttgctttttgcattccccaggaaaatgcaactgtgtattatttagccttagatgttcaagaatctgactgccgggtcctatccaggaaacactggaatgactgtgagcctgctgtttccaggcgttcatctgatatgctaagtaaatagggcaccatcgcactgttctattcattcttactttccgtctactccattcactcggggcagccaatgcctgggcgaacatagcagaagagaaagggcaacttttcccttgagattcatgaagatgatgttgactttgagtgataaccttgagagtcgttcttgggaacccagttcaagatatctcagcagggctgtggtcccatcaaagagcatgaccagctgtgagtcctcggccaaatcacctaataacatccctcctcgtcagggtttttgattgtaaaataagaagaggggtttggagttcatggactctaaggtcttccgctcctgatcatctatgagtataagaatctatgaacttataattgtgtcctaggaacactggtcctattttcaggaatggtcaaagcgacatgttgcaaattatgaggggacacgtgaggactcgggtctgcttctgtgctttcctcatacactgaggaagagcgtttcattgcgtgtgtgggaggtgggtactcaaatgccaggctctctgacacaagtggagaagatgaagatgaacaagcaaatattcaagacttcatttccagaaaatgagaggttcacaatcctaggagtttcaccactttttcccttgaaaatgtttggggtatggccatgatgctttaaatagtttctctctggttctcctgaggatttttggtgccaacaggaagcagcacacagaaactgactaagaaaacgcaggttttgagacaagctttgatgaaggaagccccaaatgcattttaaatggacagtaggaggatgttgcttccttttgctctctcatatctgacctgaggaaggcaggatgcaatgactcagcaaggcctcaagagcttctttcttacaggtgatcggacaatgtaaggtaatagctacaagacattcccatgaatctcaggatctcagaatgattgactttaactgcaccacaagttctggtatggtaatttgtcaaattgctaattaattcttgattaatacaaattcaatcatacagtggtattcatcacataatgccataaagtacatgaaagaaagggtccctgccctcgtggactccattactcactcttcagatggtagaagggagacaggtttccctggtactggtacaccttcctttaagaaaattcagtacataaaattagagatttggctgggcgcggtggctcacacctgtactcccaacactttgggaggccgaggctggcagatcacctgaggtcgggagttcaagaccagcctgaccaacatggagaaatcccgtctctactaaaaatacaaaattagccaggcgtggtggcgcatgtctgtaatcccagctacttgggaggctgaggcaagagaattgctcgaacccgggaggcagaggttgcagtgagccaagattgcaccattgcactccaacttgggcaataagagtgaaaccccatctcaaaaaaaaaaaatagagatttatgagaggtaggagaacatcattacagacatcattacagagacataggcttgggtcagacttgctttagtttgagtatgaacctcatcacttagtagctgtgtaagattacacaagagggcagttacttaaactttttaaccttttatcacttgtaaaatgaggatagtaacagcattagctttcaggattcttgttagaattgaataagatgctccatgtagcacactttgcagattattcttagcactcaataaatattgacatcaatgtttaaatgtcatgaatagctctacaatttacaaagcaatgatacctgttatctcatttaatctcccaacaaggtaataaaatgtagattatgatactgtcaacttatgaaataaataattgtgattggaagaggtttaatgatttgccctcaggaacacagccaaggtgcgatgaagataagactctataccaacagtgttgacactaatttccatgctctttttttttttttaactttttaaaaaaagaattatcacagaatttttaatggcaaatttcactatgattctatttacaaaaattcaataggcaagctactgctgaaggaggttgttttaaagaaagactgtgtatcttctcctgtctctgggcaaaattttatgttaatgataccttctcccttttgacaaacacaggaggacttctttaaaatattagcacttgatgagtggcagtggtggaggcatcacgagtaggggtaacaactgagactcgggcatcataggaaaggaaggaaggatcagcagttcagttctgttgctggttggctgattcatcttgaagaagtcacttacatcccccaaccttccatttgtctatctgtaaaatgaaagttattgtccttccttccactgagcccccattgccattttcaaaccttaactgcgacactgccattttctttctctagtctcttcagcattggccaataccaaggatagtcccgtcctcttagattccctcaaggataccgagctctacagaaaacaagccaacaaagcccttgtgaagtataaaggagagaatgatgactttccctctttcggagtggaccaagtgcagagaactgcaagagtgttgagtctccactaatatccagctggagtctgagggcccaggctccaacctggcagcaggaactgaacgacaccccctctccacctgcctcactggaccagctgccttttcatctgaggcccccattgtagcatttggaggaatgaaagccaggcagcaggtaccgctctccgggaagaactgctctcccgcaattttttacattttttggaggatgtcggggcagtgtgtatctgttagagaggaaggaaaacccaaagaggaaatagagaaagacaagagcatatgagggttgtgtcattaaaaatcatccaatattaacctccttgcactatgatagaaaactgaggctcagagaaacctcaccacacccagtggtgtggctggaattagacagttccctgctcactctacaaggactcaagtgctcccacccagaactgttttcagagcagctggttgatgtttgtcatgcattcagaaaatgcaacagtaaatcaattgtgttgcatataagaaatgaggacagtaaagttgctcaaagaaaatttgaactcatgtgcatttgaaagagtttcaagacatatttttataggaaaatttacagaacaatatttagaaaagagtgcaaatgctaatatcacacaaaagtataaaaacatttccaagaattggggagaaataagatttggcacaaaagtaaaatcatgtccaattcgatcaacctgaatgaatttgaaaatgctccttgtagtcaggactccagtgctgagacttagtcattcctagcttttattattaggcacagaatgtaaggggaataaattaggctcaaatttattatataaatgtatataaaataagatgcaaaactatattttacatctgtcccagaaatcttagttctattttttacatgagtacaaagatctgtttcacggaattttttatatcagaaacaaaactgaaaataattcaaatatttatatcccaagtttaaaaaaaaaaagaaaagaaaagaaagaaagggcaggaaagtcactatgaacatggctccacagatttttaaacattacactctgaacaaggaggagatggaagaggttaagtgttcagccttgaggagtaagaaatgttgataccatcaacattctcagacctctgtcgaaaatattaactagaaattaccagttttccagttttccagtgttggtctacggatggttgacattacataatatacttttgccactctgtattgaaatggaaaaacaaggattttcagacattgcagacaaactggatctgtgtagcgactccctcctgtaatatttttgtatctagcatttattccatctaaggactattctttactctcacatgggcttctgaggtttctatggttttcctcacctttgttatcttttatcactcattttgtgaaacagtgatggtggtaggtgatagttgttgtttatgttttaaatatcaattgggctagataacaactttagaacccttttttttatcctacttttcaaattcatgtgtggaatccaaaatctgagtgccattggtctaaatccaatgtctaacttctcttagaagttgaatgtctagcttctcattgtgtgttacatgataatatttatttttctgtgtccttcatcagacatgtacgatcatgaattgcgtgcaaccccatttgacctatccgctccatcctggtgggcgtgaacattctccgattgccaagcctccatgtaaggatccttgccaagccccaaggatccagagatcatcgtcatcctgagaagccacatgaacacgatgcccacttccagtagatgaaaaaggtgactcagacattaaccacttcaagggggggctcctccactattgcccctcagggtccagatgcaaccatgtttcttctaacatgattggaacacaaagttactcccataatcataactccagtgagcttcatcctcatgaccatcatccccatggacaccatctccaaggaccctgttcctatgcacaccaccaccatggccgtgattgctttgacgatggaccctgtaacccaccaccctatagccaaggtccccaaggtcaccattgccattgccacggcccaccacctgggcactcagaaggacgaggtcaaggtaaaggacactgtcccttccattgcaaactgcatctgtgtacggactccctcccgtaaggaaaggtgagaagctaccacttcctgaagccaattttcccagcttcccattgctgcatgataacaaccctctaaagccagacattctgccctccctcaatctgcctctgaatcatgtccagggaagttcaagagtgagtttccagaagcattcaaggcttttggacatacatttcccaaacaaaatgcaattcttttgatggggaaaaatgtataatagtttgaattagaataataaattaaatgaccaacactcatgaaaatcactgttcctttcaccttacttgcatactcaggatgaagcaaaatatggatgggggtggtgatggcctgagataatagatcaaatggaaaggagaggaaagagctcagtgctgccaattagtagtcaattctgtcactcgccactacatcactttaggaaatctatacccctcagaatttccttctttcctggactgaatgctaattctagagtctctgttaccgcttgggctatacctgggcatagcaagaaaatatggtgcttaaactattattaaagtgacctaaattctctcctagtgattgtttctagtcatctaaatttcctttaggaaaaataagttaaattcaatcatgaagcaaacaaacctctggctataaattgcaaagaagcttgctagcatgaatcatgaccataaattcaggtgcacaagaaatgtcgctttatgttcagaacaaattaatttctatctcaggttgccatcctattgggctaacaggaaatttaaccccagtcctttttggaattcccttgctctgccctgctactttccacagttgggccacagttctaggatctcacacagttgccaagtggttcaggtagtggaatcaggaggtcagatccttgatcattggtccaacagttgtccctgctgagggatagtcaggacactgttcacatcactctttgaatccagtttatctgctacttctgtagcaaactgtaaatgcaggagtgtctgtaccctagcaatggacatgactgccaagctatagcacatggctactctctccctgggatcttgcagccttcctggctgcgtgcccagaaagcagggcagaggtgtcctctgcctcagagacccctcaacccactgttcttcttctatcttctccctcagctaaggactctctagtctcaggtaagttcactttatttatttatagggccagaagactctttttttcactccgtaatcttctttctttttctgtctcaaatcagggctcgatcatttgaaacaagctaaaagaattcagattctctataccttccaactgcaatggtgatattcaaagtattgcataaccaatgtgaaacaagcactgaccaatcagaccagaaacaacaaccgatcagaacagccgccatccataaacaaccagtgtcaccacaccggcagatgcagctgaatgtggccctgcagaatcacattcctcctggaggcatggacaccaggtcagctgcttgaatgaggaagagagaaaggtgagtcctggggagaaaaaggtgagacccagggaggacaaaagatacagaggttaataactcagaatatatcttcccgcacaagcactggagtagagtttaataatttacaaagtactttcataaacattgcttgagttaatgacaatattacctggaatgcagaggagttgaagctctcaattcatttcaattaagtgcattcttcccatacacacccaaacttatccgtggataagaaaccattcccacactaggagcatacgttctgtactagaggttttgcacaatacactatggatcattgtttttctagacattttatgtcatcatggctaaaaagtctatgtatcttgtttgccattattccataaattttcacaggtgatgttcacagacagaatataataggagtgtctcttcaaatgtctaaagcccaaactcctcgctcttccctggaaaatttttcccacttcttaccatcacctttgctgtcagtggcacgaccattctttaaatcctacaggctagaaatatttattgattctctctttttctttatccccaataaattctatgacagcacagactttgctttgttcactaaagtgactcccacatactagggatacaataaatgtttgtttaatgagctggtacagtaaacatttattgtgactgtgaagatttttctgttttgtaatttcatctttactaaaaagtcccttatacagaaaacatcattgtatcagaataggtcagttgctggaacaaacaaactctgtggcctaatgatggagaatgtgatttctctgtcatgttacaggtcaatatgggttatcagcaggcggccatctacatggtgattcgggatgccaggctccttttgtctgtggctctgccctcccctaggcctcagaattgactcttgggtcctctgcatccagcccacatggggagggagtggaggatcatgaaagtggtttctgtgggccaggcctggaaggcgcatgcatgattcatgctcacatttcactggctagaacttagtcatatggtcacacctaatgcaagggagatggggaaatgaaatctacctgtattccaaggaggaaagggcataggtagggaaaaggggctgcacgatcaccatttcttagggaagaaagaggagaacaaaagaggttgaattacttgcttaggctcttatagtcagaaaatgtgggactgggattagaactttgattggcttcctccaaagccacatgctgtcttcttgatgacactgccagccgacaatgcccaggcctgtttctgagtcttcatgggaagcacacttgctggtcagcctggaccatttctgtctacttccccctggacagtgctccctcatgcatttccccatcctcccagtgttcaacttctccatctctgattctctttcttcttctctgctcagaacttcataaaatctcttccactctacatgttttccacacatctcaccattacaatctactttctcccatgactatgaacctgaagctatttcagtcaggcagggattcttagacacctttccctagtattagagatggtttataagaactaatcaccagctcctgcacatatattacctcgttcacttctaaaaaataccctgttacgatatcatgattttccaacatttacaggtgacaaacctaaggctcagaaaggttatgtgaccctgtcttgcttgggatcacataggtaagtagcagagctagactggaatccaggttggacttactgccaagttcatgttcctgccccacccctacaagggcaccactgactcccactgacccttctccagggactctagggagaatcaattagcaagttggatatcctaataacaacaaaaagtcaacctttatgtttgtaaaacttgaagacacacatttactacaggaaaacacatgtctctaacctacctttaaaactcctctctccatatagtctaactttatgaaaaagtttgcttaggcttgatgaatgcaaaacaccatatccactgtagaggcaaaaggtgcaatgcccttcctcacccatcctcagggtcacagctgacttacctacaacaaatgacaggtgagcaagagaaagcagagcatatttatttaatccaagtttccataacatgagagcctttagaatgaaggcccaaagacccaagggacaactgtccattgctaagcttagattccatgaagactggacagcagcgtgatccaacaaaaaagaaaagatccaatagtaatagactatcagggaaaccccataggccttctgttgcagttctccatggcccctctgtgcagcatttcctgcacccaggtatggagcaggacccatctgtcatgcagatcttaggacctgctatcagacagagtaggttagaggatttattttatggccagctcctacacagaaaggcctggatgaaaggtgagagtcatattttaggttttatgaccgctttggggcagagggattcccttttctgtgacttgcctttgggaagaggaattctagtttctatggtttgccttgggggagacaggagagtaggagaacaaagagtgggagcaggtcagacagatcttgcctctgaggccagatttggcttccttttggtttctttcagttcaatgggctcagcatgccaaggcaacatactgtggggtatcctgttctgagccctaaaatattcaagtgaacacaggagtggtaaatgtactggggcaatttaatgaaggaggatctattaggattgtgtgggaggaggcttcagctgggtagtgatgcaagggaaggatttgcataggaagagagcccgcataaaggcattcctggtgaattcatagcacaccacttctagatgggtagagaatcaggaagaagggtgctagagagccattgaatatacacagaggggctgcatctatgttggctctggagctgccatcagatgggaggagagaccgggcttatcttcagggaaagcaagcttactgtcttcacttttagattatttgcctacctgaagtggatttgaggggctgatggacattagggagagaactgaagcctccctcttctatcccaaaataagctaccctccctttggtggaacaactgaaaccagaaggacagaccaggagtactacagaggacaaacagagcaatttacccttctacccttcttaaagtatcagagagggggcactgtagattgtagaaaacaggtgtgcaggaatttaggattcaaccagcaattcagtgaccattagtcccactccaggctcattgtcacatgttaaggcacaggatacatcagcacagagctacctctaagagctagcatagagagtgggtgggtgtggagagaactcagtgtgcctggggaaactgaggcaagagacagggacatgaactaggaagctattttatgtatgctggtgtgagagaatgaaggccaaacctgggcagtgggtattaaagcaatgagaatgaggaatagacaagagagacatttgccaagaaagaccattcagggcctggtactggataacaaaagcaaggaaaagtaagacatctcgtaggtttacatgttttaccccagtctaaggcaatatgtaattaatggtgccactgacaaagacaagggaagtggagaggcagctggtttgtaagagaagagagagggttgagctttgggcaaagtgacatcaaagcagggaattcatgttcaggaatagacctgggcaagagcgcacaactacaagaacagactggaggccctgatgaagctgtcatcgcttatacttctcggcgtgtcccttcaacacttcaacacctccaccaaaccaccactgccatttagtgatagcttcttaaagctcaagggcagaagaaacatcatgaccacataaaaagaagatttggaaataactcattgaagctatttattcaaattaactcatcaaatgacataaaggtaggacatctgaaaagatgtggagagcagtgagaattctgtgtaagatataaaggtagatattacttctatttaaaaaaaagaaaaaaacctctggactgccgcatgctattcacgtatcgcttttggcatttttcgggaaactgcagctgtgttttattagtcagtgttctctagagggacagaactaataggatatatatatatatatatatatatatatatataggagtttattaaatattaacttacacaatcacaaggtcccacaataggctgtctgcaagtctgaggaggaaggagagccagtccaggtttcaaaatgga

SEQ ID NO: 1772 - DNA, 180327 bp, Homo sapiens
  LOC285768 gene - 906241 - 1046567 of chr6; NCBI Entrez Gene ID: 285768; Build 35; sequence includes 20,000 bases upstream of initiation codon and 20,000 bases downstream of termination codon of the gene
gaaaacagcaagtaattaatttcaccacctagcgattattaatggctaatacttcgctgtgtggatagaccatgcttccctcatccttcctagggtctgtgggtccctgatggcatatcaggttattttagctagtgtgaagataaatatcgtgtgtttttttgagacagggtcttgctctgttgctcaggctggagtacagtggtgccgtcatagcttatggcagcctcaaactcctgggctcaagcaatccttcctcctcagccttccaagtagctaggactacaggcatgtgctaccacacccagctaatttttttattttttatttttatttttattttcttttttttaaattatactttaagttctaggggtatatacccaaaggattataaatcatgctgctataaagacacatgcccacgtatgtttatcatggcactattcacaatagcaaagacctggaaccaacccaaatgtccaaaaatgatagactggattatttttatttttaatagagatgtggtcttactacattgaccagggtggtctcaaactcctgggttcagtgatctttccccctttacctcccaaagtgctaggatttcaggcagaatccactgtttccagcccagataaatacctttaatttaatagtttagtattcattttaatgtatatcaggaaaaaatatctagctactctatgtatatgttatgtcatggacattattgcttagaatgaggctaaatgaaaaagagtcaatttgtttaaagcagatttaaaaaagagtgttaagtaaatgtagaaaaattgtaggtgactaaaatctgagaagcaatgttcttaatgcttgtccttttgttggacagttaggtagtttccaatgttttgctataataaacaatgctggatgaacggctctgtgcatagctctttgtttacatatgtgattatttctttagcatggacgcctagaagtagggttcttaggttataagttgatattatgaatagtagcactggttttggctccacaacagtgaaatcttggaaaaataattttgtctcagtttcctagtgcttttgtgaatgaaaaataaaaaacgtaaactttaattcataggatcaatatagtaatgcagatcaattaaatatatacccaaagatctttgagctctccaagcttctcttcagttgtgtatccaactccagcagctacgtgcttgtcagaaggaacggtgctttgagagctcctgacagaggtaatggatgcttctggctcatcgcttccttcttacccatttcaccagaagaactggaggggaaaattcaggtcacagggacaggacacaatggcccaaccaaggctacactacacagggcaagtaggacaggtactagaagctggagactccagagggtgaagcatggtgtccaaggggtgcctccttctttgttctgattcaccaatggataactttgggtgataacaaataggacataaaaggggcaaatgatagtcagtacagattaccaagaaattactaacaattgatgctctaggcagaaggcaattacctgaaaactgtatgggcagcacacaagttcaactgcttgaagtgtgaactaatttatgaatttacaggtagattcattaaggaagccataagtgataactggggttgacttaggcgggagaaattggtatgaggtagcagggcaacgtgccaacacagaatagagtaaaattaactagcatacctggctgacagttcaaatgactcctgagtgtagccttattatgtgctgatctccagccgagccagccagctgtagatagcccatgtgacagaggtggcttactgttctccagtatccactctcccatggtgccttctggaacccctctagctgttggaaacatgatcacccatctgcagaccacattttcttgtctaccttgcagctctttgtgaccgggggttaagtttgatccaatgggaggtgagtagaaatgaagatacattcgatgtctcttctctgtttttctcctgttagttggagaaacttgtaagccaggtgctgtcaagactctctcaccttggaccattcatcactgtcttgctacctaactgtcttagtctgttgaatagcactgactgggtaatttacaataaaaggaacttatttggctcatgcttctgggggctgggaagttcaagattgaggggccttcttgtttacatcatctcatggcagaaggtggaagggcgagagagggcaagagagagacaaaagagccaaactcatcctttcataaggaacccactcctgcaataacaaacctattcccatgataatggcgtcaatccatgcatgagaacagtgcccccttgacacaaacatctccaattagatcttacctcccaacacggccatacgggggatcaaatttcccacagatgaactttgggggacacattcaagccacagcattaagagaaaaaactgtgtcttatgtgggagatcatgttacagcattattattgcattttacctaactaatacaatgtaataactgcaatagctacttgtctggcacaaagccctgctcattagcagtaggttatgtgtaaaatgtcccccatgccctctgaagcatccttttgcacaagaggtcaacaacacaattctagatgcgggaattttagtggctgtgaaactgggaagagaaagcagttgttcaagtctgatgttatcaagggaaaaattgtgccctccatatcctcagaataaaacaaaaacctttcattatgctttttttatctggatgaatgacaggggcaggtgggaggtttatttagttatctttcctctactcagctgcagagagagatgtcaagaaggcaaaggtcacactgcagggtaagcagtgtagaacatcctgtccattcgaaaacccactctgtaacaaaaaaaaaatgcacttttgagtttctactctgttgtttttttcatgattttatcactgaaacagcaagagagtagaaatctaaaaatatctacttggactcagatattcagaaaagccaattgataggttggtaataatagcaggattctgggatctcggagcaacagcatggccattctctccacttccttgcttagaggcagtcgctcgctgccttccctccctgcacccgttttgccttctctcctggcttggacgtagcccctcactctatgtagtgccatgtccttggattggaaaagggtagtggcccaatgttccaacagagatgcaccaggttccaaagtggggaaatgactatttcatactctcatttaaaattccagttctattaataattgattattgtaacaattacaattgttacagtttctataatcaacatttcttattttgtttgtagaaaatgacaaaatgatttaaagtgctcttttggaaaaagttgatagactcatattttattgacaattggaccactcaaacttcctcatcctactaggtctctttccagagacagaatgaacttctagctgtatgtgaactttgttcactttggtatcgcaaactttgatagattcaacaagataaggtataccaggagaaaaaaagtaggctgaacataagattgaaagacagaagacacaggttcaaatctattagccatgtgaccatggcaagttaaatatgaaatgtatactacctctcttatggactgtgaaagaatcaaagctgatcatatgtcaagaatgaaataacccacaaatgctatgtgatattaattactcctattgctggggcttagcctttcccctgcctgctattccatgcatctgtagggcagtcatttccaagaattgaaagtgggcctcttagttaggaaaagctttgtctccatctcaccactttgctctttttttttttaagctacactatttggtctgttttgcaattaacattaagagcatatgagatttttacatttcccaaatgtggattattttctaaaaaggttgtgcagcatgattctaagatagagttcttcatatggctttatgatctgtgaagtcactcaaaattgcttgtaaaaatgtgtgcttggatgtaaatttttctggagagaggaggtcttagtcctttttctcttgctataactgaacacctgagactgggtaattaattttaaaaaagaatttatatcttacagttctggaggctggaaagtccaaggtcaagaagctgcatctggtgagggtcttcttgtggtggggactcactgcaccatccctaggtggcacagggcattacctcatagggggctgagcatgccagctccggtctctcttttttctcttttaaaccactaacgcctcaccctcatgatcttatctaatcctgattacctcccaaaagtctcacctctcaaataccagatatagttggatttttacccacttaatatcactacaatggggattcagttttaacatgagattccaaggggactaatactcaagttttgaggttcagctgagtactctagcaatgactagagttcacacattgctctttgtatgagtctgagctcattggttgaattccttcatataagtgagggctggcattacatactataaatcatttggatgatggactaacatattcacactcttttatcaaatgtggaaagattctgactatggaatgtctgactttcatgtgtcacttctacaaatggtggccagactcaggacgctttcctctctgcacactattgcctcttggtattgtcttcatctttactttctccttcctccttgttggtacagacaccacactgatgcccagcaccttcctctcccagcccccgcctgggacttggcaccctgattggtccaagcagcagcccatgactagactgtggtccaggctggcgagtccaggatgagagcatacttgtctccaaaccagcatctcctaatgaaaagaagcagcagcttaaaatcatctgatcaagggctgatccttcatgttcccaggctctgggtgaagcagggagatgctcatttgtgcctctgtgcaatactggggatctctggactccatgaatagagtggctgccatcataatggagagatttgtcttttcatgggtttggaccacaatgactcaaaaccactctgtttgacagaaagacattcttctttttaaagttgagcttgcgacatggctaagcaacgtaatatcttttgatgttgatgttttagtttaaatttagttgggtttcagccaaaacataaactaagagatattggaaaagaccttggtttgaaggacctaccctcctcttcactggactagatctgatgctacccattggtatgggaggagaggttaaacctagagagttcacttcctacgtggctggggcctaggactagttaacatttgcatctcagctgtggggcattgatggggtgtggcaggaaaaagattcaaggagggagacatatttccacaagaaaagatgttcttctccatcccttttgggaaagatatgatatttccgatggggatacagagaaggagatgcttggggtgatggggccaacctgcaaataggatagctaggttaaaagtccagggatcccacttctgaagggtggatatcttgtgagacacaaggaaaagtccaaattcactagaaatatgccactttgccaactagagacttccttttgaaatcggcctattccaagagtaaagaaatttacatacactataccaatactgggagaacaaaagaactggatgacctcaagggcggggctaattctagtacctctcctccagcagatgagaggcatcaaatatttaaggaactatgccttagagttctaagccacgacaggtagtcaccacagggccaaccacactgaaagaggggaattagaaaatgactcttgatgctgggggaacttgttagagagacagtgaagccatcacttctcacagccctaggcagctctttttgctcccagggataaaagggattcatctaagttatctataaatccctttctgatatacctgcctcgctccctcagagaactcaccttgtgagctgtggttgggattgcacacaggatgtctgcccagcaggaatattaccgtttttactccataccaggaactgtaggggtgggaacaaggaagaagacactggtggaggtgggaaaggaaggacattactgcagctgggggcaagagaggaagaaaaaggaaggaacatgtcaccgactttcacgccaggaggaaatctcctgagtttaaacagctcttttccattactttgaggcctatgaaagatgaaagtcctggtcggattgggtcttggtgtctggccacatcactttactctgagtcagaaaagactttctgaaaaagtacaccagagatgtccagagacagagaggaaaagaagccccctgcacccagctcaaggttagggttagggttagggttagtgttagggttagggtgtaggaagcgtaaacggttgctggttgctggaggcaaaccaacagccttgttcattcagtgatagagtagaagtagctttttaaacaaaaaagtagagtaagagagtgatcagagactctcaaaacactctcagaaagacagtgttcaggagggtggcaggaaaacgcgattcagctgttcatagggttgggaggagccaggtgaaagggagagtttgggaaaggagaaaggggtgctggtggaccagagggagaacttctcaaggggccttcttcctgggctgtgatggaaagccctactagacacataaaaatcacaagaactcgccctgagtgatatatataaatacactcgctaattattactggaagagagcatgactaatgcaggagcagatgttttaaaaaataaaaggtcacaaacattttcagactattaaagcatttatttatgtagtaaatttgcatctggattttgttgttcctgctttgatctctttctctcacacacgcagcgagaggctggtgttggaaaggtagaatacccaggcaccatagctgtgatagaaacagtcagaatggggcaaagtctcctgaatatgcttgttgtttcaaatcagaggagaacggaaatccccaggattataaatcactcaaaaccatcaaatgacattggttatctacacaataacttcaaataaatgccttttccccagaacggggccaagttgcaatgattaatcttaagttactcttgggctattaaataacaatctcaagatcttttttgaaaagcaaatgtctttttcatataagcgagaacctgtagtatttgttcttctgtgtctgccctatttcacttagcataatgtcttctaggatcattggtgttgtcacaaatggcagattcttcttctttttttaaaactagataatattccattatatttaaatactacattttctttatccattcatccatcaaaagacatgattccatatcttggctgttgtgaataacgctgcgataaacacaggagagaaggtatctcttcaacatgctgatttcaattcctttgcatatatacccagtagtgggattgctgggtcacatggcagttctatttttaattttttgaggaaactccatgctgttttccataatgcttgtaccattttccattcctaccaacagtgtacaagagttccaatttctccacatcttcgccaacatttttttacttatatatatgtatctatgtgtatatatatatatacacacacacctatatatacgcacccacataaacacacgcacacatatgaaatagtcactctaagggatgtgaaataaatttcatcatggttctgagttctgatttgtatttccctgatgatgagtgtgatatcaactgtttcatatacatgctggccatttgtatgtcttctttggagaaatgcgtattccatttctttgcccggttttcaatctggttattttgtttttctgctattgagttgtaaaagttcctcagatactatgaatattaatcttctatcaaatatatgattttcaaatatcttctcccattctgtaggttgcattttcctttcgttggttgtttcctttgctgtacagagcctttatagtttgatgaaatccaatttgcctatctttgcttttgttgcctgtgctttcgtggtcatacttagaaaattattgccaaggccaaagtcaggaagctttttctctgtctttttttttttttttttcctaagagtcttagtgtcaggtataactcatagaagcagacagtagaatcatggtaaccaggtgctggggacaggaggagagggggaggtattggtcaaaaggttcaaagtgtcagttctgcaggatgagtaagtgctggagatctagggtacagcatggcgcctatagtaacaatcctgccttatatacttaactacttcccaagagtgtagatgccaagtattcttatcaaaatcagtgaatagggcaagaggaagcttgtggaggtgatggatatatttacggcatttactgcagtgatggcttcatggctgcatgtgtatctccaaactcatcaaattgcgcacattaaatatgtccaactctgtgtttgtcaattatgcctcaattaagtattttgtaagctagtagcaaatttacatactttcaatggtggagccaatttagaaagcagtttggcagtttcttaaaatgttaaacatagatttaccatatgacccagcaattccactcttaagtatctatctacacaagagaaatgaaaatatgtgacacatatgtctacacaaagacctgtacacaaaggtgcatagcaatattatttgtaataacgaaagcatggaaacaacccaaatgtccatcaaccagcaactggatcaacaaaatatgctatatctacacaatggaagaatgctcagccacagaaaggaatgaagtgctgttgggtgccgtggctcacgcctgtaatcccagcactttgggaggctgaggtgggaggatcgcttgaactcaggagttcgagcccagcctgcgcaacacagcaagaccttgtctctactaaaaataaacaaataattaatgatcataataagaataaatcagccaggcatggtggcacttgtctgtagtcccagctacttgagagaatgaggtagaaggatggcttgaggttgggagattgaggccacagtgagctatgatggcaccactgcactccagcctaggcaacaaagtgagattctgtctcaaaaaaaaaaaaaaaatagttaacatatatgatgctaagtgaaagaaaccagcttcaaaataccacatattgcacgattccacgttatgtaatttccagaaaaggcaaatatgtacagaagaaagtagatgggtggtggtggttgtgctcggagtgggagtgggcagtgtctgctcatggcaggaggcttcttttggggtgatggaaatgttgtgaaatgagcttgtgatgctggtgcacaactctaaaaacttactgcaaatgagccagttgtatatttaaaaggaaattctgtggtatatgaattatacctcaacgaaattatacacacacacacacacacacacacacacacacgaacttccccattccaaaccatgtcaccaacctacgttttcctcttttcctcctggcttgcgtttgttctgcagagcctgcttagtaaggagcgtcctgggttctgttcatgcagacacgttcagacatctttgattctggagaaattccctcaagtcacacttttctagataatatcacaggtgccacatgaccagtttggcttattttaaaatgcatttcagaagcattaagaccaaaaaacactctgcagaagagcctcggctagcaagctcctcccagtcgccttttggaatttgcctttttgtgaaacaccaacgtgtctgtaggtgtggcagtaatggaatgtgaggagcacaactgaacaagtcaccaaacgtcaatgaaccagctcactgctgcttctggagaacagcccgtgacattttccaaggtaaaaacattgggtttaactggcaggctgtaaagaagacgcagcgtgtgaaggagcctgaggctgttcagtgagaacgagggggttccatgtgcgccgacgaggatggagagcctcattaggtcaccacacagagtgctgggaaacagctcaaaacacatgacaatggcacagacacatacatggtgtctgtgcgtgtgggtgtgtgtttacacagggcatgccaagctgcccgcagtaattttttgtgagggaggggaatgaaattggttgaggaaggggcagggcagcgtcttttgtttatttagcatggacatttctggattgacttttaaaaatgagcatgtatgaatgtggtaaataaaagaacagagagcaggtgtgatggagggctgaccaagttgtctggttgcgtcctgcactctttaacgccttaagaaatggtacagatgtaggtcccagtacgagggtggagaacatcacctaggtctgcccaagtacttagcaccacattttttttagacactttgtcagccaggctggagtgcagtggcatgatcatggctcactacaacctgaaactcctgggctcaaacgaccctcccacttcagcctcccaagtagctggaactacaggcatgcaccaccatgcctggccaagtttaaatttaaaaaaaatttttttgtagtgacaagatctcactatgttgcccaggctggtcttgaactcctggcctcaagtgatcctcccaccttggcctcctaaagtgctgggattttagttgttagccaccgtgcctggccagcgccacactctggtacaccagccacacagtaatgagcctggtctgtgcagctgctcattggacattggaggttaatcaggacccatctggctaatgaaacacttcattgcacttgctgccccctggcttatgaacattttccatcatagctaagactggattaatacaatgtgaaacaaggtgacagtttatcctggaaagacacgcaatattaaaaatccacatgatgggctgagcctgcctgattgctttaaaaggtggatttatttcttttatcccgaaaggagttgtgcccacaagcactagtgccagcccttccatctgtaacttctccttctcttttagaaaactatagtagttttaagatggttttgccccaggcgaaaacctcttcatcaacactgtattcaccacatgacttttctgtggtatatacatcaagagaaaactaccggatggcttcttctgtttgtctgtgttccagagtctaatgcggctgaaggtggcacatctcagctcctggtggatatgaaatattttccatcctggaaggtctgattggcttggaacagagctaagtaggctacggttcctgaagccaaatccagctccagcctgtttttgtatggcctgtgagctaagcatggtttttacattcttaaatattgaaaagaaaatcaaaagaagaataaatattttatgacatgtgaaaatgatatgaaattccagtttcaatgtccacagatgaagttttatgggaacacagccacactcgttctttgtgtattcgtgccccaagaacagaattcagcatttgtgattcagaccatatgacctgcagagtctaagtatttgttgtctggacctttccagtaaaagtttgttcaccttggcctggtggagtaatattggcatcaaggtctttggtagtgctcacttggcaggagtccaaattgaagttctccttgaagattcctgtaaatggtgattggtagagggagtcaccctctagccatctgggaggcacaggtgacttgtcctgagatgagctgagtggcccacctggggcattcagagtgggagccctaggcaagctagttagatgaagactgccatccttagagcacggcaccacactgcgtgtcctcatttctgagatactgttcatggtaacacacaccattgatttagtaacagcttttctaggaataaaagacacattgcttgcataatgcgtattaattttgaaaatgctaatgagaaaatatgttatgatttttaatgtgattgcttccccacccccacctgactcccaagtgagcttcctgggggctaggactgcacccttatttgtttttgcaacccaggatttcccccacagagctccaagatgtcaggaaactttgcagaacaaagttttgcaatcattggtgggttgtggcatcaatttagcgaatacactgctggcatttaagaaataaaataggaaagacggactagacagattagaacagaaagatcagagtagactagaacacaaaacaaaaaaacagaaaatgcacatcccatagcataaggttcatctacgatgcccttgtttccgttacatatgtgagtgatgggaggtcatgtcaacgtatttctcaccgtggatcatagtaaaacaagtgtgcaagtccctgctttggtgcatgtatttgagctgcgcttggtcacgagatgagattgcacaaattggcatgtgtcacagaagcatagagcagtgggtgtcaggtcaggtgtggccttcgggtccccaccaggctggtgaggatggccagcccaccagcaaatgctttcccagagcacctcccaaggctctatgctgagctgagtgtgatgaaggtcacaaatctctaggtgacatgattcctgtcctcggggagctgatggtctatcaaaatcacaaaatcacaccccaaagcaggaaggaacacagtgagatttggggatagatgttgaaggtgttgggtgcagaggaggcggagaccctgacagctctgctgtgccacagctgtgttgctcagccagatccagacgcctgatctccagggtgttcaccagccacgtggcatcctcccagtttcctgaggcaaagatgccgaccaaagcgccgtgtcagttcacacatggaacacggtcatctccaggtaggtagactggaccacacagtgccattggcctctttctctagagagggaggctcgaaggtggggaacacaaacaggctgtggactgccttggccccacaagagtctcaggccccaggccctagaacttcaacaggagaggcgagttgaagaaaaccaccccaaaggaaaggaggagcagagcaaatatctccctgagctgccaggacccatctaagcagcctgctggattgaagcaggagacggcaatgtgaggaatggggaggagggcaagctgtgcacgagatgccaccccacaatgaaacaccaagggactgccagcattgtgctccggtaaatgcccttcatcctgatccagccaccaggtgagaaggagggagccctcacctccaacccacctcccaattcattagggtttcccacaactggcaacatggctggaaatcctgctgaggaagatgagatggggcctgtgctggcccatgggacatactgggagcagaggatgcaggtgtctacaggatggttagcaggcgagtgtggcagagtcagcaaggttcagcacactgaaccttgcatcaagtggagaatgggaggaggaaattgagattcggggtgaagaacaggccaatcagaaaggatgcaggaacgagcacaggatgcttattcttctgggctcctctaaaatgagaagccttccttgtcatccatccccatcccccagcagcctaggggatgggcggtggctccctcttctccaatgctgccccctctgcaggtatctgcgtgtttactttcctttgctatcattactgacttctgaaggggaaggatcaggtctcccctactctcatgtgcccagagcctctgggccacagcccctggtgcagagaagcagcactgagagcaattttgatgaataaatgaatgaatgaggaaacgtggcgggtaattattcagtcattgctactgtctgaatgtttgtgtctcttcaaaattcataagttgaaattctcacttccagggcgatggtattaggagatgggaccttcaggaggtgaggaggtcataggggtggagccctcatggatgggattagtgccctcataaaagagccctagagagacccctggcccctcctgccacacgaggacgccactagaagctgccatctatgaagcagggaacctcaccagacaccatatctgcagataccttgatcttggacttcccaggctctagagttgcaggacagtgaacaatacatttctgttgtttataagccacaaatgcttataaacaacagcccaaacagactaggaaaatcatcttccgaaggtatgaatggtgagcttcaaaacatccccttagggttgagaagggaaattagcttaatctgaaccttgggcatctggtgcagctacagcagagaatttcctgtttcaagtgatttcaaaggtgaacaagttcctaagaaacgtaagattacctaagtccgatcacagaggcccatggaagcacggtggtctaagtacgattactacagaagagatctgccaacaaatgacttagaaaagaacctcaggatatctgtcggctcaaagacattaggattttaggcaaactaagagtttgaatcttatgctggttgctttcatccaaatccaaatttttggcattgtgttttagggactgtatcttcttcacgtctgtgttcttagaaccacttagcagagggtcctggccgttataggtgctctaggcatacatttgtttaaatccacctggtttagtttcattccattttatggcaattaaatacaggtctgagttttgtttgttaaaatgattaggtttttttttcaagtgtgattaattggtatgagtcagcagctatttaaactcttactaaacagatacataagaaacgagggatactgttttcttccacaaaaatgttccaaaaaaaatgttccagctgaacatttatttcagctggaatttcagtgacttgaatgcagaatgaatcccgtggctcacttcctagactatttgccaaagaagatgttgccctggccatgatcaagatgacacaaacggtggccttttgcagggagaaccgccgtggaggcctgtgtctgtggcactggtagcttctctctgcaggcaaagaccccatggcttagttcttcatcagagtgagaattcatcttccaccttgagtggaacagaatgtcaaggagtgcatgaaaccctaggtttgaattgatgaaccacaggtctcaattttcccttttccaaagataacgatgacttcaaagaaccaaagactacgatgacaatgtattgcaggattttgcatttcagaaagcatgcctacacaattaccttgtttgcctcatgccttctttgctggcatgggctgggcaactattactattaagagatgaaaatatggaaggtcagagaggttaagagaacaattcaaggtcaggcaaccagggattgagcccctggagccaatgatttcacacggaactcctctctgtgcagcattctttgccagccatccttcccttctgctaatggactagggctaagaccatcacgatctaggtgtgaggtcattggcagaagatgcaggcaaggacaggtctgtgtagagagatttcccaatgttggaggctttcctcgccttgctgtttctgttctgaaggacgttctggaggctttgatgcagtgtgaatgaggccttgttcacagtttattttcatttgtagatgtgtaatcacctaaagtagttatgttatggctacctcaggaacgcaggttgtagtatctgagcttgtgcatgttcccacaggcagtcccagtggtcataagtcccaatgccacatggagtttgtttatacccaaatatacagtaatttcagttcactggaatccacacccccacctgctagaggcacctctccggaaggtgtccagacaaaaccaaagggcttgtcgtctgctttcctgctgtttctagaatatactcagctctcaattaacataaacctcatttggtttagaaaacatccatttggtttagaagtcagtgttgttttcaaattgcatctctagcaaacgattttttttttaggtctaataagcactgaatagattgtattaggttaaaagcaattgattcccaataaataaattctgccaagttatgctcgggagtgtgaagcaacagtgtttattggttcttatctacgatcatcaaaacctgttcctctcctctccttccctctttccctgccttcctttttctttccttctgtcctcatacttgacttcacctacttgctattatgaggaaaatattaattccctttctaatgtctatattctagcatgtcgcctcattaaattcccctgggtgtgcccttttacaattagtgctaccaagtaaataaacttcaaagggacgtgtgtacacacacagacacatgcactcagagacacacacgttcatttgcatgccaagaagagcccccattaaagtctattagcccccaaatgaggaaattcagagctctgagctctgcactgattttatctcatggtgtggagagagtttacaaataactcttaaggtaaaatgccatttttttcccctgtatgtaaagttaatattaatgttgtgtagaaggaatgcggctctatttctttttgagtggcattttctcattgtcactctccaaccctattcttagagacccttaggtggtattgtgtgtattcttttgtagaataatgaaatgtttatattacacagtcccattgtaagatcaatccacccctgctgggggattcataaacatcatctgcaggtggtcctggtgtgtcatcccccagaagaggagctttcatttcaggaaacaaccttgctgaggtcccacacagcccaggacaccagacccagtgctgcagcccacggcttcccgaagcccaaacagtaactgatggtgttgtcaccaatcttggctctgaaactagcatgttttaaattcctgcttctccaagcctcctgggcatgtgctctgtagccaaaaagagctggtaattacacgtggcttctgaggaacgagggtccaggcgcttatctgggaagggagattggtccagaccttcagcctctgggccccattcctcttctcattcttcagcgtagcaacttgttcttaaagcagaggctgatttctgtctgcatctctcaagcggcacctttgtttagccactaagttttctcaaactggaaatccatatgacgaagtataattttatggtctcctatcatatttggtttttctagaaacattcaagagcttgttccttctcacttagacaatattactgtcatcaaggtgtgtcttctcctagttccagaaccacttcctgaatttaaaatgctcttctggacattttttttttttccagataatggcaaagaaaattggtccaaagaaagtggaaaattgtcagagggcagtcaccacaatttttttttcttctgttttcacatctgttcaatcaatatcagctcctggcctcaaggcagtgtgacctagaggcaagagccctaggaagctggggatcagaggacagcatctcatgctgcctttaaccaggggcaccgtctcacagcaaacccttaacctctctgggtcagggagctcctttttcaacaaaacaggttggtctagatgggttctcctgtgctttccaactctctactttctattattctgaacttcatgcctcattgtatctgtgcgcctctggtagagttggcataaacccaagcatatgttattggcttagagaaagaaaacatttctgggtctgtgaaatcataggctttgcttgacgaagcttcgaggtgtgcgggctctcttagtgcagcgcaacaagccatcagccggcagaaagctatttctgtagcggagtgttaaaagactggtattcttcagtgaagaataatctgctgagggcaatgtgtttttattccctctgggatttatctgtcaacgggcagatgggagaagaagcaataaactatgagcttgcatatgtcaaggctttgattctagggggtgacttccaggccctgcttgagtaggagacattgtcagggaagaaaattttggactctcactgttacttcctgatctcagaacacaaagcctagtttttgctgagtctttgaggaaactccatgagcactcggcttctctctcgtgttttctgaaaccagaagtagagagaaagaggcagctgagccctacagaaccaaccaactgtggagaccagcagcgaacccagcgtgtttgtcattggtttgtgaatcttatacgctgttctctttgggatacctatttctcctgggtctttacatggtcctggatcaagaaacaccttttaacaactcccttcagaccctgcactcccgtgcattcagaggcctccttggcttagcgtggtggcaaccccagggtccaggtgattctgttgaagatctgagaacagagcttgcttcttcctgccacccagtttgattggaccttctccagacttctgggtgcatttccagagcatttacacaaggaattatgtaggggtcattgtgacaatggttgtttgtggcttctttgtataaaccttctgtatagaaattccagttgatcaaacagataaacggagaggtgatcagtcacattgctagatgacttttctctacctaggaaaggattctttatatatttaaataggaactcctgtccccatttcttcctggctctgccttgctcttatcttgactggtccagacatttcctggcatccagggcatcagggaggctgtaagtctgtgtttgatggtagctgtccttcttcaaactgctggctggaaggcagcggtccctgctgggtcccagagagctaggagtgcagcttggagaagtcggctctctcatcgtgagtcttccagaagagaatagtagaggacagcaaggacaaagggcgtgaccaggagacacatggcttgggggaaagagcactggcatgtacatcaggaggctggacaccaatctgcttctgccaccagttctcagggcaactgtaggctaatgaggtcacctctaggggctttctgtttcttcccccgtgaactgaatactgaatgatttctaaggcaactctcagcacaaatatattatgatgctttagcgtgagagaggtgggatttgatgtggggagggcagagctgaaacaagcatttgaaactgacacttcgggccgtggtcgtttagagatctgttagaagggaagacagacatctttagaaatagatatcaatgaaggggaactctacttgatctattaaacatcatgaatgtccatctggcccactactggatcttgaggtttttgagggcagggactcagcctggcttactcactgctaggtcactatcactaagaactgcacctgacatgataccctcaataaacaattattaaatgaatgaatgagatgacagtggttgccgttgcttctgctgtcaaacacagactccatttcctgttttccagggtcctgcctacccatctgaggacatgtctgctcatcacccatgtgcattctgtcacagtgggacctgtgtgtgttccctgctcattgtcgtttccatggttttgctgattctatgcgattcttccaggccactccaagttccacctcttccacgaagccctccttgattgctgggccctggttgaactccttattagtaacacccaggttagtcctacttaattcttacctgcagccaaagtggacttagcatctccttgcatgcctggtaaagtcaagggttttcagccagggcctgtgtataaagcagaagcagcacagagtctggtttgaagcttagtgcttgggttcagacagttgtgggttacaatcccttctacacatgttctctgtggaaaccatttggttctctgtgcttggaactcgcctgcaacgggacaaagccatctcacctagactgttgttatgaagattgaattaggtgattctgagaggcatttatgcgtcctccctgagtaacaatccatgaaaagtgggcgtcattgctgaagctcaaggaagaaatatgaaatttgattatatccttattcacggcattgggtcaccaactcagcactttttatgaaagtagcatctgacctggcaaaggctgtgtcatcttattacctcagaaagacaaatttacggggtcagacgatggatggcttgtagatttctcaatgggctggaaggaaggagagaaaaagagagacaggagagagtacacatttaattctgcttcccctagggtgatatttccttcctccccttccagggttctcaaaaaggcattctaggaagtcctgtaaaatacatgctcataaaaatctcataatttccacaaattgttgagaatttaaaactcggttgggagtttgctgtttcagcctgagacaccggggtcacgtttcagtgcctgcagtcttgagacagtaccaggcatctgggatgaagctgaggaaagaagatgtgggggccctgctggcctgctccttctctcgaaagacgcttaccggctgctggtgtgtcacagggctttaggatttggaaaaacagagggatttaaaagaagatagaatggtcagaatttcgagaactgtgtgctgaagtgccatctttagggtgctcataacacggccttacaacattagaggtgctggaatcatggaagaggcatctggactctgtaatgtccttccccctggaaaatctgctccagaagtgggggattgggagctgtcaacatatgagccatcttttgctccgttcaagatggtaggggcattctcaacatgcccctcactctgattctgcctcacttttattttagaattttccactgccttttctggaatgtgctttttcaaccctcaaaatctgtagagaagaaataagcagaaaccgaaatggctttctggtgttctccatgctctcagcttactggaaaatcgagccgcaggctcgaggctggactttaaggcagagcactgcaattatagtgctatggccttggcttcctttctcatcacccaggtacagtcctgcagtcctcagaggatgccagtcccacacagggggatccttctccataggaaaaccgaggaacaatgcaggttcgaggtgcacagtggctaagcacactcagtcctcaagatctttcctctcaaatgctaatgctaccttcagatgggctgctgcctgctaccatttcaacattgagtcctttaagatgccatcagagagaggggaagcaagaggccaagaaaaatgaaaggtaagcacaagaccagtagaatgagtggggagatctgtctgtctgtctgtctgtttgtttgtttgaagtgtcttctgcttgactgcagttactgttcttcaagtgagggcgaagcgcttctcttctcctctctgatagctctgcagctctctaagtaaactctttgacaaacacatcgcagcagcgagtggaaacatgtctgagacgctgcagcatagcccggctggttctgttcttagcagtatttgctaagttccatccattagaatgtttttaaacaatgggacgcatgtcatcttgatttgacaggataatcctgagtttatagaatttcatcacagtgtgtgaaactggtttttaacttcactatactggccctcagcggtggagtcaactgggcactgaatagaaaaatctccctcctccgtgttgtccccagcccaccacatttcgccctaagctctgccctgcaccaacaccagccttcttctggagtttggcagctgtggcaactgctggctgtctctcaaccacttcacaatatgtatcaatgtattctacaaatcattgtatttgccaagcattctactactacacagttctgattcaactgacgtgtatcttagaggtcaatatattttctttttcccttagcttggctaggactccataggaaacagctatttgagtgatgatatataggagaaggatagtactgtatttaactgtctgttaatatcagagaagatgaatatttttcacctccctgtacatagctatgcataagcttggtattcatttatgaacaatgtagcattttcaaaggcacaactgatttacttacattaagtcaatataaataaattatgttagtagattgcgaattttgaaagttgtaatcaacatcaaaaatgaaatgtcttggttgtccaacttaaattatataatgcaatttcaacacagtaaaaaaaaaatcacctagcgtaatagtgagagtttgaatcattattagttagattcttgtttgtattaattaagaatttcacagacattgtttgtaagtgaaaaagatattttaaataagtatttagaacaatttttgttttgtgatccttcatgctgcctgttgaatgagttaagcaaaaaagaattacaaatggtttaaacagaaaaggattggcaaataaataaactagagttgtgctggagaaaagtgcaaaacccttgactcattttaaagatattttaaataaaatattagtgatcatttaaattaataaacagttctaagtttaaaaaaatcaggaaaactttaattacattgaaaattaccaatgtgtcctgtgttctaccaaagtttagaaaattctatttacaattagatgaccttggagattgagattaaaaaggtgagttagttcccagtccatatttaacatttttttttgtacagaatcccattattattttctcccttagaaaaaattagaagctaagttatgctatgtttaggacagatatgactctgttttggcaggtaatggatgtcaggaatgattttctaatggctagtacaatgttttggggttttttattttttaatattattttgtaattgacaaataacaattgtacaacagcacaatgtttggttgtgatttctactactgtcaaatgttgtcttctggtgactagacctttcgctttttgactgtgtttaagctggaagccctaaagccactgcagggtcaagcgtccccagtgcagtgatggtcatggggccgtcactacccactgaaagctgggagaggacagccctggcggggtctgcagtgatggtcacagggccgtcactacccactgaaagctgggagaggacagccctggcggggtcaactcccccccgatgcagtgatggtcacggggccgtcactacccactgaaagctgggggaagacagccctggcggggccaaggagcttgcagtgtcccatcaaccctcctggagagatgcctgagacccggttttacctatgagtctggcctcaggacaggaaagatggggacacgcacagctgaggcaagagccatgacagggcatctgctgtcagccacatccaccccagagggaagcatgcccttaccccagaggtgaggacacagagatccagaggcggcgctggtgcccttcactggggccacaccacagggcctttccttcctttgtcaaccttgctctgtgggccaggggagctcactcaacctcactctctttaaacccttcatgccaacccagaatctggctctgctcatccttgctacgctagagtgggctttactgttactcagaggctgacaaaaatacttgagaagagtcacttccagcacgacagaaggaggaggctgacaaatcatcttacctaaaagcaactattatgccggacaaaagtgtcaaaataatccttatggcactcccgaaaatggccaagtctctggctcagctctggcactgaaggtggtcagcccagacaaggcaggcactgcagaggggctcactgattctgagtgtggtcggtgaaagtggtggtcctgggggcaagcagacagggaaggtggcagctccaccacctggggccgtggtcagtcacattcaggcaagcagcaggctgacaggtccttccttcctgcctgccttccttccttccttttttccttccttccttttttccttccttccttttttccctccttccttccttccttcctcctttcttccttcctccctccctttacattacaggagttaagagtaaaccatactccgggcaaccatcaccccaaaagggagacaaccagaccttctgtgcctcccaatgaaagtccacattcaacaccacctacgaaggattcttaccaaagacaccaaaactgaactcaggcaaccctccagatataactaccaatttgcagaaaataaaagggatagaagaacacaaagatgcaatcagcaaaattcagacaggacaagcaatatttttttcaagaagaagaagaaaattgagggagtctggaagagatgtagagtaaactggtagagtgagacacttaagggatgcatgagttcagaacaaagtgtagacctcgttgggatcccagttcaggcaagcaaatcttaaaatgttcatgagactgttggaggaaggcaaacacagatagcataggtgttgacattaaagaaatcttaattttctgtgtgtggtgacggtattgcggttatttttaaaagggagtcgtccatgccttttgatgttatatatttttttaattacagattaacatgattttccaaatgtgcttcaaaataattcacgggagtaagtgagctcaggaatgcaaaataataaatttagctacaaggcgtttattgttgaaggcaggcaatgggcacgtgggaatttttaatataattctctgcacttttgttcctgttaggaactttccataatagaaattaaaagaagagatgaggtaggacaactgggataagcagaagacaagggtggacccacagcctctcctccacagattctgcagggccagggtgagcgtcagtgccctcagtgcctgctctgaggctggcgtggctggcttcactgccttcctgtctggcttcactgccttcctgtctggcttcactgccttcctgtctggcttcactgccttcctgtctgagtgcagcaagaggtggagggaggactggcgcaacttctgcaggggacaatgctttggacacagcagtcgtgcagagcccagtgggccgtgtggggacagaggagtgtgggtgtcaaaaaaggagaccacctttccattctcttgggatccttcttcactggaagatttggggcaatgtgcaccgcctaacctccctccactttcatgtcctcatggagaaaagggttccttcccccattcacaggtttgtggtggtgatcacggtggtttaatgcactagtttgctttcctgataggaggacataacggtagaaggtgagaagggcaattctaccatttggtaagaaaaaatgaagaaagtgggcaacagaggcagttgtatgaaaaataagaactactaaataatccacagccaatttgctgtggtatccaactgctatctccaagacaagcacccaaaagccaccaggaggccaaacccctgatttgctttcattggaaatttttttttttttttttttgagacagagtctccctctgtcgcccaggctggagtgcagtggtatgatcttggctcactgcaacctctgcctcccgagttcaagtgattctcctgcctcagcctcccaagtagctgggattacaggtgtgtgccacaacgcctggctaattttttgtatttgtagtagaaacagggtttcaccatgttggttggccaggctggtctcaaactcctgaccccaggtgatctgtctgcctcggcctcccaaagtgctgggattacaggcatgagccaccttgcccagcctttcattagaatttttctaagaactgacattactttcaagtcttccgtaatcaaaactaaaataacttttagaataagggcaaattgcctccaatagggcctggatgagatgatggaatggggtagggaaagaagagagaagctgggcctccaggagaccctcggctcaggactgaggagtgtcaggccccggtgtgtgtgtggtgtgtgtgccgggggtgtggagggttgcgtatgtgagggtggggattgcaggtacagtgtgtgttctatgtgtgtcgcatatgcaggtgttgcatgtgtgtgttgggttgtttgtgagaattgggtgtgggtgcatgttgggtgtgtggagggtttacttttgggtgctgtgtgcttgttgggtgtgtgtaggattgttttggatggtgtgtgtgtgaaaaatttctctctttaaactcagactttgaatcctggaggttttgctcataggtccctgggattctaggagaaagggtattttcttaggagaagccacatcactggactcttgaattgcaatccagtacagccagattctattagcctttagggtagaatgtgaaacttctcatttatcttaagcactgagccaaatagattttaaaaaaagaaagaaaaaatcaacacagatgttcagaaatgggtcatgagacagggccaaaagagaagcctctcagatcttgggaactatgagtcacttaaaaggactctagtcctgggagaaatgatacctacccttaaaaagattcccagttcactttctgtgggctggagcatttttcaggcatcccagaattgttgttctttgttttttgttttttgggggacagaatctcgctctctcacccaggctgtagtgcagtggtgcaatctcagctcattgcaacctctgcctcccaggttcaagagattctcctgcctcctgaatagctgggattacaggcggctgccatcacacctggctaatttttgtatttttagtagagacggggtttcaccatgttggccaggctggtctcgaactcctgacctcaggtgatcctcccgccttggcctcccaaagggctgggattacagccatgagccaccacgcctagcctgagaattgtttttttggccataaaatttctaagaaactatgtgggggaaaaacacttgaatagaacttaaatgataaaaataataatatttatgatttatagtgagtattttaatgctaaattgtgttgatgtgaacagtttttttttttaacaactcattgattcatccattcattcactcggcaaacatttctttagcatttacactgggcagacggcgtggcacagacagtaagacacagcccatgtcagggtcacactcataattctctcaccggacatttgctcccttctctgtgctagctgccggggatgtggcagggataagacaaagtctgtctctgccctcatagagctggcattctagcagggaattcagacaccaagttattaagtcccatgaggagaaatcggggggtcaaggaaggattcttggagaaagtgacaagccatctgcaatcctgtggatgttagctaggcaaagcaaaggctcctgggaggggagagagagggaggaggcgattgtaaattcagcaacatcctgcggtgatgctgaggtggctgtgagtgggagaagtggggtgtgtttgcagaactgaaggaaggctcttgtgtctggaccccagaggtgttggggagagttgggtgggagaggctggggaggtaggtggagcaaggtcaggcggagtcttggaggtcatcttttgtattccatctatgctgtgatcaaaaggatatggtgatgtgcttttgtttcaggccatcaggataaatggtatggaaggacatccccaagtctactgtctccatagcactgggcaacaagcctgcctttggttgggcctccaggtcacagctcattctgaaatgaaatgaaatctcttaaagcctgtgtttgcattttgggttgaaaggggagaatcagctatgaaagtacaatgtaaaaaggaggaaatatgccgggcgcggtggctcatgcctgtaatcccagcactttgggaggccaaggcaggtgtatcacgagatcaggagttcgagaccagcctggccaacatgatgaaatcccatctctactaaaagtacaaaaaaattaactgggtatagtggcgggtgcctgtaatcccagctactccagaggctgaggcaggagaatcacttgaactcaggaggcggaggttgcagtgagccgaaatagtgctactgcactccagcctggtggcaagactgtctcaaaaaaaaaaaaaaaaaaaggaggaaatactgtttctggttttgttgtgttggtcatgatggtagtcatcgttagtggacaacattagtggtttcatatgttatctagtgaattataaaagcacgtggctaatagtgttcatttttcattcattacaaacaatttctgcatctgaaatagaatgaacctgactacaggtttttattgaatcttgcaggacttgactgtgtgggttatacaatacatgaacctagtcctgcatgtgtgtgcatagatgtgggatccattttagattgcagagggtgtgcaaactgcttcttaattctcaaaggggttagaaaggctcaagtgcatttaaaaaatatacaggcataccttattttactgcagttcgctttattgtgctttgcagatattgcgggttttttcacactattgtgtttttaaacataatgctattacacacttaaaggactacagtatagcataaacataactcttatatgcactgggaaacaccaaaatttgtgtgacttgctttattgcaatatttgctttattgtgatggtctagaactgaacccacaatatccccaaggtgttcttgtaatagaattataggcctttgcgttgaaaaagacattctgtggccatgctgtattaggcaataaactcaaagggcagtaaactccagacataaataaggaagtgtcacgccacttatgtcagcagttgtgcataaaagggaatcttctactcaaatccagctctgactggatttactggaggctctgagcatctggtaggcatttgatcttgacccatgggagggttctgtggacttcagagtttctctccaaagtcttatgcccatacacatgccctgtctcctgtaagcatttggttcatactgcgtttagtatgtatgtgtaaatgtgtattaagtatgtttattcatacaaaatataaacgacttcacatattaggctctatgtgtatctttttcagagaggtctcctggctttgctggctctttataaccaaataaccacagaggcagcaaacaccttgacctggcagatggtcctatgccattactgcatatctgagctcacaaaggccctgggatcagctctggaaccagcctctacctttccccagaccagggaaaaggggaaaggttagaaacttacacattgtaaagatatacctggccgggcacagtggctcatacctgtaatcccagcactttgggaggccgaggcgggcggatcacaaggtcaggagtttgagaccagtctggccaacatggtgaaacaccatctctactaaaaatacgaaaaattagccgggcgtgatggcaggttcctgtaatcccagctactctggaggttgtggcaggagaattggttgaacccgggaggcggaggttgaggtgagccacaaccatgccactgcactccaacctgggcaacagagcgagactccatctcaaaaaaaaaagatacactaaggagtggaaattaaaaatgttttgtacagatttgagcacttacagtccaagacaaccagttgcctaaaatctgggtgttgcagatagaaatactctaaagggttaggatggtttctatgggtaactcctgagcctatgtttctaaggagatgatctgttgattgttaatgagtcctgtgagtgctttaaaaaagaaaaatggcatcgtatttgagagatctagactaaaactaattgtcacacacttcaggaaatatgacagaagaaaaggcttttaattttttttattttctcattattgaaaaggtcactgatcagttgagtacagatgaaaggttcttagagtagatcaatgacctgttgttagtgaaattcttggggtctgaatcttagctatttagagttttacattatcatctctaaatgttttgtctattataataatgaataaccagctgggcgcggtggctcacgcctgtaatcccagcactttgggaggccgaggtgggcggatcacgaggtcaggagatcgagaccatcctggctaaaacggtgaaaccccgtctctactaaaaatacaaaaaattagccgggcgtggtggcgggcgcctgtagtcccagctactcgggagtctgaggcaggagaacggcgtgaacctgggaggcagtgcttgcagtgagctgagatcgagccactggactccagcctgggtgacagagggagactccatctcaaaaaaataaaaataaaaaaaataataataatgaataactaacagactagagtttgtagaacttttgatatacattatttcatatgatagagtttaaagtcaaaagtaaccagagaagtcttttaacttgtacctaaaacaattttgataacctattgtgtttatggcaatttcctttattaatgtcttcactctttcttgggaatcactactgcaaaatagttaaaagaatatctctagtttcactaagtaaaaaaccaacaaaccaattgaaaaattgtcaaagggtagaatagcttatttataaaatataataaacaagccctaaatgtatgagaaggtgttcaacctcatccataataagataaatgtgaattcaatgagaatatcttttatcacctataaaatgggcaaaaattcaaagtgtgacagcacattctgcagatgaggccataagaataaatagatgtttacacaatctgcaggaaaatgtgctaattgaagggaaatccaggaatgttacgaaatcataaaagctgaaaaatcaagaatctttcaacctggaagtaccacctctggaaatttacccaacagatacacttacacataggaaaagatgaacatcaagatcattcatgactgtactgtgtgaatagacaagaactgaaagtgtccatcaatcctgaactggttaaatcatgacacagtcatgtgacagaatatgcagcataaaagaatgagaaggatttgtatcctgctatggaaagagctatgagatatataaataacagagaaaaaaaggtgtgtagagcatactacattttgtggaaggaaggtagaagaaacaaaaagcatatatttgcatgtgcttgcattttcattaaaatctccaaaggtatattccagaaactactaaaagttgtcaactgcgtattagagttggggtcaggagtgggcaaagagaaaacaggcaggaccagagtagaagcaagactccttacagcatgccttctagaatttttttttaaaccaggtgatgtgttacctatgttgaaaagaaactaaagtcattcaaaaataaaaatgtgggctccagaatgagctttcctgggttcagatcgagtccctgtcacttagcggatgtgtggcctcttaggcatcttatgcctcttgtcatttatttcctaatctttgaaatgggaataataatagtgcctaaattacgaatttggaattcaaagaggatagcacttgaaaagtatttacaagggtgcctggcacctattaagcatgtaatataggtttgccatcattatttctaagccagtgattcactgggagaggcgacacattggatttgaggagaagtgcattctaagaagattagcatttagaacaccagttattaggttagaaaaaaattagaaatgagttttattaagcagaataaatcttgatcttgagaattaaacttgaactatgattttaagaggaggtatgtaaatatatttttcattcagaataaaactacagtgcttaagacaaagtgagcagttactggatgaagctttgctagctaaaaggcctgaggcttgcttaaacaacagtaataatactatcttttgttttcacattactccgtatcatcttttattgtatatcatcttacatgtatacactgtctcatttactttccttaagatattccacccagctgtgtgagttggcattttaagtgcttattggcaaatatgacagtaaaatgagaacaagtcagggaaagaagtttccaatctctgtttgtacaaccttaagccaatctctaccacctcaacgggcggcgtccctgcagatggtacagaagtagagatggcaataaatctaaaagctgagtaagcactatataaggaacattcatttagcaattcaggatctgcttattttaatttgatcttgtactgtgccaaacactgatgaaaccacgatgagtagaatatggtctgtaccttcagtagctcagagagggactggtgtgtccacaggttaccatggtgagaagctcagaactgcagtgcagatatgtgggaggtacaggggtggaggagggagggtaagggtttcacaggtcagcaagacacttgtttggttcaggtgaaagatttccaccttggcaggaaaggagcaaagactttggaatgtagctttgaatcacttttggggctttattaatttttgtgagactcaacttcttcatctgttagatgggctgataattcaactttcagagaagttatgcaaattagaaataatgtataggtaaagcagctagaaccgagcctggtatacagcagatactcaatggacggtagcagtaatgatgactagccactggaatatagggtccttagggatggggatttttttttttttttttgagacggagtctccctctgtctcccaggctggagtgcagtggcacaatctcagctcacggcaacctccgcctcctgggttcaagagattctcctgtctcagcctcctgagtaactgggattacaggtgcccaccaccacacacggctaatttttggtatttttagtagaaacggggttttgccatgttagccaggttggtcgtgagctccctatctcaggtggtccgcctgcctcggcttcccaaagtgctgggattacaggcatgagccaccgcgcttggccgaggatgggaatttatttgctggttttattcacttttatatgcctcaatgtttctagaacaatggcatttagtaaacatatgttaaaataaaaggatgatggaaggagacaatagcagagaaaacagcacatgtaaaggaaatgcccgcttagtctggaggtagcagggaagtcacatggttgggcacacacctgtgcgtgtgtgcgcatgggctggcactcgtcgggagagaggcaagggcggggcagcgaggaggtgtctctaaagaaatttgaacagcaggtcctgccatcaagtcgatctgatattttaagagacatcatccataacatcactttttataatccccaaatacttgcttctggaaggagagaagatctgacaggaggtattgggatttggttctgtgatctaaaagagccataaatcttaggttctttttaactagtgcagcccaggatataaacactgtaactgtatttggatttaagttccgcctcttcctgtgaagcgaggagctgctttgcaggggagtatgaaatgcacacaggcaatctgcatgtttggcgttttcaaggttcagagttacctgataaaccaaaatacttcaggcctcagcttcctcaagctgctaaactctgcctgccacagcaagtgtggacaaggtgatttgaagccccctttaaccaggtcccaaatgacctaggacatttggatgtggagggttgatcctgagtctagctttgactaaacttagaagagagagactgaaggtaagaaaagttaagttgttcctgcttttacaaacgcttctcaggaaagccctctggttccagaaatgctgtggataagtaatctgaaacctctccaaatccagatatctctaagcgctaggaaaatgttagcaaacatccttttaaaacaataacagttaatatatagtgagcacttgttagatactatactaactactttatgtgctttattttgcttaattctccatgggccaacaagcagaactattcaaaaaatgatcctgagatctcagtctacatgatctaggaaatgagctggctggaactggagtttccccgcctcctcgaaggaggatgtgcacctaaactcagtttcccacaggaccagccgcaaacattccccaagaggagagctgcccctctccccaggacccatgttccctgggtgccaggcagctggccttcctcagatgccttctcagctctgctggcatctagaccccgacggcctggcaatcgagtggtccccctgtctccttactggaaagtggtgttcgtgttcatccttcgaggagataggacactcaggtcaggactgcagcccactgcatggcaaagagctttgtctttgcattggttcagttttccataggattatgagaagatggagacccctatgcctttggggcctgactcctagtttctaaatttccccagtaaatgccattccttagtttgcactatgtggtgttgtagaatctatcccagtgcccattgagccccatccttgcagcaaatgtataagttaggaattactatgtttagttagagatgaggaagttgaagacacagacaagttagctagtaagtggtaggatttgaaacccagtcatctgattcctgagcctgtgatctcagagaggctggtaaactcaatggatctggcaatttataaaggtctgaatgagtgctcaactcttcaaggaagcacccatgtggaagttcacatctaagcacaggttccaatctcagctgcagcacgtagcctagatttagtcttcagtggtgccttttactttctcctaagtctcaggctcatggcaccttggggccagctccatggagaaaataagctgagaaaaggaaggaagcaacatggctgggtctacagagaagacgcaagcttcactctcactcactgcatgtccaggacaaagcatgggagacggaagcaaacatctttttaaatgtggagctgagcttgcaaaaaagtatgggctgcttccgggatcagaatagaaaaaggagcccataggctgaggcaggctgggggtgggtgggtggcatcccagggacgtagagcttgggcttgcagccgctcagcgtaagcgaggtgggcgctgagaaccgtgcttgaatcctgcctctcaccagggccattagggattgctgtctcagtgagcgagcagcataaaggaaacgcctcccatcaaacagctatggtaacactgggcctttctgccttttctggactgggagtggacaaaagtctcccccgggaattctcgtcaatggccctgcagcacgtggaggtgaactatgcagattcagaagagctgggaagctatattcataacaagcttaacattatggtaaaacatcattattaagaatttttaaggcactaaacaataagaaaataggcaattctattttctttcaaccctagtaacatcatctcaatgtatttaaagcaaaacttgacaggcttacaaggagaaaatggaaaaactactaacttagttatccctaaattataataaactctgtgagggaaggcacctcaaagctttgctcactgtttactccaaggggctagaacagcaggtgcttgattaatatttgttaaaggaattggcaaataatgccagaaaaaaaaaaaagtcaaggattttgtcctggcccttctggagccacttaaggtggtttgaaagatgacagagtaagttcccattcccaggggacgtgtcaccagaggccaagtgccccgtcactggagggtatcaatggaggctgtgcagtccagccctggagggattcatgttgcctcctgggatctctatagaggaaattcaaccacccaaaggaacaaattagttctatgatcatgtggcttatttggatatggagtaattccttcttggcgatgtcccatgctcaagagagggacagtcagtgacaatttgggccttctggggtgtgtatgatctggcacacagcacactcctaagtgtgatgttatacaatctatccccttcattcattagcaatgaaaggttttagagcacagcaagcgcatttctatgctgtttctagctatgcaactaacaaagttgacgctattaactgtatataggcaattctgcattcccctagtagaatacacacattctagtcaagcccccacgggacgttgcctaaaattgaccaagaactagcctgaatgtaaatctcaataacaaacaagaattagggccaagtgtggtggctcacacccgtaatcccagcactttgggaggctgaggcgggtagatcacgaggtcaggagatcgagaccatcctggctaacacggtgaaaccccacctctactaaaaacacaaaaaattagccgggcgtggtggtgggcgcctgtagttccagctactcaggagactgaggcaggagaattgcttgaacctgggaggcagagattgcggtgagccgagattgcaccactgcactccagcctgggcaacagagtgagattccatccccagaaaaacaaaacaagacaaaatacaagaattagtacgcactagattctccagctaatatccagttaaatcagaagttaacaacgaaacccaccaccaccccggatggaatgatgacagttccatagtttcctttgggatccttgccctattcgttttctcatctttgtcaggtcccccaagtccagtccctgcacacaggaggcaaggtgggcatgtctgtcttgttttcagctttaaagaatatgacacacgaagggtgtggttaattgtggaattttcttttccttttttttttctgagacggagtttcacttttgttgcccaggctggagtgcaatggcacgatctcggctcactgcaacctctgcctcccgggttcaactggttctcctgcctcagcctcccaaatagctgggattacaggcatgtgccaccatgcctggctaatttttttgtatttttagtagaaatggggtttcaccatgttggccaagctggtcttgagctcctgacctcaggtgatccgcccgcctcagcctcccaaagtgctgggattacaggcgtgagccaccacgctgggcccaattgtggaatttttgtagctgtgttttccaggttaaggaatttcccctctattctttttccctgtgtttcagtgaaacaacattgaaatgtatcaaatgttacggtttgacaatgctgagtgggaagtatatgtgagtgcattactgtattttctaactttttctatacactttcaatatttcacaattaactaacaaacaaacacacacacatgcttttcaccagcaaaacgcccgctcaaatgtccttcttaacaatagcagccagtatggagcaccagccacacacagtatttttagatgatgcctgttgagtaagaaatttattcagaaaaaaaaaaaggaaatgagctccaattttcttgtacagtagtatgttatgatactatgggtcatacattgtataaagcgcctctcagttattggacagaaaactcctgaaaattagtttggggccaccttgatgctcaattggcatctattttcatgtgttttgcttactttatagtaaaatgaggcctttgggaaataatggtcatagtacatctactctatgtgatacagataataactcatctatttaagtgaagtgataatattaacagtatttattatatgtcaactatatgtgtgaaataagagttcaaagcacagaccctgaagtcaaatcatctggggtgaaatgccatcttggttggttgcttcctggttatgtagcctctaacaaggtactttgcatccccgggcctctgtttcctcatttgtaaagtgggcataatgacagcacctaggttttaacaccgtgcgaggattataagccaacaaaacatgtgagtgccaatgcataactcacagcgagtgagagagtccggtgcttcccaagcccttgctaactgccaggatctgcgcccagtgctttgcccacgttgtctgcattaatccttcagtgtcttgagagatatccctctattatgcctactttacacatgaggtcattgaggtttgtggttgcttaatccctgccttatgactggtgttgctcatgtataggatctgtttgatgctgcctccttgattagaaataaatccctgatttttatcattgttcccatgagaaaatattatccactttgcaatgatttacttacggtggtgttttggggaaggcactcaagcaaaccatgaaatgaaatgaacaattcactaaatcaaataaaggaaaaggaattacaaagccagcagggcagagtggaatggaaacagcatcaacctgagaaccaggacgcctgggtcctgctcctggttctgcctcagattaccgtctgtgaaatgacaggcctcgtgcacatggtaatcagcttcccttctatctgtgtaagcagtggcttgagaacgaggggaccagaatccttgttcttgttgcttcatttctctgccttcagatttcttgcctgtcaccttaatggattgaagccaggaacttcaagactcacttcctgttctaatatttcctttgccagaaaaattattccctttatcagaagttatatgtctcagaggttttagaaacaatcaggtctagtgctgaagaagtagcaatgctgaaaaagtttacagatttattacacagtcgttagtgtgcagttattaatttggggaaatgtcatggttaaaggcggctacaattttctgagtattgtgttatgatgtcgttgccatgcgtgttttatatcatagggacattgggaaagatttacattttttttttttaggaaaagtaagaacatattacttttgttataacacttgatattcctattctgtgagatcctgcatgcacactacacaatttggaaaacattttgcaacagatggcataaacagacccagatgaaactgattatttaatcagactaacctctttccttggctgatgacatgcactttccagcattccaatttgttataactttaatcagtttggactcccttggttttaaagtatctatgtcataaacagtcatatgtaggaaaaagatttgaaatctctccaaatccaaatgtgaagcttttcagccaagctctagaaggaaagaaaatgtgggaagaagagcagataggcagccaagacgggcgactccgaaatgtccgattttgcctttactggagctattgacttcattcgggacccagggcaactactcctgcttacctaggtctcatttatcccaactgtaaagtgaggataatagccatttatgtaccttgaaggggtaaggctgcgattaattagttaatgtgctcagtgtgctttgaagtgctaagtgctattaagcttcatttagattaccctaataatttcatgaactcggggttctttccaccagctgagcagctgggatctcttgatcagatttttcaaatggcagagcagttttaatgcaaacacctcaaaactggttcgtactggtacttcacattaagaaaaagagttaaacccttgagcaattaccatgtcccagtgtaccagagggcaggataatctcttcatgataatggaggtaaatattaacaccttttcccctttcgcttggttccctctcccctagtcttttatatctcttagagtttcacagtctgaaatgtttgcaacagaaattcagagtcatgaccttacacagctcaggaacctgcttggcaataggctggccgtgatgcgccatgctccctggtcctgagcgcacgacatgggggtgtgggtgtctcggccgggtgcttactgttgccgcagacacagtttcaaccggtagggaacaggggtctccgtttatcatctaagcccccgttgaagaaaaccctagaaagaagatggaggtttcgaacgggcttagtctgaagaggcacccaaactctttgaaaacagcttattgaaacacactggagctgcacatatcagagctcgctttctttcaggcgcttcctggaggtcaagtaagcggtggggtggccaggcaggggctggcggtgcagccggggcccacggcccgcacacttcgcgatgcccggggtccgagcacacattctgcaagctgcctggcgccaacctgcccccgcccccagggtaaacctttcccaggcgtgccaggcaggggtccgggaaaggacagtcagggcctcggcagtgtggtccgtggcttggggaaatgcatccttcccaccgtcagtggtctgccctcctcgcaaacaggcagcgggtttagaagtggttccagatccatcagcgttgtggggaaagttgctgataggaagagaaagtcagtggattccacgtcccgggccaggcccattggcttgcaggagaaacttagttattcagtctggtctttgctcatccagtctaaaagctacccaggggtcctgggcagcaacgtcagaaaatacttagggatagaagtgcaagttttatttaaaaaacaacagacactgttgagggtggagggtgagaggagggagaggggcaaaaaagataactgttgagtactgggtttagtacctgggggatgaaagaatctgtacgacaaaccctcgtgacacgggcttacctatgtaacaaacctgcacatgtaccctcgaacataaaataagttaaaacaatgtaactgaggaaaataaaactcataagaagcatagtccctttcttacctttctccagtcctttaatttggttcctttggatatatcttccacgtttgtggctcttatttgaggattgcgtgacaaggactacttaccttttttattgtatttaatcagtactttctaaatcaagatacaggagaaaatatgttctgttttttaatttagtaggctagcgtgaatttgatgtagataagacaccctggcttggtgttgcattctctgctggataaacattcctggcatatgtaatgtgtgtatcacggagatagcacagggagccgagctgcgataacttgctgggcctttctaacgagtgggttgagtgatttcactccaggcctgtccagtggtgcatgagctgagggtttcccatggtctgattggcaggcctgactctctgagagtagccagcctttctgctcctagacacttgatgtgtttacacaaaagtgatgggatcaattctatctggaacagagcagcccagcgtaaagcatctgaaggacagaggcttcggggatgaagattcccctaaaccacgttattaagtacttttcgttttgtttaagacggagttttgctcttgttgcccaggctggagtgcagtggcgcgatctcggctcactgcaacctccgcctatggttcaagtgattctcctgcctcagcctcccaagtagctgggattacaggtgcgtgccacaacagccggctaatttttgtatttttagtagagacagggtttcactgtgttggccaggctggtctcgaactcctgacctcaggtgatctgcccacctcggcctcccaaagtgctgggattacaggcaagagccactgagcccagcctattaagtacatttttaagaggaacaattcactaccatggcatctatttttaaaagtctgtaactgttagaaataggcctgaaaatgatattagcctacacagacgcataagttaacataaattgtaatgaatacctttgacagaaaaattggaatgcaataattgatacgggaaatgagtttagtgagtctgtctcacttttcttgctgtcttcctggggcttggacaaaatctccattttttgtttcaagtctttgcacacttttttctaaagtgatcagcgtatattttcctgccttgctacactcaatattattgaacctagttaaattgttttcattaataagcaatagagccaactttagcaagtctcttcctaagagctgctaagcccttcaggactctggctggagtcctctcctctatctgctgtcctggctttacccttaggcagaagggtaaagttggtctcaaacttttgagtaaccaaaggagcaggagtggtaagatctgcagaaaatccacaccctgggtcatcgggatgaagaactaattattgtcagagggaaaagtgagccccgcaagacagggacagagtcttgtacacagtgactgtacgatgccggcacctccagatgggctgagcccgagatagttttttgcagtattacccacgagcactgtcagcccctgggatgtgactacagttgtcacaagcaacaaagggattccactgcttgggatttaacagagaccaacatgactgtatccttatgtctgaaagagaacaccatgccttcatacctcgattaattaaatgaggcaattgtgggaaataaatcccacagttggggcattgtctttccttctaggcccctttctcaaggcttccaggcctgtcctcctgtgctctgtgctgtgtgcagagctcgtgtttcgttctgttctgctcatcgcccgtgactgctccccccatcgtggcgctccgtccttcctgctgcgccttctgagtttttcttccccagttgctggttcaggctgcgaggcctgagtctttctcacctacacatgtagagcagcgttagctgtgtgctgcccagatccagagaaccatttctctgccttcaaaacattgttcaaggactgctgcctggcctgccccggaaacatgcttctatcttcatggaactgtgggtttctttgttgcctggccatcggtgcttcgttgcagtaggggctgtggttatggccggggtaggcacagtgaattccagattggtccacgctgaagaaggctcctcgatgacagaaaagttggagaacacagaataaataaatcttgtgcccctctttcaaacactcagtgatgtcggctgccagcaatttccccgtttcatcccagagtgtgtttaatcaagtgtttctctctattgcactgtctgggaggaacattttttctccagttgctgggcaatatatgtcctgatgacttgaatatcctcccaatcgcaccacgtatgttgaaaggaggctttctattcactgtttcctaatggtggcattattcatctctgtttcagataagcgcctaacacaatttttggtttggttctgcccttttgaaggagaattgtaactcttttctgcttatagagttattgggaatattagggtagcagccctttggaatatttttgtcttaacacaaagcagaacggagaaagtgagcttaatgtcacaaagaagtaagacccgtggtgggagcaggagcttgcctacgcagcctagcagcccgcagctagcagctctcactgggccccctggcccagcaaccctggcctagctcagcagtggctgcacgcaccccagagaagcacaagatcccgcggggagcctgagaacaagttcgtagcttatctaagaaagccgtcagtgttgatcaagggtatggcttctgataacattttcactccaactccaaacagaatgacctaacttgccactcctgtgaacgtctgaagtaggtttagtcacaaagaagaaagtactagaacccttgcaataattttgtttgttttcatgcttattactcagcataggtctagaaaaaggctggcaaacttattctgtcagggacctggtagtaaagatgttaggctttgtgggctgggctgtacgaatacccagctctgccgtgcagccacagaccatccacaagcaaatgggcttggctgtttcccagtaaaactttatttataaaaacactgggctcctggggctggatttggtctgtggccagcagtttgctgacacctggtctaagaagacaagtgtataatgttctctaaacacctcgacatgggctttgctcagtagccaggtctgggtctctgctttctagaagctcccagaggccagggcggagtagggctgtgtccctcccatgagctgtgggagggctgctctccgcccaacaaggtctctgccctacctccctgccctctgtccggaatcctcttctgctttctacccagaaattctcagagtgcaagaggctgggctcctgggcgcagcaggagctctgagtctttctggttcctacatgactgaactaggcattggagcctcttccccgttgtctctaaacctagattttacttcctgaacttctggaacatgaagcttgcgctctatcaaccaaacctcgaagtctcccaattataaaagaacagcagggccgggcgtattggctcatgcctgtaatcccagcactttgggaggccgaggcgggcagatcacttgatcccatgagttcgagaccagcctggccaacatggcgaaaccccatctctactaaaaatacaaaattagccaggggtggtggtgggcgcctgtaatcccagctactcaggaggctgaggcatgagaattgctagaacccaggagacagaggttgcagtgagcccagatcacaccattgcactccagcctggccaacagagatacttcgttgcaaaaaaaaaaaagaaaaaaaaaagtagaaaatctaggaccattatgtccatggagaatcaaacaagctcaccggaatgtttttgaactttacacacatttgcaaacagactgaaataacctgagtaggagactggtggggcagataaatagttactaaatgattttgaagttcgactttgaatagttacctgaatagactttgttagctttggtagataatatatttggtagttagccctgtattcctattgtctttgctatttaatatagcaaatgttcaagagtttaggagactaggaggctatggaaacacaaatcctgactttcgtgtgtttcctcctgcaaagtgctcttccttgcttgtgttaacaggagtacaacaggaaaccacgttccattagatagcaatcctgggaaaaccattgaaagaagaaacattctgagcatgctttgtgaatagaagagtggatttaaacaaattaaccaacatttaaattcctcatctgtgggttattgccagaataaattcagtgcttgccttggccagagtttgtttggttttaaggggccaaaccccaccacagcgtagtaaaaggaagccttaccagaaatacacaggaagcctctgggaccaggggcaggtgcaggagctggaagggggctggaagcagcggggctctctcctgtcctccctgcctcctaccccaggtctctcctctcaggcttaacatggggaattgtacattttccagcatttctttgcaaaccagccttctctgcttgcttcttggtgtgcttagttcctagtgggcatccccagaagatcatctcatttctagaatcctcacacctcagagagggtcaaaaacttagaaggaccttcatatttgtatatcaggttaataaatatttattaatttgatggcttgacagattgaataagtttggtatctaaagataaccagaaatttcttggccaaacttgatattcctgggatggagaagctacttggctggacttgagccagtgtccaagatttgtccagccagctgtgaggctgtgactccctgcaccatgggggccataccttgtatcatcaagagggtttgcagaagaggcctgggcatcccaaaaggtacccactcttgtgctttcacttattctcaacaccaggttaccgaaatcaatgagctatcaatttaacaagtgacttaggtcatgtcacagcccaaacaatttggtgggctgctaagctagatgctccttagaccctgatgtatgtgcagttggtgatctcttggcagaaggggaagcgtggactctagtgaaatagtctattcccatgtccagcctggactgttctgtcgctgattcactacaaggctacattggggctggggagggggggacattcatcgacttaagacaatttgccttttaggaccatgtaagtttagacatcgtgctatgtcatgttctggactagaacgctccactagaaagacaggcgttgaccctaagggcactaccctacagtagggtggccatttgtcctgccttgccttggaccatctcagttttagcactaaaagtcccatggtctcggaattccctcagtctcagggaagctgggatggttggtcaccctcacctacactcagccggagccatagaagtgtggctgtgggtagctggccctgttctcatccagacagagaggaccatctccaaatatgattctgaaagcagcctcagagctaggaatgccctgttgaggcaatggctgcctcactgcctattttccagctcacactagcaatttccttacttcccagaggctgcaccccacaaggatttcgattccaggaaccatacttgatgcctggtttggcatcctggccaactgaccaggaaccggctctcacgggctgtatcctgcccagtttcagaacactgggggctgccttagtccatgtgggctgccatagtctgggcagcttataaacaacagaacatatttctcacagttctgaaggctggagtcagggtgccagcagagttggttcaggtggcttcgtctttttttgttgtatccttgaatgacagaaagagcatggggaacctctctggggtccctttagaaagcactagcctcattcatgagggttccagcctcatgacctgttaatactcaaaggctactcctcctcataccatcgcattgcgggttaggatttcaacatacgaaatttagtggggacacatttagtccattgcactgcccttgagcagtttgcagggagaaagattcgcctacctgcaatggcacctccagccctagaggttaaagagacacatactgacctgcagcttccaccagacagcaggttatcacagcaccacttgggagcctgatgtcacaggaatggttattgatttagcccctcctataggctatggaatatgtgtctcctgcggacagactttgtctctttttaaatttatttttggttcatgggtgtattcccagcaccaagaacagcgaacagcacatagtacacttagtaggctcttaattaatccttactgagtgagaacaaacgaacggagaagctgggagtacagaggccagttaggtggataaaggaaacgttccaggagagagataataaattaaggcctcaactagcttggttcttaggagaaggaattacaaagatcctcttttaggccgggagcggtggctcatgcctgtaatctcagcactttgggaggccaaggaaggtggatcacccaaggtcaggggttcaagaccagcttgccaacatggtgaagccccgtctctactaaaaatacaaaaattatccgggtatggtggcgggagcctgtaatcccagttactcgggaggctgagacagaagaatcgcttgaacctggaggcagaggttgcagtgagccgagatcacaccattgcactctagcctgggcaacacgagtgaaattccgtctcaaaaaaataaaaaagaataaattaaaaaacaaaaaataaaaaaagatcctcttttctctgcccggatagtccacatttttgtatttccttttacttgtgtatttcaaacacttcctcctttaggtaatcctccccaactacacccccaaacttggtttctcttactcctatccatatatataatgagtatgtgtgtaagtatatatatagacacacatacatacatatgtacatatttgtatataattgtttaaaaacattttgtaatgaaaatatcaaacatgaaatgcaacagaaagactagcacaatgaattccatgtacccttcacccattttccacaaaatgatcaatgtatgatccatcttctttcatccatagcccacttacttctcccccttcttgtattagtagaaaaaaaaatcagaaaccgtgtgatctcattggtatgttagctttttaaatagcttcctactgctgttaaaattgatgggtgttggccaggatgggtggctcacacctgtaaacccaacactttgagaggctgaggtgggaggatcatttgagaccaggagttcgagaccagcctgggctcctacaagagtaggagtcaggaagcgtagatttagtccaaatttcccggtaaatcagctttatgcgcacagagggccctctgacctcagtatcttcagctttttaaaatgtgagattaggccacatgagtggatctctatagaggccctttcttgacacatgcaggggtctggaggtctattttagtaactcagagacttgcttagatgtccccaagatccggagcataccatttggaagccttgaccccacatgaccttggcgataccttctagttctaatgttttctgaatgttcccacctgtgctctctggcctgatgaggctgagagctgctgggtgggactcccaggccccagtggtggccaaatgcctttatagtggctgggaggtatctgctggtttcaagactgttttaagcagtgaatcctgggggttgtggggaggaaatcaccctggtggcctatctcgtggccactctccagccctctctcctccaggccacactcctttggctgctgaggagctttggttatacatgggtgatgccgcgccatgtggcaggtgtggatttaattaaacgagggccaagtcaacggtaattgcctccccagtcatcctggtaattggacggtgaggctgtatctgcagggttctgtgtgtggaacaaatggctgtgtcgcaacccctattgccacatggcccagggtgactccccagcattcttctgccaagagacatggaaaggcccactcagaaacgcatggggaatggtgccctggaagcccccgtctgctgcatttctgtggagggtctgctcccagatggggaaggtgtgccccatctcacagtgtgatgccttctcctacccctggctagagtggctgaaactgaaagctctggtgaatgacatggcatttgctaatctgcagatacttagtcccccacccaacaacaaaacagtgactgagtgcctactgtataccagttaaaccctgcttgagcatgcacattccacttgttcaggcaagctctttctttcccttgaaatgtcgcccctttgtgtgagctcatcaaagtcctcccctctccatgcccagctcaaacatcactttttttttttttttttttggctgggcacagtggctcacgcctgtaatcccagcactttgggaggccaaggtggacagattgcttgagctcaggaattcgagatcagcctgggcaacgtagtgagaccctctctgtacaaaaacaattatccaggcatggtggggcacaactctggtcccagctactgcagagattgaggtgggaggatggcttgagcccaggaggtcaaggctgaatgtgccaagatggcaccactgcactccagcctgggcaacagagaagaccctgtctcaaaaaaaaaaaaaaaatcacttttcacgcttgagaaagaaagcttggcctcttctgaactccggtgatactcactgtttactgcaagaatgtgaattctcactcccgaccagccctgtgtgctgcttgtttgcccacctatgtcttagtgggttcctgggttgcagcttccttgaagacaggtggggaccttaaccctttcctttggggacactgtggtgcaatgggcagggttgccatcagtagctctgagcgtgcacattaaaccttaagcaaatcttgtttggtttgggatccctttgcctttactggaggggaggaagtggaaatgttgcaggaagatggccttctaagtgctcagaaggcactgagttcatgtctgggaagtgtccgtgaagtagtctctgattcagtagttggagatgacttgatccatgggagagagacaggaacagcagcaactttctttggttcctggtattttttccggctccagtcccagttcactgctccctagcttggtgctttctggagcctagggtcagggaccgctgccgaccaccctcctggatacagtgctgtttagggtgctttgctttatgggacactcaccagctgcccagggaagcagcaacagggaggccaagcatcccagtttgcccagcactgcaggtgttcccaggatgcgagactcccagtgttgtgccagcacagtcctggctggtcaccctaaccacagccatgcggcttcaagcatccaagggccaaacaccgccggggtggagagggtctcatgattagttttatctgattgtgtcagctgcgcagggagatgtggctgcatgctggtgaggacagactggaaccaaaagggcctgagccaaagtagttcacagataagctgtgctctctggaaaccacagcagacagccgtaaaacaccgggaagacaagtcctgcaaacacttgccagcgcccagcttatcacacacgagatgtataagcagagccctggaaggcacggctacctcgcttcggggaaacgtaaacagagaataaataacgagcctgcctcgggctttcccctgtagaaagctcgagaatgggaagcctcacttagagaggtctaagatgagttcatttaaaatttggggagattttaaagcccatccacattgaagtggatgtttagaagctcagctctgttctatggagtggtcacaggacggatagaagtggctgaggcctccactcactggccgccactgccactccagacaattgaggggctccagtccagggctgagcaatggcggccgtggggccttccctttgagaaatgggaaatgcaggcaaaccactgccctctcagcacagggatgatgtaacttgtaacatttatctctagcttaattattagagatggggccactgatagtacaccaaagtcagtgtgaagcttactccagtgacagacagttggtcaattatctgggcagcatcagattattttgatctttcagagggtttgatcctttttgcgtgggtcactattactgttttagaacatcagccaaataaaaagaaaaatgtttcatcttcacaaccctagcaggataaagcatttcaagaatcccctgcagaataataaacaaatctttataaattaactttagttaatccactggatgttgggaaattcagtgaaaccaccttcatttatttttggagagatgctgtgtccaggtcaggcaggcagaagatagagtcttgtttgacagggaggcatttgctgagcacataatgagagtggggagacacacacagacacgcacagacacgcacacagagacacacacacatgcacacacggagacacacatacaccacacacatacagacacatacacatgcacacacacacggagacacacagagacacacatacaacacacacacagacacacacacctacaccacacatacatacatgcacacacatagacacacagagacacacagacacatacacacagacacacatacagaaacacaggcacacacacagacgcagacacaaatacaccacacaaagatacacacgcacagagagagagacatacagatagagacagatacatatacacactcagagagagatacagagagagagacacacagaaagacagagatagagacacacacacagacatacgcatgcagagagagacagagagagagagactcacatatacacagagagagagagagagacagacacacacacagagacatatacacatgcagagagacacagacagacagacgggggcacctccgcctacctccgcgcctgatgtctgttctaaccccagtcccagggtatgtgtgacctcaaaatatatccccctttcatcatggtaactgagtgtgtttctatttcttacatctaggacagccatcatagctacaaaacagatggatgcggtaacacagaacaccaaaaacctccgcttaagactcggctgggaaattgagttgccttttttaatggaaaaggaaaagaatcacccataaggataaccttgaatttagaaagagcgggtgggtggggtgatcagctgggcctcttctgtgcatggtagagcacatttcagaattgtgtgtgtatcagtggtcactgtaatttaagaaaaaagaacaagaattcagaaaattatatcctatccgaaaaaaaggctactctaatgttcctgatgacttcattatcaactggagttatttatttttctaagaatgttatctttggagataattttcatcagtgagtcaacctttgtttgcttgcattggtttcaccttctattattttttacccatgactgtcagcttttaccacttactgaaccctgacggaagaaggacgtctgctcattgacatgctgacaacctgataagtcaccccacacacataccacacacacacgtgcacatccactcattcgactcgctcagacccagtggctagtgtcgatttttctctaaagttgactatataataatcacttcatttcccagaaactcatgtgtctattctttttttaaattaaaaaaattcaacttttattttagatacagaggacacatgagcagatttattacatggggatattgtgtgaagatgaggtttggggttcagatctcattaaataccaagaagatctctgaaaattacacaaatatatggaaattagataacttacttttgaatatctcttgggtgagcatcaaaatcatggcagaaatttttttaattgaaattaataaatatagggacacaactttccaaaatctttgggatgcatccaaagcagtttacagccctagaaatgccttcatcaagaagctagaaaggtctcagggtaacatctgtctcttcttactgttatgagtaaacagcgatcaccatgtacttttaggcattcttgcattgatgaagagggttctgtgtgcccaacattgctccaacctcgaaccagctttgaatctcctggggatgacatgctccaaggtcagctccttcatgctggtcatggctgtgggtgtgtctgggatgtgtgtgtgtttcctcacgtgcaggcagagtggtatttgctgggcaggaactgtggaatctgtggctcctattccaggcctctagtcaataaaaaccagcatcttagaatattccagtcaccaatagggaaaattgctcctgtaaattttgactgtgaggggcaatctcttagttcaagctgatgcctttctaatatctccatcttttaatggtactacaaaacgtcaaaggactctcacaaacctgcctcataaccagccattccagccatagagcaaagtgtgtatcattcttactgagtttgcattgaggaatcagaagctctgagagatgggccgacacatccacggtcacacagtcttcagaattcaccaggccaaggctcaggagcttccatgctttcttctttacttgtagaatttttttaaacttattcctttaagatctttcattgtactttcaacgcactcctgaccaatgcattttaagacaacagggctagcgtgcaattggatttcggagggcagtcatgtcaatgaaactagataagtcattgtaaattgttatttaacaaccacagaattgctgtagaacatctgttgctgacggcatgctcagggctgtttcttttcaagctcactgcctggctgtggaacatcagaccagatttatgcacgtgctcctcctggtttatgactatgaaatttgaagaacggctctcttggaatcgagtattttcttcaatttcctcttgccctctagtttaatctagtccatctgaaaggagtcccacagtattggggacgggggcagagtatggtggcttcacgtcctctgaaacctgttgcattatcagctgcactggcaggtcccaaagctggcagaggccagagccaaaggcctcatctacagatcaagaaagaagtgaagagaggagagggggatccatacccctgcgtccctccactccccagcacacctctgctcacctagctaatgaggccagtagaaaggtacgcatttgagttttattttcaagattttgctatttctttgagaagcctaaaaggttagttgctccccaaactcttgtataaatcagggctagtttcccctggccaatgtaccacttcctcctctatcctgatgggccttggagtggtgattctattatttgctcttttctctttagtgtaaatcttatctccccaatttccttgaggataagagccacgatttatgcttgatgatttagcaagtcctctgcaaacactcactgtggaattgatgggtaatagacgcggacgtaatccttaacattgtggatctggctcatctggtcaagactttgtctactcagatgagattacgggatcctaccttggcaagagtttctgtaggaattccgacattcctggaggagggggtcatgcgtgaatcagtgtgagtccgtctgatctcttcattcttgggaaccttctattccctcagaatgtagaatagtaaagcaggtaaaagcacatgtttagagtcagactttcatgggtgccccaaccaaggtggctgaccttgggcaaattccatggcctaaagacaattctgttttctcctctttaatatgggcataatcctggtaagtacttcataggcttgtgagggctatatggttggatccatatctagggtttagaaccgtgttcagtgtgaagcaagtgtttaatggatgcttgatattttcatattttcgtggttatcatactgcctctccatcttctctttcttttgttttgtttttattggcttttcttttttttttttttttttttttacggagtcttgctctgccacccaggctagagtgcagtggcatgatctcggctcactgcaatttccacttccctggttcaaggattctcctgcctcagccgtctgagtagctggaattacaggcagcctccaccacacccgactagtttttgtatttttagtagagacggggttttgccatgttggccaggctgttctcgaactcctgacctcaagtgattcacccatctcagcctcccaaagtgctggtattacaggtgtgagccactgcgcccagccaggtatgttgaatgtacaaaactcttaaggctattgacacagtcataccaaaaaatctcttctcaatttatcttccttcatctttagcatcttctttccatgagctgagctgaggggcaggctctcttccaagaccatgcagtacaagacttcccttaggttcctccttcagacaagggagaattactcccatcttgatcctttcttttgtttcaactttatttcagatcttacctttccaaaggaggtgctcatgtttttacatttcctctggggttccctgtccctgtttttgtcttccttttatccttcatctaactctttgcccacagaaattccaaagatactgcaaggcaggggttgcaacctataaaccaaattcagttcaacggtgtgtgatttaaagaacaaatcaaattagtttccaacacaaacacttgcaaatagaaagctgtcaaaatgttgggtttttggtttttctcctgaagtctagaggacctggcaacagtgggcctgcattgcacagggcatagacctgcaggagctgagtgcataggcacctcagagtgttacaggctctgtcctgctgccctgggccctcccagccagcctccagccaacctccctcacctgccctccctacctggatcttggaggtgtatgattttgtgatacctgctttagagcaagaacacttgagcacagagacccagaatgatatgacgacaatgcctttggagtgtgaagacctggctacaagtcctggccttcactagctgcctgatcgtgcaccagtcccaaatcttataattttttgtgtgcttctttatctggtagagggtgaggacacttgacctctgtccttacaggaccacggggaggaattttagagagaaggggcatgaaagtactttgtaaagggcagtgcagacgttagctctgaggacgggcctcctgtgtgtatctcagagggctatcccaggatcattgatgttgccaacacaagagtttgtgccaaatcttccctctgcctttgactctctgaatgtgagaatttttgctcatgagtgttggaggccatgacagtcagtatcagtccagcaagtcattctttttccaagcttgttacctgcctgaaaggaggcagtaaagcagaggtgcacagcgcaccaacagtgttatcggcaggctgcctgacttggaaaaggaggaaggtcgttcctacacattttcgttccttgttggttttcactacaaaggacctcacacacccccatagtgcccgtgggctggcgtgtccccaggataaataaaacctgcatttttcttattaatcatcaatatgaaaacacatgacctctctttctattgttctgtgcctggttcacgccctgtataattttatatggttcctacagccctgacatgccctgagcaacaatcgacattgattcactgacttataaaagtgtattatctgttctctgtgtctacgtagagttctctgagagttgcccaggcagtgactcaggactccagagagaggtgcacagagcggtcacacaccagggagggagcgatttgcaactcagaatacttcttagcagaaagcacatttgggcttgatctgctccttgatttctgtgggagtgacttcgtgacagtttcaagctgaatcctacatttgcttcttaagtcaactgaaattccattcgagttagatccattctgtgtccactttaaaagccaagctgtttagtgggggattgttatgacacagcaagcttgacaaaaaatacacctggtcttagaagcaatctttgcatagctctgaatgcacagaagaaaatcgtgcttgggtaaaggcaaggatttcactaggcataactcaccatgaggcatagatccttgagcaaaagtccagcagtatgtatgtatgcatgctgagcatgatgctaccagcttagcagcaaatgttggtgaaggaaaataaaacaatgcatgtgtccaacattaaaagtttctaagtttaaaagtacaacaaaattctgctaaatttctaacggacgctaatgtttacaacttctctttgagtcagaaggttttagttattactaaaacatgcttcctcaattccaagcctcttcattttaatgtatttgtaactaggcaattacacagtctggagagatccttcgtgctcactaaatatccatgctctttcttccatttcccagccttctttgcagttttcctggactcatgaaataagaacaaaggcattgtgcatcgccttcaggttgaggcagctaaaagctagtaagcctccttcatttccctcttcccctgacagtgggggacctgtgctctagagggcatccccgcataaggagagtggcggcccggcccacattcaactgtgacctgagaaaggaatgaaccgtgatgatgtgaaagaatgctgtggcctttgtgtgttaccacagcatagcttgtcctatcctgtctaatacacacatttaaggtaaagaggattttcccctgcaaagctaatattacatctatgacaaatgttatcattattgtcatagaatccaaaaaatacaaattctatttatttaacttcagtggtaaatgagaaactttcgagaagcagtaattgtatctagagaagctattctcagttgaaggtaggggcagcttccagacaatccctagagagcactcccaaacccctataccttccccaccctaatcctcttaccctccagatttggagacaactttttcttctacatacttttgataaccacaaattagagagagagagagcaagattccaggagcatccaccagttgagccgtgaacaatgcagggtttaggggtggtgacccctgcaagtcaaaaccccacatacaatttttgactccccaaaaacttgactctaacagctactgttgaccagaagccttactgagagcgtaaaccatcgactaacacgttatgtatgctgtatgtattacatactgtattcttacaataaaataagctagagaaaagaaaatgttattaagaaaattgtgtggaggaggaggaaaagaaggagttggccttgctgtctcaggggtaccagatatggaagagaatgcgcatataagtggacctgcacagtttaaacctgtgttgttgtgttgttcaagggtcagctgtaagagagttcacataaagatgttatccttcccattgcttccatttttttctttattttgtttaaataatatctattggaggaggccaacgaggtgagattccagaggcagccagaggcagtgggagtggttggggcccaggagagaagctcagagaaggcctggtgggttgaggctgaggaggggatgaggagaggccagcatagggacgacagaggaggtgaccaacctggagactgtgcatgcatgggattgagaaggtgagtgactgtgctgaggacagagggagtcaggttcctcaccattgaagaagagagttgtaagtgcagaaagtggggaggctagaacaaaccctgtggtgttgggttggaatcggtggtatctgggtgaactcaaggtttttagtatacacagttagagatggatatagacatacttgcctgtgtgtgtgttggggggatatgcatataagcgtatacctcctagctccctctgctgaagagctcaatgaacgtacagcaatagcaatgagcttatccagcatccacatactggtttctaaataacattctccactaaaagaatgcagaatttcttggaaaaatggctgattccaggctgaggcagggtaattccaagattagcttggaaaatcttttaccagaaagtaaggacatgtccaagaatgatgggggcgtagaaaggatgcaggagccacgcagaggtgaaaccactggccagatcttggataagctgagcatcaaaataagtgataataacagattataacccactgaataaaataagaattcatgagtttactgtgatgcaaaaaaaaaaaaaaatacatgggagaaaaagtaaaagttatcctgatagtaggatgccaacaattaagtgtagaaggagatgtgaaattaaacatttcccatttggaaacaaaatagtaataattgattctggcaggaatcaccaatgggtgctaaaaccagtggaggaaagtttgataaggaaggaggtatttgcctatctcagagtttttcactacagaatagtcagaaactataagcacaaacaagaactttccagtggagaagccaggaagaccgtcccgccaggggagctgattcagcctgggcagccgtaagacactgcaacatcacccatcttgccgggtgagccactgagaagacaccatttctgcgggattcctgtccagaatgcacaccctcaacgtaatcacaggacaggtccagataaacccaaattgtgggacactttagtggctgttgttctcaaaaatgttgaggccatgaaagatatggaaggactgagcagctcttcctcagaggaggggaggagagacatggcagccaagtgcgacgtgcagtcttcatcccatcctggaccactgtgtgtatagatggacagacagacagatacataaattgatggatacatagatagatagttacatagatagataaacagacaaacatgcatagatagatagatgatagatacataggtaggaagatatatctatttatatagatatatagattatagataggtagatgatagacatacagagagacagatagatacatatgtagatggatagatagtaatagtatatattttatatatattttgagtgtatatattttgcagtaaaaacattgggataaatagtgaaatttaaatggggtcagtggattagaggataatgatgtattaatgttaatttctttttaacttattttttattgtagttaaaatgcataacataaaaattaccatcttaattatttctaagtgtacagtttggtggtggttgctatgttcacattgttgttaatgctaatttcttgatttggatggttgtactgtgcttataggaaggcttctttgcctttagaaaatatgtgtttagagtaaaaagtgtgtgcgtgtgcatttatatgtgtgtgtgtgtgtgtatgatatatagatgtaaaaaagggaaaatcatcaagtaggtatgctaaataacaattggagaaggcagaaaaatggtatatggaattctttgtactatgcttgcaatttttcagtaagtttgaaattatttcaaaatcaaaagacaactattgaaaccgctgtggtgccttcgattctctgctatccttccccggactcaccgccttctggaaccacagagatcctctttgtcattcactttttgtgagtctgcgttctctgggggaaaatagaaagagaaagcgtctccaatgggtagcaaaatggaaaaagaagagaaactagtgtgtctaatcctcattcccccaaggcatcatgaggaaaataaaattctttctgtcctgagtcccaggctcctccggcctctgaaacctgcctcaccggcagggctcaaccccgtgactctctgccccagtccctctcagatccccacctccacccgagcctgacattcccctctctgagctcttacagcaactaagccactttacacaaaggtgattctccatcacattgaggagatttgtgttgttttctgtataagttcataaaagcaaggttttgagtttttagtttttttaaattgtggaacaatacacgtaacatacatttaccaccttaaccatttttaaatgtgctgttcagtggcatcgttgattgacattgttgtgtaatcatcagcaccatccatctccagaatttttttaccttcccaagttgaaactctgtcccctttcaccagtagctccccgctcccctcccccaagccccagcaacccccattcaactttcagtctctgtgatttttgactgtctaggaacctcaagtaagtggaatcatgcagtatctgtccttttatgagtggcttatctcgctgagcctggggtcctcagggttcatctatgttgcagcatgggtcagggtttccttcccttttttttttattgagacagagtctcgctctgttgcccaggctggagtgcagtggcgcgatctcggctcactgcaaactctgcctcccgggttcaagcgattctcctgcctcagcctcctgagtaggtgggactataggcgcccgccaccgcgcccagctaatttttttgtatttttagtggagacagggtttcaccgtgttagccaggatggtctcgatctcctgacctcgtgatccgcccacctcggcctcccaaagtgctgggattacaggcgtgagccaccgcgcccggcctccttcccttttgacactgaattccatgctgtatgcatagaccgtgtttcctgatggattccttcatctaaggatggatgcttgggtttgcttccatcttttggcttctgtgaatgatgctgctatgaatgtggttctacaggaatctgtttgagacgctgctttcaattcttatgggtacacacccagaagtggaaatgctgggtcataggataattttttgtttaattttttgtgggtctgccatactgtgttccacagtggctacaccattttacattcccaccaacagtgcacgagggtcccaaaggttttagtgtttacctcctttgtgtcccctggtcaacaggttcaccctggccaacactttggcctgaagttatttaaaccaagaggctttgtatacagtcattgccacaccacactctgtgtctgctgaccagcacgctgtgggaaaacacagttaggcctagcgtgctggggcactcacccccacagtgccttcttccctggatatgggatcccagagtgtaagagttggaagaaacacagtatcagtaatgactgggactcttcttcaaatcagttctagttatgtcattcagacctgcagaatgacataactacaaggggttggggacaattggacaactgtaaaatattgcaaaacatagttttaagctgcccatatacccaagtgataatgtatgggctttttgaagatatccacatgtcccagacaaacaggaaaggtaagaacaggcattaaagaaacctccatcttgttgtttttcaaaaaagacacagaaatctgccaggagaggtttaatactcttgttatcaggactagcactttctgattgcaagtggcagatgagctttatcataaacctagcatttagagtgcttccaaaagcaatcttaatctcttcttatcttctccaggaagacgaggctgccggcacagccagcagggactcgtttttatggttctcaggtgtctagatgctggaacctgctgtctggtttctatacattttacttgcctcctggggatgatgggagcatatgccaggctgagatgggtggcaacctacattttaattctttaaattgctaactccacccttgagcctacaacaagtaggtctgcactgcagaaagaaatcacgtcgccatggggtcgctgcgagtagttccttactgggtgggatgtggaaggggagcgctgagggacagcattgggtggaagcaagatagcaacagctgcagggagcagcagcgggactggggcgaaggctgtgctctggtgagctccgtgtaacacaggagggctgacgctggcccagataggctggcgcttgccagaaaagggcattagcaggaagacccaggagcagattttcaacacgggttgcacagtgtaattaactggagatagtttaaatatccagattttcagaccacacccaaaccaattaaaaagaaaagggcttctggggtcagaacccaggcatccatattttcaaaacctccataggtgagtacaatgcccatcgaaaaccatggagaaccattgcagtaagacacacttgcatatcacgtgtgtgacacatgtgtgacaccttccaaaaagcaaaagcatttggggaaaattaatgaagagtgataaatagcttatctttaaaaatgtacatcttggccaggcctgtaatcccagtactttgagaggccaaagtgaagggtcatttgaggccaggagttcaagaccagcctggacaacatagggagacatcaactctcccaaaaaaagtacatcctgcaaagaacagactgggtgaatataaacaaaatgttagcaatagtcatctttgtataacagtgtgggactatagtttattttcttttgtgttatctttgcataaccgtgtgggactatagtttattttcttttgttttcttctatttctcagcaaaaactctctaatcttttataacaaaagtcatacttcaaaaaatctcatgataaacagtttgcaatttgctcataaaaggagagaccatattatttaaaggatgggggttgttgtggaatctggtgtgccccctggaagatagcacagagctaacacagggtctctggcagctcccggaggggccggagccaggggccagcacaccgactccttgtgtttgccctgtgtggggccgcatgtcctggctctgtcaaggctgccggtggctcagtgtcccagataggcggtgctcactgtctcccagacaccagatgaggacacccagggctgtggagcctttttttttttttttctgagatggagtctcgctctgtcacccaggctggagtgcagtggcaggatcacggctcacagcaagctccgcctcccgggttcacgccattctcctgcctcagcctcctgaatagctgggactacaggcatctgccaccacgcccggctaattttttgtatttttagtagagacggggtttcactgtgttagccaggatggtctcaatctcctgacctcgtcatctgcctgcctcggcctcccaaagtgctgggattacaggcttgagccacctcgtccggccggctgtggagtcttctgcttccagatgtgccactgactttctaactggcccgagtgaggtcacttaccccgaagcctgattgacagcccctcccctggagtgcgttgtgaacactgaaagtagtgtcagtgaagggcttggtttctctccagcaagaaaacttgctgtgcacagtgcaaagtccaaagacttgaagatacttcagaggtgacactccccccgccaaagacttccatgaagtgggacctgctagatgttatggttctttccatgaagtcccaggaagtcctcctgctttgattttcaaagctgctatcatgctgttttagaaatattgctttcacgggtcttctccagttgacagtagatgccctgtggttcatttgttctcatgctggccttagctcttttaggatagcctccagtctctgtgttgaataaggcaaggtcaaagcagcagcctccttgcatttattccgtatgcaaatgcacctttagcctgtgctattctccagggcagtggcatgaagtcaggaatcacaggggataggtaggtcttattcccccgctgggatgggtactcgtggcctggagcatggacagatttccgaggatagagaggaaaggcaggggctggagattttaagtggacttttctcacccacatgtggaaaggaagtttggagtagagaagagttgttccctccgacacgtttcaggccatgcctttacgtccatctagcctgcttgtcatctgcaccccagcacccatcccctgcagcccccacagtaacaccaggtctggcctcagaagtgcctcccccagcctcaggtccagtctcaggtgaccgtgcagggtgctgcctcctgggctcactgcccagtgaggagaggaggcaacggggagcttccacatctcctctaaagactcacttctttcctcattccatccttttcgatctttgctttgccagttcccaccatgggcatctggaatgaaggacgggaagaaagagagagggagaaaggggaagaggaggcgtctgccactgccttgtttgctcacttcaaagggctccctaatgagtctgtctattgtctaagctccttgtctatacctgagttttgcaatctatacacctagggagatcacagggaaccgaaaggagcctctcaccgcaggacgggacagcccaccctccccctccacatggaatcaaaggggcaattgtcaaaggcaaatgaatttgatctggaggattgcacagatactggaacaggttcagtgaaagagaaaagaatgtgcatagccggtgggggtggaggaggcaggaagatggggaaggggagctgttggaagccaagatcaaattaattcccacttagatcaccttttgatgtatttcctcatccctgctgccacagtggtgagctcctggagatttctagaaattcctttcccatatctattccccactctgttccctgtgtgctgggccactggttgtcaaccggtgtctggggagggaggaggtgatgaacatttgccaaagtcggagatgctttccattgtcaccacaaggggaagggggtccctggccctcagcggtgggtggagaccaggggtgtttctaagtagcctacaatacacagaacagcttcccacaacaaaatattatctgacttaacacgtcaaaagtgtcatgattggccgggcgcggtggctcacatcttaattcctcccacaatatgaactgatgaagtggcaacagtgccagatatggcttgcagaatccaggatgtgtactgtgccatgggtgtgctgaagggggatagtcactacttccccagcagcatccagaacactatgaaaccatggtgcacacactgtactatgtggctgagaagatgctagaaatgggacagaaacactcttagtgagtagaatttcctgtttccaaatttcttttgcttgagcagtgtccacagaagacaaagaactactgatatgaatatgtgcatgtctgtgtctgtgggtatggctgcagttatggctgtgtctacggctacatctgctgtgtctatgattacgtctatatttatgtctgcctctatggctatggctacctttatgtctatgtctatggttttgtctacgtcgatatcagtgtagatgtcgatgttaatggctatgtctatggttttgtctatgtctatgtcactgttgatgtctgtgttgatggctatgtctgtgtcaatgttgatggcaatgttgatggttatgtctatgttgacggctatgctatgtctatgtctatgttgctgttgatgtctgtgtctctggttatggctgtgtctatggctatgtctatgtcacgattgatgtctgcgtctgtattgatggctatatatatggatgtggctaggctatgtctatggctatgtctacgtcactgttgatgtctgtgtctgtgttgatggctatgtctatggctgtggctatggccatgtctaggtctatgtctacgtctatgttgctgttgatacctacattaatgactatgtctatgtctacgttgctgttgatgtctgcgtctgtgttgatggccgtgtctatggctgtggctatggctatgtctaggtctatgtctacttctgtgttgctgttgatacctacattgatgactatgtttatgtctacatgtacatctgtagttatggctatggttgtgtttatgtctgtgtctgtgtccgtggttgtgtttatgttcatggctatggttatgcctatgtgagttttcggacctaaattggggtccgttgtggaggactaagacttccagtatgtctttgctcaaaaaaatacccagagaatatgatttaagctccaaatgataattagttattggatctctgtcttgttcaagtgcttagttaccattgccacatatgccttcaacaatccacagttattgatgttttcctatgtgtcaattactggataagcactgagtacacatgggtgaaaaggacagacactgcccctgtcctcatagagtaagtagtcacttggttgctcactctttttctccctcctctttcaaagctttcatgaaattccatcctagttttttttttttttttttttttttttcagacagagtctcactctgtcacccaggctggagtgcaatggcacgatctcggctcactgcaagctccgcctcctgggttcacgccattcacctgcctcagcctcccaagtagctgggactacaggcgcccaccaccatgcccggctaattttttgtatttttagtagagatggggtttcaccatgttagccaggatggtctcgatctcctgacctcatgatccacccacctcggcctcccaaagtgctgggattacaggtatcagccaccgcacccggcctccatcctagtttatgacagaggctatgaagtaccaacagcaaaagtatctcagaaagataccataaaaagcctacagaaaacatacctataaaaagccttctgtgaaagttgtcttttaagagcaaaacatagaagcacaaatcattccacacagcccactgtttaggagtcacagcttactgggcaatgccaagtgcatcagaaggatggggggctatggatccttttgggaatgaactcattttccagtgagatgaactagtgtcaggaagggagaagtggttctgaatacaccctcaggtggacaggtcacagaaacctaccaccagccaagccttggggactcatctctgagcctcatgaaagaggagctagaggtactatcttcatgaagaggtggtgagatccagaacccagtgaccaaggatgtgtggggagtacagggtgtctcgggcaaagaaggaccaaagagcacacagggtgcttttgcatcttcaaggctggcagctgcaggaacgctgggagaagacactactggctcacatattgatgtcgtccttgaggatagatcttggtaaggggtcaccctcaaaagctcttcctgcagggaccttgttgtgggctgaattctgttctccttaaaattcatacattgagtcctgacccccaggacctcagaatgtgctgtcttggagatagggtcttaatgaggtaattaaggtaaaatgaggtcataggggtgggccctaatgtgatggctgatggcctcatagaaagagattaggactaagacaacacacagactgaggggtgaccatgtgaagacacagggagaagacagccattgacaagccaaggagagaggcctcaggagacaactatcctgcccacatcttgctctggaacttccagccttcagaactgtgcagaaatgaatgactgttgttttagccccctcatttgtggatttcgttatggcagatccaacagacgaatgcagacctcagtaagaagaaaatgggttagaagagcactaggggcccttcatggctattgatgaggccctcttggacaggctaaaatcactgggtattttcaagggcaagcattatgaatccagcagcaaagccaatggaagttgttacagttaatgtcagccaataagaactgctatggtttgaatgtctgtccccttcaaaactcgtgttaaaatttaatccccaacatggcaatattgagagttgagatctttcaggaaggctcttccctgatgaatgaattaatccattcatggatgactggattaatagattaatgggttatcctcggagtgggactggcagctttataagaagaggaagatctggctagcatgctcagccccctcaccatgtgatgctctgcattgccccaggactctgcagagaggccccaccagcaagaaggctctggagccccatatacagcctctcgaccttggacttattagccttcataactataagaaataaatgcctttttaaaataaagcacccagttgtgggtattctgttataaacaacagaaaacagagacaagaacctggagaataaaagacccaccatgaatattgaaacaaacaaagtatctcctcttcatgccagtccttctaaaggccaagccttgtagatcttggattccctcttctctctcattactcatatttattcccgtatggagctcgactgtgttttcctttagaatggccagcgggtctgctccttccactccgtgcacatgtccacttgtgcgtctgagtcttcaccacctacaccgagatggcttccacagtctcctctctggatccctgctttcagtcatcctctctcagtatccatcctacatggttttacagagagctaaaaccactctttcatcgtgtcattccatgaatatgtatttggtcttcaacccacttcttggcatacaactctaaatatcctggaatgtccaaagtagtgtcttttcatgtgaatgagttgactgatggctgacagctcctaggcagctcctggacaggatggggctggacactgaaaagaccaaaccaggattagagggttgggactttcagtccatcctgcagcctctgaggaggagagagtggctgaagattgagttgattgccaatggccaatggtctaattaatcctacctacataataaagcctccatgaaaacccaaaaggactgggtttggggagcttccaggtagctgaacggggggaggttcctcaagggaggcatgcctagagatggcaaggaagctctgcgtcccttcccccctaccttgctctatgcacctcttaatctttatactttgtaatatgcttcatgataaaccagtaaatgcacatgttttcctgagttctgtgagccactgaggtaaaccaatcaaacccaaagagggagttgtaggaaccccaacttgaagccgttcagtcaaaatttccccagacctagacttgtcactggtgtctgaagggtgaacagtcttggagactgagccctccactatgggatctgaccctgtctccaggtggagagtgttataattgaattggaggacaatcaggttgtcctcacacatctggtgtcagagcgtgcagtggtagagacacagtttgagttttctccactcatacactcttacccagaagtcttttcccagttcctccatactttgtcccctctctgtgcccactgtctcatttgtcactgtcacctaagacttgctggaccagttctttatctggccttggaacaagtcaggccgtgttcatgcatcgtgaccattcatgctgcttctcttgctgaaacgtgccatgtgggtattagggaaaccctttctgtggattagagaaatctcacctatttctcaaactccagcctaaagacccatatcctccagaaatccttcgctgacaactttatcacaccctgaactttttttcccttttcaaattttacatcacacttttgggccactgggcatataatttagtatttcatcaatttctgtagctgtatgttagagttttctttaaggagctcgtctcatttaactggtcccttcccctgctgtcctcccatcagcattattcttgtctgcacacgtcagttgggatgctcatcagatcacagtgctcctttgctcaagagcccccacgtcttgtcatctcactggaataaaacccagcatcctcagctgatctgcgagggcctttaccagccatgcaatcttggctgcaggtaacagtcatttgaagaactttggaaaacaatcaagtcttggccccaacctatacaacaattgaattaaaatttctcagaaataagtgcaggaattggtattaattttaaatgtccaagatgaaactttaccagaagataagctccatgaatgtaaaaaaattgcttgctgtgttcactgctgaatccctaggtcctaagacagagcagatataaatagattgaatacatctttcaaatgaaattgtacatatgcttgaagatggaaatcagaggtaaaacttattttttcatattcatattactgagcattcggggcttgaaatgctggaatttgtattcaaattttccacattttatttttagcaagtttgaatcataccttactccttgactctgaggcctaaatgttttcaatcttctcaactgctaagtatccattgcaaaaatggggtgctttcatgcacaacaggtgaagtgaacattcattttcgttaacagtccatcagttttattttaaaaaaactcaatgtctacttagcttttatctctaaaagataaaagattaatccttatctatcattctgtggctgtcctaagttcctattgtgatctagctcatgcaaagtgtcaaagagcatggaaaacatacttcccacaacaaggtgttgatgacccacactgtggcaagcactgcccaagtaattttgcatggatgatttttaaattaagaaacaaaacatgtaaggcagaaataggtgtttttaattttaaagtcagagaaattaatgttcagaaaggccagtttcttgtccaagaaactgcgaatgagtggcaggtttgttacactgatccgagctggtctgatgatgaaaacctggttctttctgctacactgtgttgttttcccagtcatctacctcgggtaggaaacaactcctcccaccgcagacataatggtgcttactactgtcaacaggcttgagaccactgggtgagaaaattcgggagaagaaacctgaaaaattcccatcagatttcaaaacacatttgacagaacatagcaaagaggctgaaagtggacaggcgctgagcctgttcttccggaaggccgatggacatgagctcacttctgtcctcagcaggaacctctgccccgccatagactcccagtccccatcagcctgagcagccgagacaacaggaaacagataacaaaacccttgtccctctgcccacaaggtcgctggttgtgttgtaggtaggtctcaaggaaaggtcaagcaaagcttcagcagccccctggagttgaacatctgagcttagaagccttggagaaggagtctctttgaaaatgagggaagtttaattctttttgaatgctggcagaagtccaggatgtgagaatgttttctttcttttgtgcaagtcaagcaagcaaagggaaaagcgtgtgtgtttgaaggacggtgggaggggagttactattttggggcatgacagcagcaacgtggaaatgcgaagtctgcctccagccccaaactcctgagcagaaagcgggcagaggccacggacgtggcttagagtgggctctactgggaaggagctgtgaagtgacagtggcagagggagggcgtgctgctgctttccttggtcttatttctttcctgtggaggtcggggtgggtggggaaaaggctgaagaagctggaagaagaattaagacgtctcttaaagtattcgtgtaatgaagaagtgacctgtggtcagtttcctggagggttgtatgtggcccctcgagtgtgattagccatggaaagcaggaataaaaacctcgtggtaatgacttgctcaggaaggcaactactgagattctagaaaaatagttaaaatggttgcttcataagctgaatacaaactctgacaagaggaaatgctgaaagtcgaaaagaaattggaatggcttgagggatgtctagaagatactcacaatccacccagaactgatcttgaggctccacgtctaccaagaacttggtagccaaatatctttgggttttttatgctttttatttttagttgacacatgataattatacatatgtatgggatacatagtgatatttgtgtactcaatgtataatgatcaaatcagggtaacaaatccaccagctcaaacctttattatttctttgtgttgtgaacattcaaaatcttcttttctacttctttgaaaatatacaataaattattattaaccatattcattctgtggtgctgcagaagtccagaactcatgcctcttatctagctgtaattttttttttttttttttgagacagagtcttgctctgtcacccaggctggagtgcaatggtacgatcttggctcactgcaacctctgcctcccgggttcaagtgattctcctgcctcagcctcccaagtagctgggattacaggtatgcgccaccacgtctggctaatttttgtagtagagatggagtttctccgtgttggccaggctgctcttgagctcctgacctcaggagatccgcccgccttggcctctcaaagtgttgggattataggcatgaaccactagctgtaatttcgtatcccataaccaacctctccccatcctttcttctccccatcagcacctctcccaggctctattctactctttagttacgttagttcatttttttctttctttctttttttttttttttttttttttgttgttgttgttgagacagagtcttgctctgtagccaggctggagtacagtggcacgatcttggctcaatgcaacctccgcctcctggttcaagtgattctcctgtctcagcctcccgagtacccgggactacagggctgcagcaccacgcccagataatttttgtatttttagtagagacggggtttcaccatgttggccaggatggtctcaatctcttgacttcgtgatctgcccaccttggcctcccaaagtgctgggattataggcgtgagccactgcaccaggctgagttcatttttttttttttaatctcctgcatacgagtgaaattatggtctgcctcagacattgcattacccccggaccagtaggaaaaacctggaaaacagagcatgtcagtgttctaccgtctagtttatattcctttgatcctttaacattccttcaattctgtgcagatgtggtgctagctacaaaggagggatattagaaaatcataaacattgtttgagttgcacgtgggtctgccatgcaggcagaaggatgcagcgggagtggggcgcaccaggtggctcagtctgcaaacccaggtgtgaaagaaaccaacttcattttgaatgattaagcccagtttctgttaagagccgagattccccaaatccagtggggcagtaatattctcccatttcctaaattctgcgactcattatttctacagaaaaatgtggtctagcctgggcaacatacaaagatcctgtctctacaaaacttttttaaaaattagctgggtgtgtagccccaggcactctggagcctgaggagggctgatcccttgagcctaggtcttcacggctgcagtgagctgtgatcacagcactttaatccagcctgggcgacagagcgagaccctgtcacttaaaaaaaaaaagtgatcagagttccaaggttcaatgccagcaacacctctctttagtaggaataggggttctcttccttgctcagtgcccctgcagacagcactgggagcacactgtctccatggaacaggcttcagaggattggacgttcaggctcagcaaagggaggaacagggacatcggtaagtcacatgcacaaaatgagacagaaaatgaaccctgcctgatctgtctccattgtaagactacacgtggaatgacacattctttgctctctgcggatatgtcatcagtttttccagcaggtttaaaaaatgctagttattgagtgttttcttgtaattattcagaagaaaaacatatcatcttcattttgaggaacataagcaaatttttcagtgacctcttttaccccagtaaacccataaaaatctcacagaagaatgagctataaacagttgccaggtccatggcaccattttatggcagcagcaatcagataaaatgtttctcaccccttccttacatctcctccctcttcaccacccttgaccatgtccaggtcagaaacctggcaagcaaaacagagaaatagagaagaataaaacccattttcctccagcccctatgctgctgccactataggtcggcagaggcaaggggttgaagatgtcatgcgatgtcaacctggagttgtgtatcatgtggactgagcattatggtttcctaatttattttgcttttgaatcctaaagtgttggtagtattttctattacaaaacagtgaccagacagtcttggagatggcctgatttttcatccaggagcaaaggagggatacctctaaacctctttgagaaggtttcaaagggtagtagaagaaaagtaaacattgctttcatgatttcacccctcagtcttgcttttcgatgtacccattacatagttacggacacgcttctcctttgtcttccaacttcacttgcaatcatttcaccaagtaaaacagaatagattaggagtgcagacctgtaacaaaaatagcccatttagacttcacggtgtgcaaagtaaatgtctcctggaagctagaaagtggatccaccctttcttcttcctgcactgtcttcccttgccctcctgatttgaggcttcccagtgatgcctttcaccccttcttgcctacacagggagcattttgcctgatatttaaccaggatttttgctcttaatccatgttaaagccaacccattgcttcccccaacttcgtctgccttgcctccatgtggcgggaaggaaattacagtctctgccattctgtgtgtcaaaggaggtttgtttatcctactagtaaagtcaatagaccagtgacttcctgccaaggactgcattctgggacaagaaagccaagctgataaaagcaattgttctgaaaaatatgctcatggtgcacctgatagctcctctcccctgtgaacccacctattgaagaggaagctgagtgttccatggaccagggtggttccagttgcaggtcactgccctgctcacaggagactttgggctctcaccagttgtgggaacctcggggtggaaatccacaggatgtgctccctagagaagtgatactggagaccaccctgccctgctctggctcagcacccagggctgcacctgctcaggaggtttattcaactgagctcccaatcaaggcagtgctggggttcaaacaagttgtctccgatgggcactcgctattttggcaagacctgttcagagcaacagcctgactccattttctcgtgatcctctgtgagcctagccaactgaagtctcctttgaacctgtgagtcttaaactacgttcctgcaataccttggtttgatgtgttgcagccctgaccacacttagaatctgttgctcaatgtcaatcttcccagatggatttcagacgagggaagggaactttgcctggtccagccgctgcattctctatgtctgccactcagtagtactcaaagtgattcaagaagattttatttacatttgattcagatgatattagaaatggacactaccatcctcagagcatgacatcctcagagttgctacttgctgtttagccagaagttctgtgtaagagaggagtttagggtttaggtttccggattcctgtccctgggtttgatgtcttaatttccaccacattccacatttccctcaatactccttccaaagtaaggcacatgcctcttggcttaccactggtaaacacggcatgtctcccgataattacacaaagaaaggaagagaagtgacttgagcagactatttccaaacagcgtacatcacttccctcactgcacacgctgtacagagtgctccagggaggacgagggagagtgccgagtgcagcagtagaatcgcaggacagccaggacaggaacatgccacatggacatgtgtttttggtgaaagaccaaatgctgaagaacccagaggaaaaatctaatcaccacatggcatttcccttagtgcagttggcctcaacatgctgacctgcccacaatgagcaagaccgacgcaaaatcaaaggcgtctctgaggcaggaggcttcccacacagcagcaacctggcacccgactgacctgggtcctccagcatctcagcaagggtgaggaactcagggtcgcttatcagggtaccctgtcctgtggctgggccagatcaccctcttcctgaatcatcccgacatctaagtactatcaaaaagagatgcttttcttacttagcagctggactagtttggctcagagaaagtcacccttttgggaagatgacaacacagggatgagcatctgaaagcaccattgcctgaactgtgaggcctgggatctctcaggcatggaagggagagaggtgagcaagcatccagcgccagccatgcgccggccatgccccagcccctcgagcaccactcctgttattcaactctcatgatattctcgtggggtgtttaaaaagtgattctccccattttacaataaaataagcagatccaggtgtctcggagtaagcagtctacccaggaagcagagtgcaattttaaaccctgacccctgacatcaaagtccagccattcactgccaggactcaacaatgacctgctgcactattgagccagcacgtacctggctgaagaaagcttttctctagtaccacagggaaaagctacaccaactcggaaattatcatggcttatttatatgttgatgcatatttcatgttttttaaaaaaacaactaaatatccttttagaaaaatggataaatatccggttaggttttcttgggtaggttgtgagtccctgtattgttcagtgcacgtatgcagttgataacttcccagtatcagccttccttcctacatttgtttgcccaattctttgattatttaggctttcagagccacatttaggcttgctgacccaagaaagcattatagtcttaacccagactcaagctcttcctatatttttttttcattttacactccactttcactaattttcagtgaagattttcatccctgttatgagtcataaacctatcaaaacctctgggattcagcaaaggtggtgcttggaggaaagttcatagccttaaatgcctacatcaaaaagtctggaagagcacaaatggacaatctaaggtcacacctcaaggaactagagaaacaagaacaaaccaaacccagcagaagaaaggaaataaccaagatcagagcagaactacatgaaattgaaataaacaaacaaacaaaaaaaaaaacaacaaaaaagataaatgaaacaaaaagctggctcttcagaaagataaatgaaactgatagaccattagcaagatgaaccaagaagacagaaaatccaaataacctcactaagaaatgcaacaggagatattacaactgacgccactgaaatacaaaagatcattcaaggctaccaagaatgccttcacacacataaactagaaaacctagaagagacggatgaattcctggaactttgatgcaactcttaaaagagtgacaggatcagaagttgcagctcttaagaaagctcccatcctaacttctgaaaaggtgggagaaataatcaaagccatatttactgaggattacacaccacagggatgagagtcatggtaaaagggaataacaatgcaagcctaaccttgactccaagggccctggcaggagctgcaggcatcatgtagtgagatggctcattgtctgcccaatggcaagggaatttacaaagaagacacgtgcaccccgggttcacagcagcattactcacaatagccaaaaggtggaagcaacccaggtgtccatccacagataactggataaacaaaatggggtatacagatgcaatggaatatgattccatcttaaaaaggaaggacattctgtccattgctgcaacgtggatgatcctggaggacgctatgctcagtgaaataagccagtcacaaaaggacaaatattgcatgattccacgtttacaaggcacctagaatggtcaaattcataaaggcaggaaatagaatggcggctgccagggattgggagaggggaactggtgtttaatggacacagtttcagtttgagaagatgaaaagagttctggagatggatatggtgacggccgcacagcaatatgaatgtacttgacgccgctacactgtacgcttagaaatggttaagatggtaaagtgtacgttgtgtgtattttaccacatttttttaaaaggcaagaagtgcttctggggttctagcagtttctcccagccacagtgcctagagtgcattatggaagaactgtttttgggtattaaaaagacaaacctgtgtttggtacagaactctatagtgatggctttataccctggactgttttaattagagaattttattcctaagacctaccaatgaattttatgatataccttattctgacaaatatgtaagtgaagaatcaaaaggctaaggatttttttaaaacattggttttcagtttatctttgtttaaccaaattctttacccagtggactttgccagtgtgttttgggcactagccatccgtaattggtgagagaagtactgcttccggcagcccttgcattttcctctaagcgcccccccccccgacacacacccctccccgttgtctttggttgaggaacaatggggcaccaggatggggcggctcccagaggtgggcatgacctctctgccccgctgtctgttttcctccctagctgagccctgtctgtcccagcactcctctgttcccagctgcccctgccctgtctagcctgctatggaaaggaggtcatcccctagctgctgaatactcacccacctaccacgccgaggacagctatgccgtctgtcctggtgctcgtgtgttagaggagagaccacagatctgttgtacagcaacatgaatgtgcttaacacacggaacttgaaaacggttgtggaggcaaatgttatgttatgtctttttaccataattcaaaaaaattattttaaaaaagtggggactataggaagaaagcaacccaatcacttcatggggaagagaggtggaggtccaggcatgagacttcaggccagtgaatggggaagagaggtggaggtccaggcatgagactttaggccagtgaagtgtgtggtgtttgcagtggagcagagaggaaggcattttacaggggcccctcctgtccctgggccttgtgagcaaaccaaggcaggacctgggctgggaggagatgctgtacctgacaattcctatgtggctgagcaaagggaaagggagagaaagaaggttcctgctcagcttggcaagatacttacaagactagcaacttcacagtcaacaagccaaagctgcgggcatgagtaagtatgcactgaaccaacctctctggtgcctggatgcctgagccaggccctcttcagggttgtacagggctgccctgaggctttcaatctgttccttcctggaactcagaagtttagtgaaaaccacagaagcagagaggttggaaagagaaagttctgcacccttccctgattacttcccagtgggggctgggagcgtcttctccaaggtgggtttgcagcaaatcaaagtcttctctttcctggtgaattccaagccatctctcttttcttctcttatttgtcctgttcttcttatcactgccccctccacacaactgacaaagtgaccctaagccttgacacatgcaagatgaagctatgagcagaacagatgccacgcagagctgcgaggttgcacagaggcctgagggggcctgagagcacagctgtgtggatgaggagagagtgcagggcagccctcccggtgtgcgcacatctatctgcctggctccaagtcggcaaagtggatggctggctggtggctgtgcctcagacatcactgataatggctttcggctcgcccagcgatggagcaatcctcaggaatccggagccctcctccctggcagaggtctaagtaaacggcagcacaccttggtgtgtgggtggcaattaatcaaagcagtctatgagttctccttgcagaatttcttttatttctttgttcctggtccccaccctttggtgtggttcccttgggactttttttcttcctggagttagggttatgtatacatgcataccatcactcatgccaacaagttaacaagagtttacatcccccaccccatggacagggcaggaccaccggtccatccacccaagcactagacccgctcagacatgtattgaccgtgtggcctctggcatgtaacttctgtttattgactggaaaaatttagacaatgatgtctgttttacctatttcacatatacgggagagcattttagcatcttccacaaacgttaaatacctaggaagggaagggccctgccgctgatggcactggtgaaggtgtgagagcaagctcaagattcatggatttcttctttctttcttttttttttacattgggtgaaattaaaccactcatttttacaaagtggggggaatcctccccaaatatagacacacacacacacacacacacacacagatttgaaagtgttgtttatagttcttaaatactagattaggatttagagacacaaggttttaaagtgccagttgattaagtatcactggaacaagcttatgttttaaaattaagggtgagaagccacaaagcaaatcacaattgtgatttaattcatcacaatttaaaactgggtaattctggggtttagtcacacctatccatggtttggttttaggctttgtcatcgtcctgctgagaggtttgtgtgtgcatctccggagtgaggaggccagcctggatctcctgtcacggcccctgagccatgtctcttctttcagaatagtgccaaatattggacatgagtttcatatccctgtggtccagagtggtttgcacacagagagactgggtgtttctcccagttacaaatggcgtgcctaaggtccagcaccagcagtcaactcccatgaccattgaccactgagaacagcagccctgtaccacacaaagaaactaacagtccatgaatgaaatcccagactgaaagacatgtgatctcttgaaatacggggttctttagacagaagccactgcctgagcccagcaaagtttcggggaggaggacggcaatcctgtccgcccccttcttgctgctcactgtcaagggctctgcatccatttcttttattgcctctgatggctgagatgcttgaagagtggataaaagcttttgctgattaattcatgaatatgcctgccgtacagtgaatgcctaatatagatcaggcagcgtgcagacctgctgcatgaattacgtgtgcattgctcagaaccgcctcatgggacggatgttaagagacaagaacactgagctgtattagcttatttgcccaagggccacagagttagagtggggaagtctgggctccctgctcccaattttttgttattgttgccctctcaatattgcacagaaattgcaaacattatttggctgtatttctaaaaccattggggaggaaggagatagctggaaggggacatgaggcagaacctgccaagtggcatctaactccctcctggtgcacttctaagttatcagtgtcatgattcccaggcagtgtttgttcctgtggattttgaaccatgttcctggaacacctgtgccccaaagatgtgcttccgtggttctgcaaacattctcttccaatttaattttgcaaacaaacaaacaaacaaacaaacattttttaactgtttagaaaaccacagaaaagagcacgttctcttaaaggcattatctgtaggcttttctacacactatcaaccaccactgcaattacctgggctatgagtttaagcctttgctttgttttgtttgagatggagtctcggtctgtcgcccaggctggagtgcagtggtgcgatctcagctcactgcaagctctgcctcccaggttcaagtgattctcctgcctcagcctcccaagtagctgggactacagatgcatgccaccatgcctggctaatgtttgtatttttagtagagacggggtttcaccacattagccaggctggtctcctgaacttgtgatccgcccacctcagcctcccaaagtgctgggattacaggtgtgaaccaccgcacctggcctagtttaagcctttttaaaaagacttttaaaaattgccttctctccacccctatatatacgtttttacttgttatccataactcagcaatggaaaaatgcaatcctgcattgatcttgttttaaggggaagcgtgttgatatccaggcaggtaagggcacactggcagcccacctgcctggtacaaagccagggagggccagggaatctgcacagcacagcattcatctacgcataaccatttctgaataactaactgaacgcatcacgttatagcttgtttaaacatagtttgaaatgctttttgtgtgtaactatgcaaacaattctgtagaacagaattattataaatttggaaattgagtttaagtgataatttttcattattttctattttttagttaaaaagctgaaaacgtttaagaaatttaaaatgaataggagagactagagtcaagatcaataacaaatcatgctagacagcaaaactgatatttccattgtgtcaactctgctaacagcaagacataaaatcaatgagatgaaaaataagaaagtgttacatattttccatgaggattcaccttctaagataatcaaattgcctgagtcctcgatattttatgaatttttagaaaacagccttatggaccccaccaagatgaaacatcatgaaattatcacatcaaaacaaaactatatagagtataaacataacgctctattttgagcataaattgaataattcaaagttgtaagaaatgcatacatgcacaaaattccagcaatggaaaggcatttaaagtgtctgcattaagttactgcattatgtgtgagggaaggcacatcctttaggctgcacctggttgtctgtgatgccactgactttgtgttaagtgtgttagatgagcaggtgcccacagaaacgcaagctatagtactggcatccacccagctaataaagccgtaaggctggtcatccttcttgacatttccctccctcttacccccacattgatgccatgtccattccacctcccaaatcaatgtcaaatcccttccctcctctcctcctctttcttggaagcaccttggaccaagctatcatcacgcaggccgagactgcagcaagaacctcccagctgtttacccagcttcccccgttgctttattttaaattcaccccgtcctgagaactcaggatgctattttaaaactgtgagcgctaacacgtaactcccctgatgaacgttcgtctgtggcctcctgctgcacttagcgcacgatccacgtgcattttcctacagccgggaggcctggcacagtccggccctattcatctcagccttgtgctgcgcgcccatcctcttccactcctggcacacacctcaccttctccctgtgcaggatccacacttgccaccccctcgcctggaggtcccttccctgcacccccacacggagggctttttctccttctcaggctgccgagaacacacccccttctcagaggctccctccgtgcctctaaggccttaccatcctcggtgttcctcctccagcggcttgtgaattccttcttggtgctgtttaccatctggatccactgatgtactcgcttgcttgtttatcgcccgccccaccccagtagcctgtaaactctataaggattggacaagaattgatcttgtttgtcattgtatctccagcaccagaacccccagcaccaggcatgtaagaaatacagttttcatcacaacccaagacacatatttgtgtgtatttttattatctgtaattcgttctgacattttctatgctatcacacttactctatctcatttcctttaaaggctggttgtgatccaatagatttcataactcactgaagagtcccaacctgtcatttaaaaacattatggtaatgcaagttacagaacaaatgttcaatattcctgattcatttggatgcaaaaatgttgtgaaatctttattcaagtggaatagacaaactgtcgattagtcttcaaaatggtgaggactcgggcaattacaatttcactttaattaatttaatttagtgttgtcatgcagtgaatgcaggaatttttattattttgtaaaagcgaaaaagataagaggaggaaattattatatattagttcattcttaatatactatccaatatatcatatacattcatagtaacgcagcatgacagccaaactggtgctgcagaaggagcaacaagctggccgtcaggagccatgactcctccacaagccatggcagaaccgtgtcctgcagaacctgcatgctgcatgggcaaatacccactagagagagccacagtttcccaacacggggacagtcacatcagaattttccaattttataagagaacattttttatcttgcttcatttattttatttactaactttgaaataggatatataatttttaataaatagaaattatgatgagaaactatatgtagtggccgggtgcagtggctcacacctgtaatcccagcactttgggaggccgaggcgggtggatcacctgaactcaggagtttgagaccaggctgactaacgtagcgaaaccccgactctactaaaaatataaaaattagccggtcatggtggtaggtgcctgtaatcccagctactcaggaggctgaagcaggagaataacttggaccagggaggtggaggttgcagtgagccgacattgccccattgcactctagcctgggtgacagagcaagacaccatctcaaaaaaaaaaaaaacccgaaaaaaacaactatatgtagtgaaaaacctccctttgtctcagacacccaaactccactctttgaaatggtttaacagttttgcatatacttctagagatgttttccatatattctcttttagaaaaaaaaaaaaggcacttacacttctaaatcatgtttttttcaaaggcttacgataaatttgaagcatttatccacatcggtgcatatgaagctttcccatttcttatttcagttgcgtagtattccactatgtgggtgtaccctcaggtatttaaccaatctcacattgtacatttagcttatctccaattacttgctaccagaacaatcatctaatgagtaataacctcgtacaaacctcacacaggataggtgtaagtatttctgtagaataaattcccaggaatggagttgctgtgtcaagggtatatgcatttatagttttgatagatattgccaactgcacatagctggggatgtaatcatttattgtccaaccagcaatgtgtcggcagatctgtttccctacactcacatcaacatggagttttgtcaagctttttggtatttcccaatttgataggtgaaaaatggatctcagtgtaagtttaatttgcattttttaaataatgaacgaggttgagcatcttttaatatgcttaagagtaatttgtggttcattttttgttgtctgcttatatattttgcttatttttattgggttatcagtctttttctcgctgatttctagtatatatagctgaacagacatgcacacacacatacacacacatacatacaatacacacatatagcagggaattaatccttagcccatattatgaattgcaaatctgctttatcatttttattgtttatgttttaaattttcttctgggggatgttgccatgtagaaatcatttctttttatgtagttaaatttatcaatttttttcttactttattttattcatattagaaacagcttctacattataaaattatgagaatcaaaaaattctgccatgatttattctattttttaatagtttattgttttccattttaaacatttatctgtaatttctcaataaaccatatattaacattgtttgaatccaagtttatgttatcttccagttggctacaccattttagaaaacaatttgtgtttgttgaatagtgtatcttttccctgcagattcaagtctgtgcctttacacatattgcattttcggagtatatggctctataccttgacgttatctactacatattgatttgtcagcctataagtataccaatgcctcactttttaaattatcttcattttataatatattttcatagctagtaggataatctcaccatactactactttataatgtttttcttttcatactcaatgctaaaagactgaaagctttccccctaagatcaggaacaagacacgaattcctgctttggctatttcaactcagcatagtattggaagttctagccagagcaattaggtaagaaaaagaaataaaaagtacccagattggaaaagaagatgtaaaattacctgtctgcagatgacataatcttatgcgtggtggctcatgcctgtaatcccagcactttgggaagccaaggtgggcagatcacgaggtcaggagatcgagaccatcctggctaacacaatgaaaccccgtctctactaaaaatacaaaaaattagccgggtgtggtagtgggcacctgtagttccagctacttgggaggctgaggcaggagaatggcgtgaacccaggaggcggcggttgcagtgagcagagattgtgccactgcactccagcctgggtgacagtgtgagactccatctcaaaaagaaaaaaaaaaaatccctaaagtattcattaaaacctgtgagagctaataaagaaatctggcaaagttgcaggatacaaaataaacacataaaactctgttggcatttatagacactaaaaacaattcaaaaaggaaattaagaaaacaatcccatttataatcatgtaaaaagaataaaatattaggaataaatttaaccaagaaggtgaaagatttctccattgaaaactacaaaacattgttgaaagaaataaaagattatataaataagtgaacagttatcccatgttcatggattgaaatatttaatattaggatgacagtactactcaaagtgatctacagagtcaatgtaatctttatcaaattcccaacatttttttcagaaataaaaagctcctgataaaatttatgtggaatctcatggaacctcaaattgtcaaaacaatcttgaaaaagtaaacaaagttgaagaactaacactttctgatttcaaaatttactatcaagtgatcaaaataaaaacaatgtgttactatcacaaggacagacctataagaccaatgtactggagtacagtccaaaaataacaaacagccagttgattttcaacagctgctaagaccattcactggggaaaggacagtcttttcaacaaataggatgggaaaactagatgcccacgtgcagaagaatgaagttggactcttcctttacgtcatacacaaaaattaattcaaaatgaatttaatacctaacctaagagtcaaaactataaaactcatggaaggaaacataggggaagatcgtcgtgacactggatttggcaatgatttctttgatatgacagcaaaaccacaggcagcaacaaaaaatagataattttggacatcagcaaaatttaaaacctgtgcatcaaaagagtgaaaatacaacacatggaatgggagaaaatatttgcaagtcatatatctgataaggaattaatatccaggatgtataaagagctcttacaactcaatacttgcaaagaaacccccacaaacccaattcaaaaatggtcaagagacttgaatagacatttctctaaagaaaatatacaaatggctggtaagcacatgaaaaaatgctcaacatcagtaatagttactgcaaagccacaatgagataccacctcacacccattagaatggctatcataaaaacaaaacagaaaacaagagtgggcaaggatgtggagaaattggaaaacttctacatcattgatgcggtagaaaatagtttatgacagtcaaaaaaactaaaaactaaaactttccatcccccattttccagacatttaattgtaattactttgaaaagttataatatttatattctcctatgtaacaataattttctcaatctttaaatttattttttctcatttcttgatgatttgtttaccaccagaattgctattacattttaaaaactgaccttattaaatatgtatatttagttagccttataattatatgtaatgttcacaccgagttccttcattctgctacttctgcatttctgaattctttattttgatttcttttttaataaggtaaatacactttctccctttccaaatcctggagcattttctcatttatcttacatgctgaatgttcctggagagatgcttgaggttcaccttcttttgtcctgtacaaaggacttgctttctgtctggatgtctacagcatttgtgccttatccttaaagctcagaaacattcctcagtgttgataatattgtatctttttttcctggtacaaaatattccttttgtatcttcaggttcagattttctttttattttttattttttatttttttatttttatttttattttttttatttttatttttgagacagagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctttctttttattttaaaaatgttctaactcttcttgtctctgtattatatttgagtacttttacttttctgtttattctcttcacctcttcaagaacaccaattatactcaatttagttcttttctattctacctgagatatttctcattttgcttttattcactatctcttctttcttagtttattcttgggtgattttatcagattactgactctgttcagtggcatataatctgatttttttccttgtaacatttatattgttatcttctattgctgttctgggttctgtaatttcattttatatctcctgtacaactttttaaaggtattttccaaccatccccccaaaatagtcttgtttactcttcaatgtatttgagagtacggagaagtatttgagagtacagagaagtatttgagagtacagagaagtatttgcctaaaattttattctattacctgcggcaattcttcttaagtgaagtcttcttagctctttgcttgtgattttcgttggctgtgcatgtggtacatcttaggtcctttctgaatattactcatatttttattggaatgggtattattagcgccagctaattgctcaaaaaacagggtggggagtgcagagaatgtgtgttagttcattgtgcctaatttacaaagaaaataggtttatttggctctctgttctgcagactgtacaagaagcatagtgtcaggaactgcttctggagaggcctcaggaagcctttactcatggcagaaggcaaagccggagtggatgtgtcacatggcgagagaagacgcaacagatgggagaggtttcagactctttaataagcagctctcccgcagcagcaagtcacgcatgagggaactgctccatgacccagacacctcccaccagtccctgcctccaacactggggatcacatttcaacaggagatgtggaggccacaaactaactatctcagagcattggctgttacagtcaataacttttaaacagttctgctgtcaccaaatacctttccccccacaaaatctctgtcttctctgaggacacatccctttccttagatttgggggcatcacctgactggggtaaaatgatgccccacacaggagctggcagtgactctcagatgcctcttagctcaatggtttgtgacttaccattgatttttctctattcgtacatctcgggttagcattttcttctgtctggctctttctccaggttacgaagccatgtccatagaaaataggccaagaattccagaggcaacctcccgcccacacgctggggtggaggcggcctgttccctagtgctcctgtcactcatctgtgccggcacctttggttttcaccataggatcctcggattcctcaaggcccttcacctccaggaaaagctaagactctcaagaggtgtgtgtcaactttggggcagttgccattcagacccccttgcaagctctagaaaacccaactgaaacagccctaaatgtaaacactctattttcccccacagagcatcccagaggcatgtctggcttcaagtgagattcatccaggccttaaacaacacagccataaaacagtttctatttctcaattccgcatcctcagagttgccccaattctctagcaactcctccactgtggtctcaagagcctggctgaatctcctgcccaactccatgtctcatttacttccagtaggaaaacactgcctttctagaagatcaacaaaagggttggagctaagtcctgcaggtccgcatggacctgactcggactgtatgtccgttctcgaacacatcaccccagcccaagggtggagaacgtcaaccccctccagctaatcagggccgcctactgcttgagcaagggaaagttcaatcccattgaaagtaactcagcaggatgtcacagcacagttaggaaagaggagtcgatgtggtagaggcagccaggaagtattctcagcaggtcaaagcgccacttgaactggtagaaattctttgtattcttgagctgaaaatgtttccttttcttaatttaaaatggggtcttctactttatttttattttttgtccatttttgtcatttttagagataaggacagtatgattgcttgatttcttatctttaattggaagtcctaacttagcaattttatcagcttcatgatttggctttttctttattcattaagccaacatattttgaacatgtgtcatgtggtaggcattgctctaggactggagttttgacaatgatgggggcagacgttgcccctgcccttttggaacttatagtctagtgtgtgagacacaactgggaggaaataagctcaacttaaaaaatgtttaaaaccatcaagctattctggctaatagtcttccttctttccttccttcctctctccctccctccctcccttccttcctctctcccttccttcctccgtccctcgctttctccctctctccctccctccctgcctacctgcctcccttccttccttccttcctccctccctccctctctcccttcctccctgcctccctccctcccttcttctgtttttttcctttctatttatttagggggaggcacgtgagggatgacacaggattgagtcatggaaactgctcatggtaatgaagggagtcctaggcaagaaggacctctccagaaagatgctgcacatttctgctttttcttggctttcagttcttaaggctcccaaagaaaactccacttgcacaatttctccttgttccttcggcctttcagcaattacccagcccattcccaaagcctgggactctgtgtcatcttgaatggttcacgcctccttgttcctgatcttctttccccacctcctcccatccttcctgcccccagttccccagatagtaacgaaagcaaggtccttgggtcctgggagcacccacatgttcttttgggagggctgagtggctactgacagcaagaacagaacctagggccagtgtcgcagaattcccagagctgtgccagtttaagggctacccacaggcatctctatgctttgccatttgcccctgtaagaagtaaggtcgggagtcctggagaagtcaagctcaagtcgtcctttgtaacgacactaaagctcaccttgagttcacttcacacgggccagtcacaaccacttaattctgtcctcacagcccatcagcaggcactgtggtgtttctatcttatggaggaggacgccagggcttgcccaacgctatcaccttgccagagtcgtgctgctgaatgatggcagatctagggtgctgtcgtgggtgtctctgtctccctcccacatcccagtctctacccaccatactccctggaagtggagagcaatcacagatctgctggtttctttctctgcacctggcaacctctggagggcaaggcctgcacttttccagctgtgacaccagcccatgtgtctcatatcatttctctctcatgtagcaagaatttctccccagaaaggaggtggcaaagatgggcagggggtgcaaaggtgggggctctgacagccaggttccagggtgcactgctgagccagcccacaaccatggtgaggcagggagattccgcaggactccgtatccgtgctttgaagatggctttcgtgcttttagtcttttctttgttcatttgttgtttgttttctgatgatgttttagtaaaaagttcttttgaaaatcccaagctttctcagctgtgcaaaggggaacaaagaacagggctttggtgttttgtccggacttggacaggtgtcccgctgaggaagtggcctgtcccagccccagtcgggtggtgctgggagggtggggagagaggcaaccaggctcagcttggccggggcttctgtgtgcccttccgtcggctaccttcctcctttagagctgtctttgttggatttgcccttttccataaggagccatcgacccctttatcatccaacacaatggaggtttatgagaaacatattccaggaaggttaccaatttttcccttaaatagacccaagtcaaattgctgatcctcccaatctcatccttgccactgtgaccagccctctaggagggaaatccagtgaggcccagtgggtagagaacattcctggcagtttggcccaccctggggggtgtccctgaatcctattgagcatcagcttccaaacccaaaaaggaagaaacgccactgacttcacaggccttctgttatgattgaaggtggagctgcccagtaaccatacctctgtgccagcaccaccacaaaccctggaggactcggagggcagagcgcatttgcactttgtgctactgaggccagagtttttgttaggctaaaagggtagagaaggtggaccatgtgtactcaatggaaccaaggagggcagaaggcgggttagaaattggtttggtggctaagttgttctcggccattccaactcctgagaacaaattctgcacacctcttcccatcccacatcccaggacatcaccctggagccttgggaagagccatggtgagtgtgttcacatcacagaaatcaggaaatgctgcaggatttttatgatcactgttggcaggttattagagaaaagtttctagagtcttagttattatttaaataagtaaaatctgacaacgtagaggcagtttaatgatccatatattatgagcacctcagtgttaactgaacgttatcaatataggcttaatgtttgcaatgaatgactgtcataccacaaagcattccattattatacatggaaaatatgtaattttttcttaatctaaggtatgttttccatttagcatggttggttttggaaagatgctataaactgactacaaaaaataaaatccagggagaaatgaaatcagatttttaaaaatatctaaaaatgggacaggcgaaatcaacgtcagtaaaacacaactgtaatgtcttaaaggataatgggattaatttcacaattgagttccaaagcatcctcacaattattatttgtcaagaaagatctacaatgtgcatttgtgttaaagacaatgactgtcacttggaggaagttttattaaaaggacagtaaacccgaggttgttcttgggagaatgcattttcagatagtcccaagtagcttagtttattacatatttatgttcttcaatgcaagtcagcaggggacccactcattacatttagtatattaaatacttcatttagaacatcttacagtggaaatttcctgtttttttttcattgctgtttgttacccaagagcaaaccgcagtgtctcataaaagcatcagcctgtctttggtccttgcagaaagcacattgaataaacatctctccacagcggggttcctggcagagcaccgcccctgagtttaactttgctaacttggcactgtgattttttcctagttgtgtcataataaagaatgcatgctccttcaagctctaagaacccctggttgccagctgtgcagaggcagcattcaggaagttccttgcaggcagtgcggtgaccccgtggggagggatgtgactgccgcgtcctagtttctccagacctcttcggccatgacatcgggctttgccttttggccactgaaagaaagttcaacatcttctctaaacagagcagaaattaattcctcatgtccttgttctcctagcgattttctcattacagttacaataatgaagttgtcacgtgcagtgggctccaggagccatggaaagacctcgggaaggaagaagggtggcttgtgctcccaactccactgtggtcctgaagctacacccacccagctccagccaaggagtgcaattggccagcggcctcctgccaggcctgcacacctgcccttcacctgggtcaaaaccatgctccccacagcagccagccaacaaggagagacgggctgctgtgagtgctggctttggtgaggacccacagcagcctatagggccctccttagagggtacagatctgggactttccacccaaccttcagtctcgctgaccttatcttggggctcatacctgcatggtggggaggcctgcctcttagccctctccactttctctcatgcaggcctttctcccactagaatctttgcagacttctgcttctcagaagacccagactcacaggagtggtaccaagagtggtcagagaaaaaaggtgacaaaatatgggtttcggtctagatcgtgaattagctagcaggtagaaaggtctccatgatgactggtggaagggcagagactcatgtcctccttgataagggatggcagctcgattgctaaagatttcactgaggtgggccttgaaacaccgctcagtggaggataatgcagagacaggtgcaatgatggaagcatttggaaaatattgggggaacaatgtctacaagacagcacagttgactggttattgcaaagctgaattcatgtactgcagaaggaaaaggagtctgggatgtattaactagcagttaatggtcaagtgtgagagccagagagcttcaaggatagcttctgaagggaccctcatcacctggcatgggtgggcagatgcagttgagcagcaggtacttgtgaaagtgtcagagctctggagatgtgtgggtgctcagtccaggcatttctgtgatctgtgaggcagaaccttggtggggaaacctctgcatggcgttccctgtggacgctgactctacagtccctgtgagtcctctgaaattgcagaggtggccccgccatatcctagtacaagcgcagaagcttccccaacaagcaacaggcatcctcccctctaggaggccagggcacagctaggcttcaatcccaacagaacccagctgagaatatgctgggcttgagaggggaggaaaagacttttcatcccaataatggaaaggccagctggcatgtgtccacatgggagctaagggagtatgcctgggattggattttgagggtgtttgatcagactgtaaatcagataagcaatagttagaagtaatttttttcagaatataagatttaacattgtagacaggatgtcaagaaatgaagcaaagctcctggggtggctcttggaagactgggtctttttggggatgatggggccccaaagtaatgggggctagaaaccagaggccacaacaatgatgaataggaaggttggaggggtggccaagggggcctgagctgcagggagtttggggatggctgatacagcagattgttcttagcctcagataggcccacaagggtgccaccccatgcctgtaatagtaatggtaaagaaggaagaagcggcaggctgaggactgcctctccgcaaccaagacaaagcctcctgctcagtccccaggcatacccaatttcagacttgaaacccattgactgaagagctggcttgtcctgcaaatacagattcctgcagcatggtggccagcatatgagcattcccccagtccttcctcaagggcacctaaggccatttactcatgtgactttaatctgggtagggggaattacctgacatttcaaagactattggacacaaggtctgaatttccagggatacctagagattccacagagtcatcttggctttcccggtagagtaggggacctgggggccaagtcattactggatctggctgttgtccagctcgcagtgggcctgctgggtctgtggcttcagcagtggtctttcccagttcttcagtggactgttagacaagagctacagagcaggtggaactacgcccacattagggttcttggtttgtgggataagagctatcatagtgggaaaggccaattggaaaaggtgaaaacccccgaagctgccccctcaacctcgctgaatcttggcaggagatgggaaagaaaggcagactgaagtccaccattaaggacctaaagggtgcacagtgttggtaccgatcactgctccatcgaattgtcaggctggcccctgcagaaactctatggatcccagagaacgaatgtcgactaccactactaccagacttaacctagcagtagcccagatcacaccattagagcagattagcaaagcaccaagaacggggcatgtgcctcttagtttgccagtgcatgctcgaccattccatttggaaaagaggaccagaaacagctcacataggactgatgatatgcactgctaatttaaccacagtgctgtatgaactctgtgcctcttggcattgagacgtgaagccagctggacttcctgggtccagtggggacttggagaacttttctgtcttacaaagggattgtaaaatgcaccaatcagcactctgtaaaaacgcaccaatcagtgctctgtagctagcaagaggtttgtaaaatgcaccaatcagtgctctgtaaaatggaccaatcagcaggagtctaaaagtagccaatcacagggaagattgaaaaaagggcactctgataggacaaaaacagaagatgggcagagacaaataagggaataaaagctggccaccccagccgcagtggcaacactcaggttcctttccacctgtggaagctttgttttttcactcttcacaataaatcttgctactgctctctctttgggtccatgccttctttaagagctgtaacactcaccgtgaaggtctgctgcttcattcttgaagtcagcaagatgagaccacgaacccacgaaccaacactaggcacagcatgagcagtcctggactgcttggcctaactgtagaatactgtaatgatcaatgacttcatgcagactgaacgaaagaaacaagagggggctcatgcactgagagagtaaggaagacacatgtgatgctgcaggtagggggtaaaccctgcaaagactcgggagttgaccactccagtgaagattttaggggccagaaattaaggagtgcgaggattttgctccacagtgaaagataagtcactgcattttgcattaactactacaaagaagtaagcatggtgcctgggttctggtggcaactcatcccattcctagattgtgtgtgacacagaaggcttccaggtataccgtggtgggcaggaaagggctgtgctgtgggtccaagctgtggtgcattcatccctactgctggggccacacaatcttgcagaccctatggtgctggaggcatcagtagggatcagaggcagcttggagcttccagtagttccacagaagagccacaacacaggctcctgggatgcgggagcaaggccttgccatctgcaacagaggattaggcagccttgagaaatgtttcttgggtgctgctggccttggtgaaggcaggctacttgactgtgagacaccaagtaaccctgcttccggagctgtcctcaggaggtggctgaggaaatggaccctggtcattgagaggagctgtggctgcttgtacacagtggggcagggaggaacatgcctagggctccactcgggtgcctcctggtatacccgggttccaccgtagaggtaaatgggtgctctcagcaagcttggatgagaagaacacgatgaccaagggtgtgatccttcgggtcatgccatcagacaagccactgagccctgccaaagtgctgagggtgagggacatttagaatgagtagcagggttaggggatgattagtaccagctggggccccaagtgaatgacagcaatgtggcctacagcccatcccacctgcctccctcagctgtgtctccctctgcagaaagccccataggggccctggaggagctgctcctgcagtgtgtggtcagtgagaacccctacccatggtggaccctggtagccatgagtagcacagacccccaattatggaagcacacgtgaacaaaaaccccggcgtctgcctctgaaatctttctcgacatttgcttttccctggttctcccagccaatgactgaggacagcaggggccctaaggccagcccggtgctggaagaccagggcttctctgacgtttgcttcacagctctcctaaaccttcctctgggtgcatggccctctgggacgccgccatccaaccttacctccctccctctttcactggtcagacttgctgcaaggtcttaccctggcccctcacccattctctttcacacatggatttatgaagtcctcacacatctaagcccatctcattgtcttctaaatgactataatcatgtcacttcacctctatggactttggtttctcatctgcaaatttacagagttagaatttaagaagtcaaggtgttgttggacttattcacctctcagaatctgaattcatgccccaccaaatacctagtgcaatggggaactagtgcatattcatgaattttgtaggttacagtaatttgagtgatgggatgtaaaaatcagaaagaaagcttttctttgtggtaactcctctgagagcgattttctaacatgtccccacactcccattcagccccacacctcttctaacactgcagtcactcgtgaactcagtatctctgcgtttttgtttcctgttctccccaggcttctgcttccgtggcagcttgattccatgtgtttgggtggaaagagcacagaataggtgggggctaagccttgtgtttgagcccctctgccattttctcccccatcctgaaagacacgggtgtagaagaagcctgagttttaccatatgcttttcccaagaggctaagttttaaataagtgtatggaatagcaacaattacttattcagtacttagaattctgtatttactatataattttgtcaaatatcctggggttcatattattatccccatttaaagataaggaaactccgaaaggctaagtcatttgtttaaggtcatagagcaagcatgtagcagaatttgaaatcaaatgtaggttttttggatctccctaagtcaaagcatgtttctgttgcttaacattttaataatgaagtattaaaaatcagatgagtccttcccagaacgctcaatgcctgaatcatttcctctttctgaggcgtctagagaacagccaggtgtagccatgtgactttatctcaagactctgtcattgcctgccatcttgcctgtcttatccataaacgcacagggctctccgtgggcaggggactgggtcttaatcgttgtattcccacggtagagcgtgatgcttagcacacaggagatgcacaacaaatacttacctagtaaatgaatggatgggtaaaagaaatgatgggttttaaagattggattaatttatgacatgagatacaatgcaatcttgggtaaaccattgaagatgttttcatcttgattccatttcttcatatgtaaagttaatacaattaggtctcactaagtaacctctgagttgcttttcagctgtgaatgtctgtaatactaaacaatacacgcatattatgaaagcttaaaatcacatgctcatgtgcacagtaaaagaagaataatgagaaattaatgaaacttttctcaattcagttgtttaaggcaatggttaatggtgatttacttaacacttttattataagcgtcagtattggaacaacactagctatgaattggaaaatgaactagtttcgtggagactcacatgtgccatttgtacactggcacaaaaacttaataaagctcaagaagcaacactcacacaaagaagctgcagttggctgtaagaagccagtgtagtccttcctaacgaacattccgactgttcttgtaaatgtggatggcagagtgatatacacacaaacgtgaatcactagttttagaaaacacaaatttcttaaatcaatagcatactttttatggtgactgtaagaacagattttttttcttcccattctcaatgtgtttggagtggaatttcttggggaaagccaggaaaacagaccccataaattagcctgatgtagaaagtgtttatgtttattgtttgagcctgtaactgaaacaggatggggtttagctctgggatgtacaggtggaaacacttagtgggaacagtatcctctgccacacacaagtatcctgagggagaaagactagaacattccccagaggataaagagctctctggatttttacctacaaagtaaaggcagacaatcttttacctggcagggttatttccttgggtcccgcttgttattaaggagtgaccccaccggaattgtggtgagtagcatcccaggtccacctaaaagcagtttcatgaccttccagcccagcagctcccctgtgtctgccagtaaggactgcacatccacatgtggctgttttgcccactggacctaaaagcagtgggttttaaactccgatttcaacaaggctattacaacaaagctgtctttgactaagaatctcagaagctatttttgtgttcaatgtttagtctaaaccttgcaaagttaccaagtattaaattaacatatattttcttttaaatcaaatagaagtgcacccttaactgcagttttaatttttccgagaacatgctgggatatttgcttgattctgagatgtctttacttattcttgtctgctcaataaattattttttttaagtggagggaaaaaattataaattaggactccattcttcccacaacacaatgactttcaagttaataacaaaaatgtattattaatcatagtatttagcatttattgagcactaataatgcacgaagagtttgctaagaactttcctttattatttcatttgtctcacaattacctgtaggtaaatatatcttatatatcctgtatttctctctttttcaaatgagaaattaagtctcaaagaggctaagtggactgccctaggttacacagttagtgattagtactcctgggattcaggatcacaaaagtccatgttctttctccggcacctctgatgttcatccctggatgtgcagaatcactctgggaaccttagagctgatcacccagccctgggccacctcacatcggctgaatcatatctccgggtgacgtgggaagcatcctgctcgttcatttaactctccaggtgaccctaacgtgcagccactgctgcaatccacccccaatcaagccagtccccagtgaactgtgggcattcactcataactggcacagccatcccctgaaatctgttgcgaggaacaatactcaaaggctaactaccaagttaatctgtttctcaggtatctcaaacccaaatcagttccccttttccaaatctaaaccaacattttcactgctgccttgccggtgtttactgagtgcccataacatgcgcagacagacctgacatctgtgttccctgcagcacgagccctgggcctggcacaggtacatttttattgaataaatcaatgagtgaacgaatgcaaggttgaataaacatacaatgcttgatgatgtcataaatccccaaataatcacttttttccgtaaataattttgtacaggaggaaacggaaggtttatactaaacatggggttcatctaggacctttattcaaaggaaacttgaaaacttggttgctgtaatgctggtttgtcatgatagccctttgataggaggagttattatgacaggattttatggggctgccataaatagtgagtaaacaggaacgaggaaaacaaatgtgacaaccaggggtttgtttattttccttatttatgctctgtcttccgtctctagattaatttctatgtcaaagcgttagaggcagttggtgtgccgggctgtaattaagtgtgtgagtgtgtgtctgtgcatccgcactacatgatgtttaaatgaagactaaaaaatttaattaaataaacaattaacaagtttccctatggctccaaatgcactaatagttgctgacatcccatatttcaatgtgtcccctggacttgggatgtcacagttatagatcttcaggtgggagggcccagcttgctgagactggactgatttattcaccctcagtgctcccttgggtgttcatgaaggagctcagatgaacatggccacagcagtgccacattcctcactgagggcagcagtaccaggatctattccaaatgcataaagctagtgctgtgcagtcaggcctctcatgctgtgaagtcatgtttccactggaggtgctgtgtggtggggtttgaggaaggctgactgggcttagtttttctgtgtcttcagagcagcaaatcccatgacctggagggccctgcagccaccccttatacaggaaagggcactctcttagttcactcaggctgctgtaacaaaacacctgacactgggtagttgtttttatgttactttggcataaaaattatcttctttttctttttttaattttactttcagttctgggatacgtatgcagaacatgcaggttcgttccatagatatacatgtgccatggtggcttgctgcacctatcaacccgtcgtctaggttttaagccccacatgcattagacctttgtcctaatgctctccctcccctcacccctcaccccccactcccaaataggcccaggtgtgtgatggtcccctccctgtgtccatgtgttctcattgttcaactcccacttatgagtgtgaacacgcagtatttggttttctgttcctgtgttagtttgctgagaatgatggtttccagcttcatccatgtccctgcaaaggacatgaactcttccttttatggctgcatagtattccatggtgtatatgtgacacattttcattatccagtctatcattgatgggcatttgggttggttccaagtctttgcgactgtaaatagtgctgtaataaacatacatgtgcatgtgtctttatagtagaatgatttatattcctttgggtgtatacccagtaatgagattgctgggtcaaattgtatttctggttctagatccttgaggagttgccacactgtcttcaccaatggttgaactaatttacactcccaccagcagtgtaaaagcatttgtatttctccacagcttcgccagcatctattctttcctgagtttttaataattgccattttgactggcatgagatggtatgtcattgtggttttgatttgcatttctctaatgaccagtgatgatgagcttttttttcatatgtttgttggctgcataaatattttcatttgagaagtgtctgttcatatccttcacctactttttgatgaggttgtttttttcttataaatttgtttgagttaagacttcatgactaaaacatcaaaagcaattgcaacaaaagctaaaattgacaaatgggatctagttaaactaaagaacttctgcacatcaaaagaaactatcatcagaatgaatgggcagcctacagaatgggagaaaatttttgcaatctacccatccaacaaaggtctaatatccagaatctacaaggaacttaaaaaaatttacaagatactcagtaatttataagcagcagacatttatgtctcacagttctggaggctgggaagtccaagagcaaggcgctggctgatttggcatctagggagggtgtgttctctgcctcatgggcagcaccttctctctgtgtcctcacatgttcgaagaggctagccagcaacccaggatctcctttatgaaggcacaaatcccattcatgacccaatctcctcccaaaggacccttgtcccaaaaggcccactgaactcccagtgagttcagaaatgaactcatttctgaagacatatcttgccccgacttgggttgatttgctgtgttcccaggcaactcatttagccttgttggatcttagttttatacttacttacctctcacaattgttttaggaactgaaagtttcgggcagacccccaaaactgggcctggcttcttgtgaaatgtttctatgagtgcaaacctcccgaatggccttcaggtgacatttcattgccgtgcctctgctgaggatttacacctgagtgaaaagtaccatcatcccctgcaagcatgtgcaaaaacatctgaaatgagtataaagtacaagcaggaagatgaatagatccctggggagattttacttcactgataggcttctaccagtactacatttgttaaaaaaaatatgcaagttggaacgctaagaggaaacaccccaagtctaaggagaaacatcgttaagaataaagtcttagaaaagcatttcaattggaaagccccatcccttgagtcagtcctaaaagtggaaagcgaaagcactgagtggagaatatttgttacaaaatgctgagactcatgaaaaatctgtcctgtagaggcaggacaataatcccaagcaaacataagctttcaagtgaaatatgtttataagatgagttgtaagtttgtcatagctttacttggcctaatggttaactacatcaaaagaaaaaaaaatcataaatataacatgatttattaagctttaactaaagtacacttctcatgtaagcccacagtgggttctcagaagagaatgagtagagctgaagtttcaagagaaacacaacaacaaaaaggcaaaattgaccaagacagaagagtggaggaaagttacaattcttgcaggttttttgaaaatatcagttaacagaaagtgacttgagctgacaagtctacaaataaggaggagaaattcggggatagataagatgagtggggcttagaaagtgagagcagaggtcactgtggggttgggtggggttcaccaccacaaaaagccatttggatgtgggtgtcaactgtctgagggggtgtgggctcttcatgaaaggccagaagacatggcctcctcgtgggggatgctcaatattctggggatgtacatggattcctttcctccaggagaagcactaagggagaggccacatgtacagccactaatatgcagccactctgtctcaaattgttcctacagagaccactcgctggcttttccttggagagggtctgggaaagcctgcaatatcagagtcacttcatgaggagcccaggagaataaataagaccaagacttgtcggccaccatcagatgaaatcttgcccataaggccatggagtcatatttggtgtctgaaaatccatacgcacagcatgcatggtctataaatcccccaaataacgtcatttacccatacctgtattgtcttttgaattatgtggataccattgttattaatgaaatacaaatttttaaatatttgttactgaaatcacagtagcttgcagtcaacacactttgaacgttacggataatcatatagggagatggccttgcaaatttttgatttcaaagcaaatctattaaactcataacagttagaaataagtgctcccaagcttaaaactacagaggtgaattctctcctctctctgtaaccagaccaagggcttggagaaccctggttgagctctgtcttgttggggggctggggacaacaactcacagctaacctaccccaggatggctaaggtttcttctttggggactgcagatttggtcagattggttctgcggcatctagtggagagaaaagtcacacccagaagtcaggaggacaatttagatgaaaagtatagacagcaataggaagctttgggatggaagacaagcagggaccagctctgaggaacagcagagcatatgggcactgtggtagtaaaggaagccccttgccctccagcactgtgccaggcagaataacacctacgcgcgcgcacacacacacacacacacacacacacacatcctacctgtgtgtaggaacctgtgactgtcgccttagaaggctggagtcgcttcgctgatgcaatgaaagatcttgagatggggaagttattctggattatccgggtgacctaatgtgatcccagggatcctcacaagcagagatctcatctttgctgtagtcaaagggagaagcatgtgaccacaaaagaaggctcagaaaaatgccatattgccgactttgaaggaagggaccatgagccaaggcatgcaggcagcctctaggagctggaaaaggcaaggagacaggtcctccctgagatcctccaggggggtcagccctgccgacaccttgctttatcctggtgagaccgatgttgggcttctggccgacagaatcacagggtaataagtgtgcattgttttgagccaataagttggtggaaatttgttacacagcaatagaaaactaataaaatgcccaactacatcctcgtcaccagattgagagtttggggaaacaggctcctgaggtcagtgtttggcctggtccttggagcccaggactcctggaaatttccttgccttctgtggatcacacaagcagtcaatctccacagatgcctgagtgaaggcacccaggggacccacaggattggactctgcagagtgccttcagaggacttgggtgcgggtctccagaatcctggactccggcagaaaccttaaagctgctcagtcagtggccctgataagcctctgaaggaggctgcccaagggaggaaactccaaaataggcaactccattatttcttcaggaattgagcaaattactgagggaaaagactttgagagaaaaacttattatttgcaagaaaagaaattaccctagagtaaacctggaaaatagggtttaactgtattatttttaggtcactaaaattgattgcctgggtttttaaaaaatgctgcccaattcaaaccatttacggggggagccctttgcagtacctgcacatacgtttaatgatggaataaaatgtccttggtttttcctgggaagcacatgttcttttggtctgcatgtttactgcatactaaagacgattgtagctcatttgccctaagcaccagaaactggggttatgtacagggcagagacactcataaaatgtgcactgggacgttggacgtaagctttgcagtgacagctttcagagttgacattatcgtgtgtgtgccttgtagctagcagaccaggaatgcagaagcccagaacctcatcaggcaatatgggcttatgaagctgatgtcacaatgtgtacagtaaaaggatcagagcacagtcatgatcactatgtagcgtgtccttgtacactgaggagaaaagcgaccctaaactacacaacgaggctgcaagtagatgtcacatgtgtccctgacactagggcccttttggcttccctgtctcttgatgagtgacaccttgtcagtacctcaagagtgtaaagcaaattgcaagaaaagtagaagagagatctacttctgcgtgtcctaggagccaagagcaatcattctaaggagtctggggaagccgctgtgagggtttcaatgacctgggcagtagcagaggagggaggaccctagtgtgtgtaagatggttaggactgggcaaccagagaaggtggaaggaggttcagtactgggtgatggggctcgagaggccagaggtaggaaaaggagtggcttgtttagtggacagtaggcaactgacaggaaggaagggagggaggaaatgagggaagaagggagaggggaaatgagggaagaagggagaggggagggagggagggagcataggttaatggttgtgagacagacatgagtgaaaataggaagagggattagagccaaacagcagtgggtcctgactcccaggaagaggcgcttaacctcagcctgttgtctttgggagtgattttgtcacctgtgacacatgcgtgagtgacacaagggtgctggagggagcgtaaggctaatgtgtgccttctgtttaaaaactccttgtgtctgcgccatactttcatagagctcataatttgatgtgtttgggaggattcgctggtctctccagcctggctattagagaagccatcagttcccagtgactcagtgagcgtgaggacctgccctggctgggtgtcagacctgagggagcgagagcaaccataattcagcagttaacccatgctcatcaaacccagcctccctggctttaaacacctcctcaccacacctctcgcctctcttccataggggactgatttcaactttgggttttcaacttcaaactccctgtctgaatgttcccaggcagatggatgccccaaagccacggatttcatggagctctgctgcaaacacgtagctgcctgtgcagacagagaacaggtggccacaggaagaatggattacaaacagggagaagcccatgaacaggcgctccccatcactaatcattagggaaatgcaaatcagtaccacaatgagacacacagccatgaggatggcaactatcacaaaacaaacacagaaaacagaaagtaacaaatgctggtgaggatgtggagaaataggaacccttgtacagtgttagtaggaatgtaaaatggtgcaggtgctgtgcctcttcctcaaaaaattaaaaatagaattgccatatgatcgcgctatatcatttcagggtgtacgctgaaaataaagcagggaatcttaacaggtgttcgtacacccgtgttcatagcagcgttattcacaatagccaaaggtggaaacagcccaaatgcatacagacagatcaatagataacaaaatgtgtgtgttcccacaatggaatgtgatttggctttaaaaagaaaggaaattctgacacatgctacaatgtggatgaacatttaggacattatgctgagtgaaataggccagtcacaaaaggacaaatactgtgtgattctacttgtctgaggttcctagagcaattgaactcatagagacagaaagtcaaacaggggttgccaggagctggggcagaggaaaggggagtgagtgtttgatggggagggagtttcagttttgaaagatgaagagaagtctggagttggatggtggtgatggctgtaccacatgcaaatgtacttaaagccgctgaactgtgcacttaaaattgttaaactggtaaattttatagtgtgtgtgtgtgtgtgtgtgtatatatatatacacatatactacatatatatatgtagtatatgtataccacaataattataaagaggctaaaatgcatgaatatcacacatacactcacttattgagagacaattatttagcagtaaatagggaggtaaccacatgatgctgatagataattcacctgcaaatcagaagacctggaatctagctttggtttcagcttttcaatccatagaatcacttgggaatgacactcctgtgcttctcttggcctcagccaccttatctgtagaacatgcacttggattaaataatccttaggatcctttccaattctaaagttttgtgtttctgagatggtttgtggccaggctgacaaatctagcatatttgtaactcagactgatgtggctacagtatgagcatatttccttgtccaaaagtagcaggatttgcttaatatggtgtaatctaatagtccacaatccttaagtgagaaaaatgccttctagaataatctcaggtcaaataagccattatctcaggtcaaatcagctaacaaccctgactccagaaggctcttctggacctgaaggctatttaagggtgtgcatgctaggagcatttccattaacctacctgggggagctgcagagtctggtctcccagttccctctcctcctcagtacactggcagctcctgagccttcctcggtgggcgagaaactcttcaactcctggtgctgttgccataaggaagttctgcatccaggcagtctgttctggtggccaaggcttcaactgccccgtgttgcccagctccaaatgtcggcatcctggtctctactatagtgtttgctcttcagtgtgagcctgtgttctgcccacttgggactaaagaaacccttcttcccagccctgagcccagatagcactctggcttcagacagcctggtcttagagcaaatatggttcttttaagatccacaaagagcgctttggtctagcactgacagttgaggatggggcagatgatattagagtcacatctcctggtgtgactcactcctgagcacaggcccttaccctcctaggaagaacagcgatggcactctccctgtccctaggatggagtcttgccattagcctcaggctcatagttggaaagcacgatgggggaaatgggcagagacggcctcactgaagtgcagttgctgaccagacactggcagacacagggatggcttgacacgtgtgtgccaaagctcattgcaaggtttctgcaaagtccatcaacacctggaggcacttctgctggaatcccagctgacctgctcctcgtggatctccttgccagctgacagcaaataagctgatcccaagtgtgcaaactgcctgcattgctgtcttccctctctgcttttttcttatatacatctgttgttagataacatagatgaaactgacctatgtctcctctggcaccaagtaaacaactgacgataatcaacagtttcattcctccatccgtcagggcaaggttttcgtctcttctagtcagggaagcataactctggggcctcaagtctgaacaatggccctaacgtagcatttcattgctttttgaggagcaggccatgcacatggggaccctgaaccctgctgtgagccaccctccagctgggggagcctgtcaggctgcaccccatctcacttgacttggccttgattcaccatcttcaaacaggtagctgtgaatggcttaggaccattctcagagttcacttcaccagctgagtttaaaacatcccgctatcctgtgagaatgatgaacagccacagccacgctgggcctgtgcttgtacaacaaacttgactttgcttctgcgcttcccagaagacactccagcatgctctgggagtaggcatactgggtatttgcacctgatgtgcaagaaagagtgcttggaagatcacagaagagtcagacaggaggagagccgaggggttgaaaccctcccgcgaacaggtacctggcacgtacctggcacaccattctcctccggagagtgctgctctgtcgcccaggctggagtgcagtggcacagtcacagctcactgcagcctcaaactcccgggctcaagtgatcctcctgcctcagcttcctgagtagctgggactatgggcatgctaccatgcctggctaatttttaaatttattttgtagtagagacagtgtctcactatgttgcccaggctggccttgaactcctgccctcaagggatcccaaataaatatatttatttctaaattcattctaaatgtttgcaatgttaagtatgtgtggcaaaagaacagatacctttcattttttcaatcacctttcaaatattgttacaaaagcacatattactgtgaaatagtcgtaatttcagaaagaaattattcttcattcaacttctcttaagatttttaattaaactttttattttgaaaacattcagaacctacagcaaagttgcaagaatattacaagttaatgattatatgctcttcccctctattctcccaccattgatacttagccatgccaactctctccatctctatattctacacatttacagtgcaattatcaaatttagaaaacttaacattgacacaatgctattatctaatatgtggtgaatattcaaattttgttgatggttacaaaattgccttaaaagcaactttttcccctcaacacaaaatccaatctagggtgatgcgtcgcatttaggtgtcatgtccccttagacttccttaatcaggagcagtccttagcctttctttgttccatgaggctgaaagttcgtttctgaagtgctcagggtctttttgttttgctgacgtctcagtttgggtatcacttggttaaggtggtgtcatccagagttatcttctggaaaggcaccttctatcttggataggaaggaatttaagagcaggcactaggcaactgtaaatatcaccccacaattccactgaatgatattaatattcagcgacgatctttgcccgggccaacaattattatggtggtttcaaagcagtcattttctgactcctttatcagttggccttctataaggagaggctttctcatggatcccaccccttcacttgcttgttttctgccagcattctgtactcacaggttggtttctttgtccagtgagttgtcacccactaccttcatgagccattttcaagctcaatttgtctcatgtgtgcccagtggcagctccttcaaactagtccttgtttccttttgtccccatcatgttttgagcagttccttactttggggctgatcctgtacttttcctgcctcagccctggagtcagccattctctagggagctggttccctggagtgggtctggcacatgtttaacaaaggaaggaagatgcaagagaaggaactccaacatccaaatccttcatttaagagagtcttgaaaatacccgggaacaggggaactcttgctgtccagtggactttaaccttaatttttccatattttcatattttaggccctgcatgtttttcttcgggaaggctgtgcagtctgctctgaggagacagatcaacctagcccttctccaggacgaactccgaaaaccacaggaattcacgttcaaaggatgacgcatctcagaatcaggtctgtgtgtatgtgaattgcttttatctcgtaggaaagaaaatccccatcttatacggccactttttgacaaaatatgttcatgcatccccaaatcagaaaaatcatttgttacttcagtttcctggaaggagaaaagcactgaataacttctgcaagcaaggaaacctgagttcagtgtggttcccagggcctgctacctccttactgactgagacctgggcgtttggccgaagcacacatctctcaacaggggccacttatatctttatcaaggggtgcctggggtgtgtgtgtgtgtgtgtgtgtctctgtgtgtgtatgtgtctgtgtgtgtgaaaaaacagagagagaaatgaaagttgtggaggtgagaaagtatttcataggttagatattagtcatcatgaacatttttgcatttaaaatgagtatcttataggacagaagttcctaacgcagagtttttaattttgttttgctttttattttctaaaatgaccttttaaaataaaattcctccagcctggccaacatggcgaaacctcatctctactgaaaatactaaaattagtggggcgtggtggcgaacgcctgtaatcccagctacttgggaggctgagggaggagaatcgcttgaacctaggaggcagaggttacagtgagccaagatcatgccactgcaccccagcctgggcgacagagcaagactccgttttgaaaaaataaaataaaataaataaaattcctccctacgagacatgataccactaactcacccctcttcccaaatttgcaaatcaagttattaaagctcttttcaattcatttttcctttctgaacaatgactatttaatataaagagttaactcgttctgtttttcaatacaaataagaattacaaactgtagagctatttctagcagaagtactttcttacggaaccaatttttcttctgattaattcaaatttattttaaacgtgtgaaagaatttcaaatactgttacacagatattctaaatgtctaaaatcaactctgaaataaagtccctacctggagcctccctggctcactttctcttccttagctattctctttttctttcttcctgtattttttcattgcaaatcttaaagtcgtggtaagaccgaaaacaagcaaacaattaactgcacaaggtaacccccattagagatagtgctgtgaatacctgcagagggggctgtggaaacagtgacaggctgcacatggggtgggggtgggagtgaggaagacccaggaggggcctggcaggggagccagaagggcaaagagcagcaggagctccgcaggacttagtgggtgagcaggcgggcgagtgagggtcttgcggggtgccgggagcaggcgggcgagcgagggtcttgcggggtgctgggagcccgcaggacttagtgggtgagcaggcgggcgagcgagggtcttgcggggtgctgggagtggatgcgctaaagtctgagaagtggccagggtcctgatcgccggggggtctgtcgtcctcagggaggagctggactttccggccagcacaaagcaaagccctttgatgagatgctttgcttcagaagtcaccttggcagctgcgtcagggaacggatgtagcggctcaagagtgaacccggaaaggctcctaaggaggtccctgcctcagtccaggcaaggctgtggcctagacgaggtggcgggctcgtgtggatgtggagagaggtgggttttaggggtagagctggtccgacttcctgataagtagatacggagtgggaggagtcaggaggtctgttccgggcccgccattgtggagccggaagggaggccacgctgacagggaagctgctgtgaggtgaagaaggttcgctggttttctggcccgtacctgtgcaggggtcccagggcccggtactctgttctttggcgggagctggttgaccttgtctgaggtcattgttcatctacgcatcagggtccttctatgagtcttcgaagccagaactagcgaagagagtcagtccagcccctccacgttcccttcactttcttgaggaagaaggtctgcaacaggaccatgtaaaaccaacgcggaggaggagagagagagagagacggaggggagacagggagagacggagcgagaagggagacagaacgagagagagggagggagagggggagagaagacagggaaggatggcggggagggagagaggaagagatagggagaaagacagggagggagaggaagaggcagagagagaaagggagagagagggaggtgggggagagagacgtttgaacgaagtctacagattagttaatagtgtgatcattgttaacttgctgactttgatcatggctgtggttatgggtgttaatatttgagaaagctgaatgaaggatgaacagagatttttcaccctaagtgaaaagccataagtctgaaatataaaacattaaaaagttttttaaaaagaaaaaatctaggcaaaaattatagcacctcaaatactgcttttgatataatttgtgcctagtcaatttcctaaaaaacattatttttctcttgaaaaatataaggtgctttgtaggttagtcttggctggtaaaagagaaaagtatgcaagatagagtatgctctaaaaaagtaaatacatagcatatggggcttctaatttcctagttgccccttttggcatggaggcattgttttaaagaaaatctattctttaagcaaaagctccaggtgaggagtaaggggtgagtttgggggccccctctggctctggggaagggggaaacaggctttaaagctggggcaggaatttcccagcctagagagttggctgctcttctagttacccgatttttccccctgaatgtatccttccccatctttgggtctccccttcttcatgttcttcgctcaatatacaaggtgccgaagttaaataaagcctttcttttcttcataatgccgcttggcatcacggagcatcttgtgctgggtgtagtgtgtggtcctagaatgtctcagctcagttttgctcaaaagcttgctcttcctggtctttcatctacttctcacaaccttacccaaaagaatgtgcaagtcaacacacaatcgcataaatgtagcagcctaatttttcataaaactaaggcgcattgaaaaaagaagtgagactgccaatttgttttgtatcttgtgccttattttattttgactcagagcatgtatttacttccacggtggaaaccatgcctggggcagaggggagatgttcaccacattttcttatattttagagagatgtcactaatgtggattctgtgaggcaaagtttgttgtaaacttggaaataatgatgatttgcagcccacagagccattgtttcatgtaattctcaggagttgaacttaagttaacatcaacatggggcagaaccgtactgttctgaaagtgatttgaggttagcggccagagtgaaagcatgagtctcttccacagatggctgagctaagacacggcgtattcggtaactcacgcatgatgagtcccacagctggctctgtagattcttggcccagtgttctggtctccaagcccaatcacgccttgttagggtttcgtggtggagtttattttggtgcattccatggcagggttagtggggttgggtgaacatcaaaaggttccgtgtgaggggggagctgctccaaccaaccattctgactctcagaagcatctgccagcatcattggtctacgggattagactgggaacctttttgaagacaagatttctcctttctcatcttttgaaaacagcagtagagcccacctcagagggttttgacatcactaattttgacctcagaaaaaataatgtgtgttttcaaaatttcaagtgatccctgaacaccagaatcttgggaaaagcatggtggtccttaccaaagctttctccctgccatgagcataggccctacagatagttcccagcacagtaaatgaaacagtgtctgcattggacaaaaggcatctcaaacctccagtagcctggttattttgaacagttttttttttcttttttgcatgaacaaatttcagtgcaacaaagaatcagaatggccacatgaagtaatcctaagtgacactagcctgatgtagatcccattcaatgcagtccctgccttccaggtgagacacagtcctcagctctgcagatacctacagagagtatcccctttcccatatttgaccttccctgtttccaaccctaacatgatggtttatgtttgtctattgtgtgagaaggcagttggtgtttttttgtttataagaattattctggaattccttccctgataaaactgctgatagactgggaccagatcggataagatttggtgttgaggacacctgtcgattgttttgtcaagatagaaggtccaagacacagaggtggctgcagtgcagagagcaaatggcctgaggtcgacaggaggctgtgggaataccagtttggggctttgtctgttcacacagctcttgggagacagaagtgagacccaagagagaacctctgtggttcagagaaggcacctcacctgtagggggtcagctgtttgtctagggtggtcccacaaatcacctagccacgtcaaactcacagagcagtgatgtagtcattttttacctcacaatagcacggatacaatgcaacagaaaaagacttgcaataaaataaaacatttcctaaatggaaggtggggatgatgtaaggtaagttaaaacaccatacagctgttttagcaggttttttgtgtttttttgtttgtttgtttgtttgtttgtttgttttctagatggatgtgaacaagattcccagggtactcagagggcaggtgaatgacgaatttaatatatgccccatctctaacgtaagatagagacaaagtttgtcaagttttataatgacttatttggagtagtgattgatgaaaaattattgtaaagtagaaatacagtatcacagaagattataggaccaatcatgagaccatataattatatatcctcatatatcttatgtatgaaactttgtgttttacaagcttaccatattagaacgggccccctgttccctgttctgaaggcatataaattcaccatgggcttttgaacgtcctttgtcccaacttcacaatcagaatttgtaaaagcaacaaaaggtcagagttcggagggcaatttctatctcaagcatggaactaacaggtaaagcaatgatgatggcccctgggagtcactgggctgtcacaaaccctgccaggggaagttggctttcagtgtcttccctctagacttcaatgtttttgtgggtgcagctctgcagacatttacatggttttaaaaaatggaacagttcagctcaggggcaaatatatagacacattcagtcttaactaccactttaaaatacagattttctacccacataagcggtttagaatccctaccatcattgtcaagtgtttgtttctgaaaagtaaataagatcagaatgaagagccggtgatcaaaggaacacagcattatttgtagcttcctacagtcgtgcgggctggcacgcctattatcgctgctcagaaatgaagaccataccgttagagatggttcctttgatcatttctccaaagcaatctcgttgtcagtggacagcttcccagaagacagtgtgaaagcacagcacaaaagacattcatttcggctttactatgaacagacttcaaaaagccttgctaagaaatatttccaactcggctgggtaccaggaatgggaagcacaggcacaggccatgcctggatcctaagagttcatgtttctctgtggccagcttagggttagggcttcatgaaagggtacaccaaaagctcctctcaggtttccccttgaagaaatatataaattaagaaactgagaaagcctcacaatgggaaaattgtgactcttccatcacgaatttttcagatctgttgaactgcatgacttccactcagccctgacgttcgtggatgctgacatcgtttttacaagcatttgctgcctggacatagagacaatcattgacatctacatggcatagcccatttttgttccagaaagagccaaagttacgatgttttactcatccatatgtaacctatgtgaaaatagagtatcctaagactgatggagtggactctgtggcaataagataccaaattataaataagatccaaggccatgcacacgcctctacacttaaacagtaagctctgttctgactgccacaaggttcttcttcttctctagcagctaaacagcactggccacgagataagcaatatcgaaacaattgcagctcatctgctgccggacgctgactagttgactccctgttccaccagccagaactaaagctttgactggacaagaggctgatttcagtcactttctccttcatgtgccttcatgtgtttgcttcaccttttgatgtgtaggtcctaattgcaatgcatttaaatgtttgatctccaccccaaagcgaggatgcccatgtgacacgcacgttagcttactatgcatgtgcacgcccaccttcatgaccgtccgtacctcctcctataacctgctgaatatgtttacttagccaacctgttcagcatccatttctgcctcacctttccccacttgaagtgtgtgccttcagtctctgctggaggctacacttcccagctcgcaggatggccagtctgcaggtcgtaaacccctataagaaataaaactctcatttccaatttatagatctggtaattctaacttgacatctgtctcctttgtaggtggcctttagtgagccagtggctcggatttatgtggtcagattctgagccggcagacacaaggacaagccagcgagaggtgtggcaggactggagattctgtgtaggtctgtatgtgatgggctttatgaaatgcatctatttaatgtactccaagccaattctaaatgaagcatgatgcagccaaatatgaaaggagctcattattgatacattttatggaccgaattgtgttctctggaaaaggtagttgaagtcccttaatatgtgaccttatttggaggaataggatcttaaagaagtaatcaagttaaaatcacgtcattcaagtgggctctaatccaatataactgatgtctttattagaaggttaaatttgaacagagacagatgtgcatagagagaaggttgtgtgaagagacacaggaaggagacggccatctatttggaacagagcttcccttatagacctcagaaggaaccaactctgataccttggttttgggcttccagactccagaactgtgagacaataaattcctgttatttaaggctcaccagtctgcggggctttgccatggcatcctaagaaagtgagcgtgaaacttaattcatcagtacggaaaacatcttggcagtttaaccactattgtaatactcatgtattgatacgtgtttcagaatttttctgctctcttcctcagtatgtatgtacagcaaaagcttcagagagaaactccaggccatgcaaactcatgaactaaactctgggagaggtgctggtgatgacctggaagggaaagatgagtgtttggcacaggacgggaccgaccgaaagtggttgtgtgggagggtttgatggggtggctgctggttgttgttgggagaggaggggcaggtgggttctctcctctggcaaggccacgggtgtggtctggcttggagcaggatccagagccattgaactctgaggaactatgaagctcctgctgcaggtaggaaagaaagagaaggtgagaagataggaggaagcttcccaatgccctagacaggttgcaggtgagggcacagacccctgtgcagatgtgctggagctgcagtgcagtgggatgcccgggaacatggggggctcctgacttagtgctgagatgcctggaagtcaaaggcacgtggagatggcgagctgcacgatgagaagtgtgatctcctccttccaaactgcagagagacctggattaccctgtccctgatccttactggctgtggaatccagaaaaattctcctaacctgcagtctcagttttctcatctcaaaaatggggttaatattagtgtatgtatcacattatgttgtgaagattaaatgaaataatgaacatctggagcatagtaaatgctcaataaatgtaggctgaataaaaaagagatccccagaccagcattatacaacttccaagattcctattgtatattccagtaggtagagtagctttttttaaattaatggtacagataataagttactgtgcacagaaaacacccaacaggcagtgccggcatgagtttatgatactgttcctctttcttctgtgcagacgtgagtggcctccaggccatagcagtgtgaccttggtttgtctgcagcatccatccaggcacgtgggaaatgttgttttcagggacactgaaatgtggaatttattcatcccctcagcaagaatttgctgagccgctgccctgtgccaggcagtgccacctgctctcagctcacacctggcattctgacagagggaggcagacagcaatggcccagagtgtcagagggggttagtgccgcagaccaggagtgagcggcgtcgggagggagtgcaagattccagcaggcggtatgacaaagcacagcacacaagatgaaatggattgggtgcacctgctcacaatgggggactagggagtgtctcaaagttatagtttcattttcaagaatgttctgatacctctgttactgtacctagatttgttttgagcctacgtttctttgaggtaattgaggggtgtctgatggagaatatatgatgaataggcacagaaaggaatgcgcacccaccaccagactcccagcactgcctgtgtaaaggagagatcaataggccaggagaaccagatcaaagaaaaagaaaaatgggaaaagtttattcagccacctgtctgcatctccactatgggccttgtcctcatgcccatggcttcactttctttttagtaacaactctactgagagataattcacataccacactcttcacccatttaaagtgtagacttcagtggtttttagtacattcccagagttgtgcaaccttccccacaatcaatttgagaacatttaaaccacccctaaaagaaaccccgtccctataagcagtacctccccactttccccaggccccagcgcctggcaaccactaacctactttctgtctgtaaggatttgccttttctgcacatttcatatcaatgcagccataccatgtggtcttttgtggctggtttctttcccgtaatgtcttccaggtccaccatatcatagcatgtgtcacgctacctgataatgtgtgattcttcatgcctgaatcatattccgtcagctgtgatctatcacaatgtgcctacccagtgtcagctggtggattgccggcctcatttaatttcccacctgtacgcctctgtatgcccagctctgctgctcactcagccctctgcgctgttcttggattcccacacccagaagctggcaggaagcagttgaggatggagagggaaggaggcaggggctgggggtcgcagacagcacagcagtgagatcatgtgtgtcctgggactcttccttcctggcctcagctctttttccctcaccagtcctatacctgaaaaccacccgtcctcctcctcctccctggctgccagagttttgggagcaaatcctgtaaccgtgcagatgccctccctgaggtgtgtccctgcagcctgccttcattctccttgtggtcagggagaggtggctcccagctcctcccaagccttcactgcagttccagagcttccatctggaccctcccctctcatagtttctgcccaccctcagccacacggcactagagcatgagcttctcgggggcaggaccagaccttatgcatcttgacactccatggtgcctaacacgtgttcttaccatgggggtgtggtcctgggacacgcagcccggcctccctgagatctgaaggactgagggcttcatgccccgctgctgtgagtgctgccagcaccatcccctgcctgccctctctctagacattgccctctgctgaagggacccaccctgaccatggtccctggagcagcctcagttgagtgatgtacttgtgataagagggccctgcccctctcaccccgattccgcacaaccttaaagggctgctcccactccagagatcttcctgtggggtggctgaggcttttcttttgaccacgtggaagcccagcctgtccctctgcccatctgccgctttccctccccacaggtgttggtcctgagagcattcccaaataaatttcctgaaccatcatcaccatagcaaagcagcttcctgggcaacctcacctacaacagccatttaagaataggaatttgaaagacattgagtgaaaacaatttataattcagaaaggaaagcttgccttataaataaaactattcattattacttagctaaaatagtcgtagttactttacaaatgtttacggctcccctggcttggagatcaatctaatcttttttttttttcttaatgttcagtctctttatgtctatggatatgtaaatatttaattaaaacatctttgtataaaataaatggtggtataaggaaatggaaaaaaacccttacctgcagagaaaatttgtgaaatatatttttcacacagaagggtaaatagaatatccatgttccattcaaataaaagtgaaacaaatgcccatctatcttccaaacagctgaagaaatagaatatcccccactatagatagaagctgtgttgtgcccagttaactgctatcctgaatggccagcttgctagaggatagatcagatagatagatagatagacagacagacagacagacagacagacagacagatagatagatagatatacatacatacatacatacacacatacatatatagatgatggattggtagatggttgatacatgttagatagatagatagatatatggatacatacatacatacatacatacatagacaaattgggtacatagatacatagatgattgacaggtagatagatacatacatacatacatagatggattggcagatggttgatacatgttagatacatacatacatacatacatacatacatagaagatggattggtagatggttgatatatattagatgatagatagatagatagatagatagatgatggaagatatatagatgggagataggtggatagatagatgataggtgatgggtaaatagataagtagatgatgcataaatgatctatgataagtagataatatagatgtcaatacataatcacatacacacgtagtgtaggttttagtgtttttttctttcgtatttaactggaattttataccatatttttttctgtgacttgctgttttactcaatgacagctgcgattcacctatgttgatgtgtgccctcatgtttccttcacctccactgctgtgtaggactccctgtgtgactgccctgtagcttatttaggcatggtatgcactgagatgtggtcagagtttggggccactgggtttcctgcaagctctgctcctgtgcacacgtggactcccaattgttacagtgtgactgtgggttactgctcaggtctggcacacagcactagtttctccgggtgtgtgtctaggagtagagtcactacgcatagaatataggcatgttcaagtttggtaagtcattccagaccttttccaagggattccactgatgtacgcccttccacacagcggatgagagctggtgttcctgcataccctcactaatgcttggatttaagatgggccaatttggtggaggtgaagtgcaatgtcaccatggtctccatctgccctgccccagtgccactgaggtgaagcatatgattatgggctattcatcttccctcctctgctaagtgacggctcaaggctcacacttgtttttttctattgggctgtttgccgttttattataatttgtagttctttatatcttctctgcatacattctttattagttttatgtaatacaaacatatctctttcagtttttgtcttttttccaccctttgttgtgttttttgatcaagatacataattaaattgattacttaagttaaaattaaactcttaaattttaatgtggtctaatttatcaagtgttttctttaatatttgtacatccttgtcttgtataatgaatgtctgtgttctaaatttgtaaagatattttcttacataaacttctaaacattttatgaatttgtcttttatagtcatttattctatctgaaattgatttttaagactggtgtaatatagaaattcacgttcattcttttccatttggataagcagcaacattaattttttaaagttttttgaattgataatacattcacacgcagcaaagtatcaaagcaatgtcaaatggcttacagtgaaaagtcttacttcccctccctcacaacccagttctccacctgtgcacctacagacaacgacttttagtcattattttataaatttccttggcatctctgtgtaagtgcaagaaaacatgaaattatatttccattttccttctttgctagactcctaagaaacttgttttttcacaattcgcagtagaccttggcaattgttcaaagtccctaccaagaccttccttgttctttttgagggatggcacagtattccattgtacagtaaagccatatctagagattttcttttcactcatgatgtaacagactggatctgcctccctccccaccttaagcaattggaatttctgaagctaaactctagaacgcaggaagctgtggagacagaagtgataacaaactccagagatgtgtggagcattctccttgagtctctgagttggtcgtgatctgcactggagtaatgtggaatgaatgaagatatgtctcttcaagccttttgcccatttttaattgggtgtttgtgttttgttattgagtcatagagttatttgtatggcctggctagcagacccttatcaaatatatgatttgcaaaatagttctcccattctataggttgtcttttcactttatttataatgtattttaaagcacaaagcttttggttttgatggagcccaatttttctatttttttcttttgctacttgtgcttttggcttcctgtgtaaaaaccccttgcaaaatccaagatcatgaagatttacttctgtgttttcttctaagagttttatagttttagctctcacatttaggttgttggttcattatgagttaattattgtaaatgatgtgatgtaagcatccagcttcattcttttgcatattggtagccagctgttccagcatcatttgttgaagaaactgtgtttcccatttgaattttattggtgtccttgttgaaaatcaattggccttagatgtatgggtttatttttgggctcttagttctattccatgggtctatatatttatcctcataccaatactatgctatttcaatcactgtagatttgtagtaagtttagaattaggaagtgtatgtcttctctttcagaatttgtgtgtgtgtctctgtgtgtgtggctattctgggtactttgcaattccctataaatttgagaatcagtatttccatttctccaaagaaggccattagaattttgataaggattgcatcaaatcagtaagttgttttgagagtattgccatcttaacaatgttaagttttctaatccatgaacatgggatatctttccatttacttatgtcttctttaatttctttaagcaatattttgtagtcaaacaatgtcagtgtacaagtctttcactctcttgattgaatttcttcctagatattatattctttaggatgccattgtaaattgaatggttttctgaattttctttacatataattcatgtccagtgcactgatttttgtatgttaatgtggtatcctgcaattttgctaaatttgttaattatctctcatagttttttgtaaattgtaaaggatatacatatatatatgattatgtcatctgttaatagggtaatttcactttttcctccattttggatgtctctaatctctttttcttgtctaattactcttagaactttgtattactttattttcacactactctaaagatactacttgagactggctaatttataaacaaaagaagcataactgactcacagttccatgtagctgaggagggctcaggaaacttacaatcatggaagaaggtgaagggggagcaggcatcttcttcataaggcagcaggagagagagagcaaagggggaactgtcaaacacttttaaaaccatcagctcttataagagctccctatcatgagaacagcatgggggaaaccacctccatgaccaatcacctcctaccctctgaccaggacccccctttgatacatggggattccacacctggctaattttttgtagttttagtagagacggggtttcaccatgttagccaggatggtctcaatctcctgacctcataatccgcccgtcttggcctcccaaaatgctgggattacaggcgtgaaccaccatgcctggctgtgttaattcttctttaagtgatgagtagaattcaccagtgaagccatgtgaatctggacttttttgttgggaggctttagtttactgatgtaatctttacatatcataggtcatttcaggttttctatttcttcgtcttgatctaattttttttagcatgcaattgttcataatattctcctataatcattttaatttctgtaaagtcagtagtaatgttcccacttttatttttgattcagaaatttgagtcttctgtctgttttcttagtcaacctggctaaagatttcgcaattttgttgatcttttcaaagaaacaacttttggtttcattaattttccctattgtttttcaattctctattttatttcacttcactctattatcttttccttctgctgtcttttggtttggtttactcttatttatttagtctcctatggtgttaagttgttttgaaatctttattctttttaatataggcatgcacaactacaaatttattcataagcactgcttttgcagcagtctataacttctggtttgttatatttttgttttaatttgcctttaagtattttcttaatttcctttgggatttcttctttgaccccttagttatttaacagtgtgttgtttaatttctatacatttgtaaatttaaaaattttttttcttcttttgagttctagttgatatggcttggacctgtgcccccaccaaatctcatgtcaaattttagtccccagtgttggaggtggggcctggtgtggggtggttggatcatgggggagaatttctcatgaatggtttagtaccattctcttagtgctgttcttatgacaacgagtaaattcttatgagatctggctgtttaaaagtgtgcagaacctttgtctctcactctttcttgctcctgctcccactgtgtgagatgccttgctccctccttgccttctgccatgattgttaagtttcctgaggcctccccagaagccaagcagatgccagcatcgtgcttcttgtacagcctgcagaaccataagtcaattaaacctcttttctttacaaattatgcagtctgaggtatttctttataacaatgcatgaacagactagttcactggtcttatttcattgtggtcagagaagatactttgcattatttcaatgtcttaaaatttattgagatttgttttgtgggttaacatatgatctattccagagaaggtcccatgcgcatttgagaagaatgtgtatttggggtagcatgtgtattattgggtagaatttactgatacttttgttagtttatagtatcgttcaagttatctgttttctttttgatcctctatttgttctatctattactgaaggtgggatattgaaggctctaactattcctttctacaattctgtcaatgtttgtttcacatatttgggggctttcttattatataattgctgtatacctttgcttgacttatcttttttggttacttttgcatacaatttattttcttcactcattcactttcaacctatatgtgtctttgaattttaagtgagtcacttatagacaacatatagttggattttgtggatttttttctttctcccaatctctgcctattctaaggacagaagtatcttcttttcttatcagtaaatactttaagtgtgaatatactaaacagaagaggatcaactgaagagtttagtatattcacacttaaagtatttactgataagaaaagaagctacttctgtcacgttgatttttgttttctatatgtcttatatcttttttgttcctcaattcataggtagacatatagatcaatgcaatagaattgagagttcagaaataaaccgataaatctatagtcaaaaaatttttgacaactgtcacaagaccattcaatgagggcaagaagagtctttccaaaaaatgatatagaacaactggatagccaatacagaagaatggaattggacctgtacctcacaccatgtgcaaaaattgactcaaaatggattaacgacccaaatttaagagctaaaaccatagaaatactaaaagaaaacatagggataagtcttcattaccttagattttgcaaaggattcttatatatgacaccaaaaacaaatggaaagttatgagctcctgggagacagttacacttctgccttggatgaaggtgtaaagtaggtaaaatgctgtaataggagtggagatgctctgccaggcctcccttcaggaaaggatttgcttcccagtgtggggaatgagggcacacactctccagctgccaactccttcaaggtctgcctccctgggtgtcccgccatcctgaggcagcctggttttggagaacccaacctgtcacaaatatccacataggtcattttagatgggaatagggaaaatttggaagaactgattaaaattgcataaatgagtaaattccttgaaaaaggaatgtaacagattattagcaggggattgagacgttgacagctggttttgattctattcattcagtgctcagactttgagcttctacttcatgctaggtggtaaggtgtgtaagtagacacaataaaaaatgataaaggggatatcaccactgatcccacagaaatacaaactaccatcagagaagattataaacacctctgtgcaaataaactagaaaatctacaagaaattgataaattcctggacacatacaccctccgaagactaagccaggaagaagtcgaatccgtgaatagaccaataacaagttctgaaattaaggcagtaattaatagcctactaaacaaaaaaaaagcccaggaccagacaaattcacaaccaaattctaccagaggtacaaagaagagctggtaccattccttctgaaactattccaagcaatagaaaaagagggactcatccctaactcattttatgaggccagcatcaacctgataccaaaacctggcagaaacacagcaaaaaaagaaaatttcaggccaatatccctgatgaacatcagtgtgaaaatcctcaataaaatactggcaaactgaatccagcagcacatcaaaaagcttatccactacgatcaagttggcttcatccctgagatgcaaggctggttcaacatttacaaatcactaaatgtaatctatcacataaacagaaccaatgaccaaaagcacatgattatctcaatagatgtagaaaaggccttcgataaaattcaacacctcctcgtgctaaaaactcgctataaactagatactgatggaacatatctcaagataataagagctatttatgacaaacccacagccattatcatactgaatgggcaaaagctggaagcattccttttgaaaactggcacaagacaaggatgccctctcttaccactcctatttaacatagaagttgaagttctggccaggacaatcaggcaagagaaagaaataaagggtattcagataggaagagaggaagtcaaattgtctctgtttgcagatgacatgattgtatatttagaaaaccccatcatctcagcccaaaaactccttaagctgataagcaacttcagcaaaggttcaggatacaaaatcaaggtgcaaaaattacaagcatttctatacaccaataatagacaaacagagagccaaatcatgagtgaactcccattcaaaattgctacaaagagaataaagtacctaggaatacaacttacaagggacatgaaggatctcttcaaggagaactacaaaccactgctcaaggaaataagagaggatgcaaacaaatggaaaaaaatttcatgctcatggataggaagaatcaatatcgtgaaaatggccatactactcaaagtaatttatagattcaatgctattcccatcaagctactactgactttcttcacagaactacaaaaaactactttaaatttcatatggaaccaaaagagagcccatatagccaagagaatcctaagcaaaaagaacaaagctggaggcatcaccctacctgacttcaaactatactacaaggctacagtaaccaaaaccacatggtactggtgccaaaacagatatgtagaccaatggaacagaacagaggcctcagaaataacaccacacatttataaaccatctgatcttcaacaaacctgacaaaaaccagcaatggggaaagaattccctatttaacaaatgatgctgggaaaactggctagccatatgcagaaaacagaaactggaccctttccttataccttatagaaaaattaactcaagatggattaaagactttaatgtaaaacctaaaaccataaaaaaccctagaagaaaacctaggcaataccattcaggacacaggcatgggcaaagacttcatgactaaaacgccaaaaacatttgcaacgaaagccaaaattgacaaatgggatctaattaaactaaagagctcctgcacagcaagagaaactatcatcagagtgaacaggaaatctacagaatgggagaaaatttttgcaatctatccatttgacaaaggtctaatatccagaatttacaaggaacttaaacaaatttacaagaaaaaacaacccctcaaaaagtgggtgaggatatgaacagagacttctcaaaagaagacatttatgaggccaaaaaacacatgaataaaagcccctcgtcaccggtcatcagaggaatgaaaattaaaaccacaatgagataccatctcatgccagttagaatggcaatcattaaaaagtcaggaaacaacagatactggagatgatgtggagaaataggaacacttttacactgttggtgggagtgtaaattagttcaaccattgtggaagacagtgtggcaattcttcaaagacctagaaccagaaataccatttaacccagcaatcccattaatgggtatatacccaaaggactataaatcattctactataaagacacatgcacacgtatgtttattgcagcactatttacaattgcaaagacttggaatcaactcaaatgcccatcagtgatagattggataaagaaaatatggcacatacacaccatggaatactatgcagccataaaaaagattgagtttatgtcctttgcagggacatggatgatgctggaaaccatcattctcagcaaactaacacaggaacagaaaaccaaacaccacatgttctcactcataagtgggagttgaacaatgagaacacatggacacagggaggggaacataacacacgggggcctgtagggggttgagggcaaggggaggagagcattaggacaaacatctaatgccatgtggggtttaaaacctagatgatgggttgatgggtgcaacaaaccaccatggcacatgtatacctgtgtaacaaacctgcacattctgcacatgtaccccagaacccaaagtaaaaaacaaaaaaataaaaaaggaaacttttaactcacttctgtctgcaggtcacattcaatgcttctggcaacatcctggggcaagcggacatgtgatgctgaggtgtattttggcagtgattaactttggacagcaatgagcatggcttgagtttattcaacaccccaaaagtaaaacaattaaaaccccaagaaacactgaaatgacagccgtgaaataataattactcaaaatgctcagaaacgttactgccgcaatatatttgaagcactgaattgctgtacttcacatcccggtagaagaagagctgcacccaatctgagcttaagattgcatctctgtaaggaacagtaccctaaatatagaatgcaaaatgctttaagtctattagtgccacctgaaacacttttgtacataagttgaatagatcactgtcattataatctggcctaaaaccctctttttaaacaaaatgaagctattcaataaagcatacccaattaggttttacttgccagccccaccctgctcctaagctgtgtcttcataagcttgtgccacatgcaaaagttagcctaaagctttggggcagagtcactgaatcatgaatcttcactgttagaacatgttttgtatgtttagaaaacaccaaaatattgaattaagtaaagttactagggtgactgtagcttggttagcgccagataaactgtcatagacagagggataccaagatacggaagaggacatcaaaagctcctgctcaaactgctagtcgtgatgtgtgcagacacctgtgcacacaggcaaaacccatgtgggagaggtggtaacatgcccagctgtgggctttccaataagtcgcaggattctgtcccctcatctgtgggtgggactacagtgtcactggtctgtggcatctagcttttcagttttcatgtattatatcttctttttacagattactttttaaattttcccttcagtttttgtattatttgtattctctttttacaatttatttttttttgccagaaatctcattctctttccacgtaatctagaactaactcttaaaggaaagagatatctgaagaagtcctgcaaacttctacaaaatgagaaggcagagagctcgcctttatgcacactgatcccacaccaggcactcgcctgtgtcattttattctatcctcaaaatcatcctttttcccacttggatatttctctcatttttccagatgagaatatcaagacatgacaaatgctgcccaaagtcatcttttcagtaagattaataatgaacactgtttgcagccaagcccaccattccccccaccccccaatagcccagcttctctccaaagttaaactaaacatggttctttttttttttttttttgagatggagtcttgctctgtcacccaggctggagtgcagtggcgcgatctcggctcactgcaagctccacctcccgggttcaggccattctcctgcctcagcctcccgagtacctgggactacaggcgcccgccaccacgcccggctaattttttttttttttttttttagtagagacggggtttcaccgtgttagccaggatcgtctccatctcctgatctcgtgatccgcccacctcagcctcccaaagtgctgggattacaggcgtgagccactgtgcccagccataaacatggttcttaatgatgacaacggatagagcatccacagcctaaccacaggaagttctttcttgtagctaactaaattccccagaaagttattccttttttttttttttcttttttgagaaggtggcccaggctggagtgcagtggcctgatctcagctcactgcaacttctgcctcctgggttccagggattctcttgcctcagcctcccgagcagctgggattataggcacacaccacaacgctcagctattttttttgtattttcagtagagacagggttttaccatgttgtccaggctggtctcaaactcctcatctcaagtgatccaactgcctcagcctcccaagttattccctttttatcatattctgtcttcaaagagattgaggctggcaggttatcatctctggcactaaatattttacttacttatctttcattttgtggcctccacataaagttcccagttcctgtcatctttgttagaatgactacttcttggccttaaatcttcttcgtttttctccactgcacctcttttaagccagtgcctctttgtaaagagcagagcagcccagtgacatgcaggggccatactttgaccagatgggtttgggtttcaccctgaaatttgccatttccaggcagtatgaaattgagcaagcgactttctctctcctagcctcagtctcctcacttctaaaataaaaatatgaatgcctaacctcatggggtggttgtaaggattaaaaataatacttggatagtccctggcacacagtatttgtgctacaaaattaaaaatgtctggcataactgtttgtactaaaagtaacctgggccaggcgtggtggctcacccctgtaatcccagcactttgggaggcggaggtgggcggatcacctggggtcaggagtttgagaccagcctggccaacatggcgaaatcccgtctctactaaaagtacaaaaattagctgggcatggtggcaggtgcctgtaatcccagctactcaggaggctgaggcaggagaatcgcttgaacctgggaggcagagtttgcagtgagctgagactgtgccactgcactccagcctgggcgagactcagtctcaaaaacaaacaaacaaaaaaacagtaggatgtgtatacaatgaagtgcaaagatttccaacttgtgtcctgagatagtttgcatgattggcaagaaagaccctggtcagccaccttccagatggtcactgtaaatggcagctacccggacatactgagaactgagaaccctcctctggtggccggcctttgtatggtccatcagcatatcacacactctataccaatttgatttctgggtttacaggagatgttgggactatggcgcaaggcttttctaccacaactctacatggcatgctcaggcccgttttaatatatgcagtggcaactgagtatctgccttaaagctgtgcaggtgtttctatgtacagccctagcagggaattatggctgtaagaatacctgggttcctacagtagcccagaatttcagtgcctcttacaaagccattctggtgacttatgcaggatccaaagggtgatatgggattttgcacatagaagggaactggctgagaaggagaggagtgggagggagattttctgttgttacatccttctgtaactttttaaattatatgaatatattcaaaaatgaatggctaaaatttgaaaataggcacttcacatatggagctctggagaacttggtttggtgtcaaagagctatagggagcaccaaagtttgtgagatttgtccattgcagagctgacctccaggtaactgtccagattcaagatgttcaaagggttctgatgcatttttcagagccaggttaatatgtgacagacaagtggaaagctcttgacacatgttttgtgttaaaaaaaaaaatccagaagattacagagcatctgtaacttctcattccagcgctgaggagtggggtgttcaaagacatttttggacactaagaagctcataggaagaggcctgtagagagctttctagaaaagcattagaaagagcactaaaaagctgatcaccagaactggcacagaatggcaaagtttctccatgctgtctctaaaagtggatcccttcaaaaaaaattttagagaagcaaagagaaaaaccaatttgatgtatttccaaatttgtcatacaacacatccagtaaaaaaagaaatcaagcaagttataaaacaattaactaaaggcagaaaaagcctaagagtctgaaaggtactcctggaatcgtctgcagtactaactccactaacacactgccggaataaaagcattcaaagcctctggtaactgaccaaaaactaaggagatcacttccactctcttcccagccttcactgcgcactcctcccatttctctactttactttgaatttattaatgtgtattctgttgtaactaatcaccctttaagtctttgactctcaatcttcctgcacattgacagtttagaatctctggtcagatgcatttattatataatagtgtgtgccaagtactcataagcaggaaatattatgtcctaactcccactaatgctaagccattctggtgacttatgcaggatccgaagggcgatacagggttttgcacatagaagggacctggtgcttcattcttctctgctggctttttcttcttttttttcaatattaaatccttgttaaacatttgtttggccaaaggattaacaaaaacaaataattctgccgtgcatagagttgagcaaagttcttaatttccctgaattgccatctgagcttcagtctttaattagaagccctcaagttgctggtgaccttggggaacaggactggggagatatacaacgattggtgtataacttgaatttttacagggcaaagtggacatgcaatttctttgtgaattagcaacttaagagtgaacaatgaagtggctatattttctgaattcaaacctgtgacatagaatatgatattacaactgtacttatggggatattataagccagctgaattgaacatttttgtcagcttacaaaataagctgtttatagtgatgattcccatgaaggactcttaagtggttgaggaacaatgttagaagcagactgatttttgtagagcatataattttatatctgtcacattgtgtaacatgtcctaggaattatcttttaaagaataaatagaatgtttcttagaaaattataaaataactttgcttaactctatgcaaataaatttggaaaatgtaataaactggaatggatgattcttctggaacatatgaaatgccaaaactaactttagaaaaggagaacctttaaatagaccacaaaagaaatagaactaatccccaaagagcaccaggcccgtttacaatcgaatgcaaaggcctgtgcataccttgttaatttagagtaacaaaaagagatccataacatctccgggaggaaacagaagcacctgctaactcctttgagtggaggaagtgggtgcggacagagaggaggcagggttttcaaaaaggcccctataaaattgtattccatttagatgtgtaacttggtcaggattccttttactcttaccataaaagcaggaactgtgctaagcaaatcagatgcattgtttctttttatacccataagaaattttgaagataagcaccataatagggttgtaggaaaaaatggtggataggagacaggactaatgtgcagctcccacttagttgaacagaacagtgtttggagactcacattgtgaacttttgctccaagaaccaccacaggaacataccaggaaaaccaaaagaattcaaagagcctttgaaaaaagtggcttgccattgcaaacactgtgagacagtcgaaaaactgtgagttccctaagagtgagagggggaaaagttggcctctgaacttacttccccaatggagaacctgaaattccagatcatggggaaagatttaaccttacttagagctgaaattgatttagggagcccagcaaaatatagcagtagaagaagcggtgggaagatcagcagtaggcactcctgatctccagcttgagccaagggaagcccttcctggccttacctctttgcagaccttccccagcaccagcctggagcccagtagcccccactagatggctagatccagaggacaataacagttgctgcagtctggctcttaggaagccctgtccctagaggaagggggagagcaccacatcaagggatcaccccatgggacaaaataatctgaaaagcagccgttgagtttcagatcattccactgaaagtctactcaattgaaacggaaccagaaaactaattatgataatatgacaaaacaaggttctgtaacacccccagaagatcacattagctctccagcaatgaacccaaaccaagaagaaatttccaaattgccaggaaaagaattcagaaggttgattattaagctactccaggaagcaccagggaaaggtgaaaagcaacttaaagaaaattaaaaagcaataccagatatggaagaaaaagtatccagagaaatagatatcataaggaaaagacaatcataacttctggacatgaaagacacacttagagaaatgcaaaatacactgaaaagattcaacaatagaatcaaaggagtagaagaaagaacttcaaagcttgcagacatggcttttgaactaacccaatctgacaaagaaaaagaaaaaaaatttaatgaaaaaagcctctaagaaatttgggattatgttaaatgaacaaacatttaactggtgttcctgaggaagaagagaaatctaaaagtttggaaaacttacttgaggtaataatcaaggaaaatttccctggtcttgctagaattctggacgtacaaatacaagcagctcaaagaacacccaggaaattcatcgcaaaaagatcatcacctagacacatagtaatcaggttatctaaagtcaagacaaaggaaagaatattaagagctgtgaggcaaaagcatcaggtaaactataaaggaaaacctatcagattaacagcagatttctcagcagaaactgtgcaagccagaagggattgggatcctatctttagcttccttaaacaaaataattatcagccaagaattttgtatccagtaaaactaagcttcataaatgaaggagaggttttcagacaaacaaatgctgagagaattcaccacaaacaagtcagcactacaagaaatgcttaaaaggaatcctaaatcttgaaacaaaactgcaaaatacaccaaaatagaaccttcttaaaacataaatctcacaggacctataatataataacacaatgaaaaagaagcaaggtactcaggcaacaactagcatgatgaatggaacagtacctcacatctcaatactagcattgaatgtaaatggtctaagagctccacttaaaagatacagaatggcagaatggataacaatccaccaaccaagtatctactgtcttcaagaggctcacctaacacatagggactcacataaacttaaggtaaaggagtgcaaaaagataatccatgcaaatggacaccaaaagcaagcaggagtagctcttcttacatcagacaaaaagcactttaaggcaacaacagttaaaaaaaaaagataaagagggatattatataatgataaaaagattagtccaataggaaaatatcacaatcttaaatatatatgcacctaacactggagctctactagacctaagaaatgagatagcaacacaataatagtgggggacttcaacactccactgacagctctagacaggtcatcaagacagaaagtcaacaaagaaacaatggacttaaactacaccctaaaacaaatggacttaacaaatatttacagaacattctacccaacaactgcagaacatacattctttttatcatcacttggaacattctccaagatagaccatatgataggccacaaaacaagcctcaactgggcatggtggctcatgcctgtagtcccagcactttgggaggctgaggcaggtggatcacgaggtcagcagatcgagaccatcctggctaacatggtgaaaccctgtctctactaaaaatacaaaaaattggctgggtgtgatggcaggcacctgtagttccagctacttgggaggctgaagcaggagaatggcgtgaacccgggaggtggagcttgcagtgagccgagatcgcaccattgccctccagcctgggctacagagcaagaccctgtctcaaaaaaaaaaaaaaaaaaaaaaaaaaaaacaagcctcaatcaatttaagaaaattgaaattaatcaagcactctctcagaccacagtggaataaaattggaaattaactccaaaaggaatctccaaaactatacaaataaattgaagttaaataacatgctcttgagtgatccttgagtcaacaatgaaatcaagatagaaatttaaaaattctttaaactgaatgataatagtgacacaactaatcaaaacctttgggatacagcaaaagcgagactaagaggaaagttgatggcactaaatgcccacatcaaaaagtctgaatccagagaacaaatagacaatctaagctcacacttcaaggaactagaggaacaagaacaaatcaaacccaaatctagcagaagaaaagaaataacaaagatcagggaagaactaaatgaaattgaaacataaaaaataaaagataaatgaaacaaaattttgttctttgaaaagataaaatcaatagatcattagtgagattaaccaagaaaagaagagacatgatccaaatatgctcaattagaaatgaaatcggagctattacattcaatactacagaaatacaaaagctccttcaaggctgccatgaacacctttatgtgcacaaactagaaaatctagaatagatggataaattcctggaaatatacaaccctgctagattaagccagaaagaaacaaaaactctgaacagaccaataagaagtggcaagattgaaacagtaatttttaaaaactgcaaacacaaaaagtccaggaccagatggattcatggctgaattctatcaggcattcaaagaagaattgggaccaatcctactgaaactattccaaaagatagagaaagatgaaatcctccctaaatcattctagaacttctttgaagttcttttttctacttgcttgaagttctagccagagcaataagacaagagaaagaaataaggggcatccaaattgataaataggaagtcaaactgttgctgtttgctgatcatatgatcatatacctagaaaaccctaaagactcatccaaataggtcctagatctgataaatgagttcagtaaagtttcaggatacaaaatcaatgtacacaaatcagtagcacttctatacaccaacagtgaccaagctgagaaccaaatcaaaaactcaacccctttatcaaaagctacaaacccccttttacaaaagctatggaactccttttacaaagctccaaaaaataaaatacttggggatatacctaaccaaagaggtaaaagatgtctacaagaaaaactacaaagcactgctgaaagaaatcatagacaacacaaacaaatggaaagacatcccttgctcatgggtgggtaggatcaatattgtgaaaatgatcataccaccaaaagcaatctataaattcaaggcaattcccattaaaatactatcatcattcttcacagaactagaaaaaacaatcctaaaattcatatacaacaaaaacagagcccacatagccaaagcaatacttagcaaaaagaacaaatcaggaggcatcacattacctgactttaaactatgctacaaggctatagttaccaaaacagcatggcactggtgtaaaaacaggcgtgtagaccaatggaacaaaatagagagcccagaaataaagccaaatacttacagacaattgatattcaacaaagcaaacaaaaacataaagtggggaaaggacaccctattcaacaaatggtgctggaataattggcaagctacatgtagaagaatgaaactggatcctcatctctcagtttatgcaaaaatcaactcaagatggatcaaagacttaaatccaagacctgaaactataaacattctagaacacaatatcagaagaacaaaactcttctagacattggcctaggcaaagagttcgtgaccaagaactcaaaaacaaatgcaacaaaaacaaagataaatagatgggacttaattaaactaaaaacttctgcacagcaaaataaataatcagcagagaaaacagacaatacacagagtgggagaaaatattcacaaatcatgcattcaacaaaggactaatattcagaatctacaaagaactcaaacaaatcaggaagaaaaaaacaaataatcccatcaaaaagtgggctaaggacatgaatggacaattctcaaaagaagatacacaaatggccaataggcatatgaaaaaaatgctcaacctcactaattatcagagaaatgcaaatcaaaaccacaatgcagtaccaccttactcctgcaagaatggccataattgaaaaatcaaaaaataatagatgtcagcatagatgtggtgaacagggaagacttctacactgctgatgggaatgtaaactagtacagccactatggaaaccagtgtggagattctttaaagaactaaaagtagaactactatttgatccagcaatcccagtactgaggaagagaagtcattataggaaaaagacacttgcacatgcatatttatagcagcaaaatttgcaattgcaaagatgtggaaccagcctaaatgcccatcaaccaacaagtcgataaagaaaacgtgatctatatatatatacacacacacaccccatatatatatacacacacaccttttatatatatacacacatataaatgcccatatatatatatatacacatacatataaatgcccatatatatatgtgtgtgtatatatatacatacacacaccatggtatatatatatatacacacacacacatatatatggtatgtgtatatatatatatggtatgtgtgtatatatatacatatacacacatggtgtgtgtatatatatgtatatatatatagtgtatatatatgtatatatatatacaccacagaatactatccagccttgaaaaggaacaaaataatggcattcgcagcaacctggatggacttggcgaccattattctaagtgaattaactcaggaatggaaaaccaaacattgtatgttctcacttaaaagtaggggctaaactatgaggatgcaaaggcataagaatgatataatggactctggggactttggagaaagggtgggaggcaggtgagtgataaaagactacaaatagggtgcagtatacactgcttgggtgatgagtgcaacaaaatctcagaaatcacacctaaagaaatccatgtaaccaaacaccacctgttccccaaaaactattgaaataataagataaaataaatctatgattaatcacaaatggatggacagagacagcagaaattaaattaccaaagaaaaactacacatttcaggggttttatgaacatgggaaactttaagacagacggctttctttgtggattgtttagtggatttatttcttctctaaaacattttaaagaattttaaaaattaaaaaattaaaaaagaactgtaatagtcccagctgcaatctacattttcatttctaatagactttcatcacagatatattaattgacaaatcttaaggtttctaatataaatttctaatgcatctttttatgtatgtataaatttatactgaaaaattatatgccaaaaatacactgagaattcagctgagaaattagagttccacagtctaggatgattgagattttcaccaaatatccaaggatctcaaagttctttaatttcatatcatttccctcctgctaagcataccaaaatactggtcagccaactttaaattattaactaattatttttttaagttggggtcttactctgttgcccaggctggagtgcaatgacgtgatcgtagctcactgctgcctcaaactcctggatttaagtggtcctttcatctcagccacccaagtagctgtgaccaccacacctggctaagttttttaaagttttttgatagagatgggatctggctatcttgcccaggctggtcttgaactcctggcttcaagctatcctcccacctcagcctcccaaagtgctgggattacaggcatgagtcatcacgcctggccccaaatgttttaaaaagtggaatgtaacagggtgaagctttgaagctttgaagtctgtcatgccacctgggactagatctacctcctgcacctgtaaaagatgaggctggggacaaatgtgtttatcctaatcaccctcatatcttatataagtgaatttgtggggctttgggtacctcaaagtgaagaatgcagctgacatccctgctctgaaagaacttacagtgcggtggggaggacagtcagtagtaaccagtcatcactagggcagtgctggtcacaaagtaagtgctatagagtggatggcagggagttcatgtagactcgcctgagatagggttctcaaattcattggaatcacctagggagctttaaaaatatccccgtggctgggccacaaccgcagactaattgaagcaggatgtctgggctgggagaggcaggcagcagactctttaaacacccacgtgattccaagacacagacatgtttgggaacagtggcgtggcaggtctgtggtggctggtgagggcggggtgggggaccaggaaatatgcatcccaatagctgatagaagccaagtttctaaaattcaagtaagctgttgtttcacacgacgcaatggccgagtgagggcaaagacaattttctgttgcctaaatatagaatggagcttgcaggggcaagacacgtaactctattgattttgcctggcctgaacacgtcaccagctgagagggctcatgaggcatggttttgtggtctgtgtagtcgggcgggtcttccacacacagacacggggtgcggcaagtgtcgccaagagtcctccttaggtttgcttggttcagggaatcccaggtgggacaagccaccccttctgaacgtatctccccatctcatcaaaccatggaatgcaaaatcacttttataagaaatgctcagtttgttaatagctttctaggagttttcttccccctctgacttttctcatggtttcgtaattcattcattgtgtcatgaggtgaattgcgtccctcaaaattcctgtgttgaagtcttaacgtcctgtacttcagaatgtgaatacctttcaagaggtaattaagttaaaatgaggtcattggggtggaccctgataccgtatgcctggtgtcctcatcagaagaggagatgaggacacagacacgcacagagggaagaccgggcaaggacacagggagaagatgctgtccacaagccaaggagagaggcctcaggagaaaccaaccctgcccacacctgggtctcagatatctatcttccagaatggtgagaaaataaattcccattgttcaagccactcagactatggtatttgttagagcagccccagcaaactaatctacatttcttttttaataatttcttttaacaagcatttacttagcacctacagaagtagcccaatttggactcatgaacacataatttcttactactttagaggacatgatttctggaacatgctttcctaaatagaagtcaaatgtttttgtttgcttcttcttttccagaacctgtgccatatgtattattgcatttttcaatttcaaatacctacttccatataaggtcaattcgaaatgaaaatatgagctttctgtagatcaccatccctacattgaactgttcagtacttagtttgggacatgtttatcccttgagcactgtgtgattgtttataaattatttcatacctgtccctcatttatgacttatctggcttgttttgtccatgaggtttctaactgggaaaaaagtatcgaataaagtcacctttagaagttttcactgtatgataatataccagaatataatgaaaattttctaatgaaaatgacatgttcgtattaacattaaaatattccccagtaaagttgagcatatactcacaagctaagaaagacaatcacaaaacaatcttttttataatctcattctggaaaataaatatttacctatacatggaaaaatgtccaaaagctatatgcttgtagtggggttttattggatacttttcactcacatccatcctcacttcacattcttaataaatgtcctgatttccaaaaagaaattgaggaaatagagaagagaaaacatcagtgtaagatttttaataattccctagaatgagtttctagattgaaggagacactaagtccaaaacaatcaatgaaaatagtttcatatcagcccaaatcactgacatttcaaaatggtgaggatgaagtaagatcctacaagctttctgaaagaaaagaaaacagcagcagcgacagcatccacaggtgacaaggaagggatgggaattagaatttagctttcttttttcccagcaacaacattgggaggtagattgcaaagaaataatactttcaaaattccaaaggaaaaccattttttaatctaaaattctattcctagccaaactatctattgaggaggaaggtagaagaaaaacattttttcagacactttcttaaggtaatggaaacgtgctccaccaaataaggtaaataaatgaacaaaaataaatacatgggactcagggaacaggataaccaagagtatagtcaaagaaatttcaagaaggaaggttaatggggacccaaaaatgactgctgaccagcaagaatgaagggcaagcaagacccatggcaggagttctaatatttgaggttgtggaatgtgcaaggctctgtatcaatagccaccctggagctgaacaatcagacatggcagaagtcaaaagcaccttctgttttattggtgaggttcacaatgacgatggcaaatgactgaaaccaaagggaaacacaaaaaatatgttcgtaatctgagccgctacacagacatgagatgcctcatgtgggcgagatctccctgatccctgtagaaagcagtgaagttgaaaaagcaaagctatcaggatacagccacattgtttacatatagatggaatatcccggaaagaccacccaagactctgccttgtggacagaggaacagcgtggctggggaagttgtgccctggatgcacactctttgcatatttgttcctttgggctttttattggataatgtatcatagcatcaataaagggaataaaattaaattcggctgggcatgggggctcacgcttgtaatcccagcactttgggaggccgaggcgggcagatcacgacgtcaggagatcgagaccatcctggctaacatggtgaaaccccatctctactaaaaatgcaaaaaaaaaactagctgggctggtggcgggagcctgtggtctcagctactcgggaggctgaggcaggagaatggtataaacccgggaggcggagcttgcagtcagccaagattgcgccactgcactccagcctgggtgacagagcaagactccatctcaaaaaaaaaaaaaaacaacaatcaaattcattctctaaaataataaggacaaggataagaacagagagaggctttgaatactcagaaaagatcaagtagtcagcactttcctctgtagaggctgacctagccatgagtcctgcagagctatagtgatcagagagcagtaggctgagtctcagggctccagagtcctgggagtgggcgtgtgggagcagaaggatgagctgcaggaaggaattctcttaaaaagtaatagaaagcttaaatataaaaccaggagcgcaacgtgtaccgaaagtagagcaaatgacaaagagatgaaaagaaagagagagaaaaatgttttaaaaattgcatgtccaacacttaaactgggattcatgcatggctggctgctctgcgattgaagggtaaggtgggggtggctgccaagctgagagctgaacatccaagccttactctggaagttgaaagcctttggatagactccagagttccgaaatagctacatcaggcagatcccgccagggcaacagttgtctaggtggggagatggatccccggtgcttccccctctgccatcttcccagagccctcttcatgactctcttttttctcatttctcctaccttgtttttattcatcaagatcatgctttgattctgcaaaaatgtctttagcatcttgttctggtttcttaaatccaatatcttatctgcttttaggaaaactccgatggcaattttctggttgtactgatgcagagcaggtgagccccacagtgggctcagcctgcgagggttcttggccttgtccaggaaggaattcgagggcaagccagaggcagaagaaaagagctttattgaggcagcagtgtgcgtcatgctctgtgactgctcctgcagggcagggctaccccataggcaccgaggagcagctcagggcagttttgcagtcccatttatacccatttttaataacatgagagttaaggggcagtgtatgcagaacttccaagggaacatgcgggttaaagggcggtttatgcagaacgtcctaggaacatgcgagttaaggggcggtttatgcagaacatcctagggaagggtagtaactttcgggtcatcgggtcttctcatggaaagggtcagtaactcgcgggtattgccatggcgatggtaaactgacttggcatgctggtgggcctgtcttatggaaagctgtttctaccccatccctgttttagcaagtcctcatttggttccgtgtccgagccctggctccagagtcaagccctgcctgctgcctcagtacctcttgaactggttagctggtcaggtttcccacagaaaaatcaaacctggtctaggacagaacttttcatgtgatataatttacaacctccctcttggaagaaatgtgaattcctgatcaaatgtttaagcagttaggcggtaaagtttaatggaattgagatctcttccaggacactggcttctcacccctcagtctgtcagccgggttgatgatttctaacaagacattctttatcttatagtcaggctgagagatctcacttagcctttttcattaaaatgttcctagcaagggttagtatttcaggaggcttgtctcaggtttctttccttagagcaagtttgaaatgagtttgtcacatgctcatcgctaaatgacgtgaatattttaaatcatgcagtcagtgaggtcccttgctttgggtatagcacaactatgcctagagccctgttccagggactctgttcagagacaaagcctccggagttcagccccactaggggggaggcaggcacgtggaggtggcgggggtaccgagggatttatctgctctcagattgcttccacaaacctccttatatcagccaccctcccttcatccttccccccaggaaactctagtgctgctagctttccccacttctcaggtagccactgccataccaggtgtacttgtctcaggaccacgaagcctgtcccgtctccgctgacctcccagctcccacagcttggcttctctgaccctttctccttcccattttgaccgtctccatgtgcccatgtgcttctgccctttttccacgagttagtaagtaaggtgtggagagcagcattcatgccagctgcccctgaaacttctctttcttgtttatagttttgtctcctccaaccgcccccagccagtattccaaagcctgatatactttggggaaatatcctcaatttaaaaattaaaaaatcttttgtaaaccatagggctcttattctcctttcatcgtgtttcagtgttttcttctttacctgaaggtcatttcatctttactttgtttgaaatggcgcatttaataagctctcctgggttatccttcgcttcctggactcaaatgccccaactcaggactttccaatctcttcacaaggatcagccccttggaaaccaaagcagaaatgtacatttccatgccctttgctatgggtgttgctttctttttacctgactattagcataaacacgcattaatactttttcacttaaatgttaccaaagaaaggtccattgaaaaatgggtacacatcccgacgctttaggaggctcaggcagattacttgagcccaggagtttgaggccaacctgggtaacgtgataaaatcctgtctctacaaaaaatacaaaaacattatccaggcgtggtggcacatgcccgtagtcccagctacttagggggctgagacaggagcatcgcttgaacctgggaagttgaggctgcagtgagccatgatcatgccactgcactccagcctgggtgacagagtgagatcctgtcttagaaaaaaaaaaggtactcgagtcttagaccaaagattttgtagctctcaggcaaatatttctttcaggaacgtttcttggtctccacgaaaagcagcttaagtgcttcacactcccagagagagggaaagagacatggtagtggggcggctaccccattaaagaatgtcagatcatctactccaagccttcaagttagagacaagcaaaaggagacccagcaagttatagtcgcacagggagttacagccatacaggccatttcagttgcacagatagtttcagtcacacaggcaattacagcttcaaagatcatttcagccacacaggtcatttcatttgcacagcacgcttcagtcacagagctagtttcagtcacacagggtgtttcagccacacaggtagttacaatctcacaggacatttcaaccacacaggtagttacagtctcacaggttgttcagtcacacaggtagttacagtctcacagggttgtttagtcacacaggtagttacaatctcacagggcatttcagccacacaggtagctacagtcttgcaggatgtttccgccacatgggtagttacagcctcacagggtacttcagctgcatgggtagttacagtttcacagagtgtctcacccacacaggtagttgctgtctcacagggtgttttggtctcacagggttcagtcacataggtagttacagtctcacagagtgtttcagacacacaggtagcatcagtcttacaggtagttacagtctcacagagtgtttcagtcacgcagctggttccagttgctgaggtggaaccaccagccgtcagtgtctgccctccctcagaatgaagccatggtggccatggttgaccagaacgcgtggccttgtctgtacaagctccatttcttcatgtgtccccatcacattacacttagtgtcagtgtttcaggcaccttcatgcttttccaaaagtgtttcataccatttctcaaatgttttcagtttggccatatcccaaatgtatttttgccaaatttcttcctcttcaatctgtctacatttcaaagaaaatttgagccatctgtttctgtttcattggcttcattgttcaaaattctctgtggtagaaactaagtgcaagaagtctttcaaatctctacttaagccttccacacctttctctgaagcacttcataaccaaagggtctgtggaattaagttcttattagaacatctcattttaactcaatgccttccctgtttctactgggatcgcacacctgctcaccagtgaaatgttaactgggagatgagtctgggggagccagggcccttatagcatgagtggatcactcacccagattaccctcctctccctccatgcctaacctgctctctgtgtgcttagggcatgtactccaggagaacacagacagcatctcttctctatatacttctctgcgttggaataaatgcaataaaataggtgccatttatgttgttatactaaaaattaaaagcagaagaatacaatgaaactgcaattctcattttaagcaaaataagcatacatctaaaatgagaagtagtttgtttcatactaaatcacatttattaagaatagaaggaacttggaatcaaattgcgtgtatatttttgtgtcctgaaatcttttcattcaatattgtaccttgggcacttttattaaacctattctttgaaaacatggttttatggctatattgcatttaattttacaattatcttttaaactctttccaattttttatatttataaatcatgctctgtctcagaggacttgagtaatttatttaacagctcccttagaagttgggcattttggttcttacacattttccctactacaaataacaattgattcttaatggcattaattttaaaacacattaattttactcagtgagagggtataaaataactaagaatccatttcctgagcctctctaacatactagaggaaaaattaagagagaaataataatttccatttaaaaagacaactggaaattttcaaccaaaagattaatcacagtgattagccaaagaattaaatcatgtgaagaaaaaaatttaaaaaatcttcattgaataatgcatttcaaggtggagctagaaacagatgctgggaatcatagacgcatgatccagaagggcttgtgagcatgagagcactggacaaataacgtccaggaaagtcacagaggaaaagtaacaactcataaaccagtacagcggaactgaattcaaaaagcaaataataataataaatcacaattgtttataaaatgtgtatttgatgagaaagataaaaataatggtgaaaaatgacaaagtaatgagagaccatagaacaggacttaacaagagggagaatgtgaactaccatgtgtggataattctggatgtacaattcagattccgatgacatgtatcctgaaacctagaggttgacaagattgccaaacattttaagcattaaggtaaaagttcacatgtaagagaaaagcagggcaattattcttctgaaagcagactgacaacaaacacagagtaatgctatgaattccagagaagcaagtctgcaggcacaccccagctagcacggggagaagaaggaggaagaatggatgctacttagacgatcctagttttttttgcttgtttgtttgtttgttgttttaaaagagcagaccttggctttgaattctttgcttactggcatatgacataacttttctgaatctctgtgtttaagtttgtaatgtggaattagcaaaatccaccccacttgccacacagagtttccgttaggatgacgttcctttgtaagttgtgaagagtcatataaatgtgagttgattttgcgtcactcatctgaagacgagagggctctctggaggctttcgacactgagaggccttagatgagtcccaggggccaggacgagcctgcctagcctctgcactttgttgacccagatgcgaaagtcaacatcccttcgaattcccctagatagcccattcttataagatcgtcaggaaccagtgtgagctttattgaagattcttgatgtgaagatggaagtgaggcacacacttcacattaaacagtcaaacccacatgtggcatttctgtccccgagggctgccttgctgttcaaaactggcccttctcttctccatcctaggtgccggtcctcctctctccttttccatcttctcctcctcctctctgtgtccatagaacattccgcctttcccagttactacttccaggattacaaacagaattgcttcaggatgctcaggaacatcgtacccttcccattaatgggatgcactctgttttgaaagcagttggaataatggagcaaaaacaaacagctaatgaaaaataaatttaaataaaaccttttacacagaaaacaaaacactagaagaaattttactactttactggaatattacgcaaataatctgtttattaaacaaactctcattggtgtccaaagaagaaacaaaacaaattaagtatcacaagcaagagcataagagggaatgccaagtaagtgctcagagggggagagccttgactatttgaaacaaaagaccctgaatctgtgaccctcaaagaattcttctagaatgcataaccttgtcaggaagaaacatgcacataggtaaaaagtaaatgaacaatatgtgtatgaaatagtgagatttctcaagacagaaatgtaagaggtagctaattattagccaaggaggggtttaatcactatgagccatgagttgagaataagaagagatcattgacggctgaaatcaaccgagaagcttcatgggaaagttagacttcaacggctcacgaaggagctgtggggagaaatcagggagcaggcatttcactagggggcatggtgtgggaggaactgtggaatgagtgtttggggtgctggcttcaccaggggagatggaagagctaggactgaacccctgcagtggagaatcgtgaatgtcagactggagcctatccagtaggaaatcaatgctcacgcaccgtggtatgatgcagtcgatggcgtgtggggaggccagtctgatgaaggaagcatgcacctgcaggaaggtagggagatgagaggaggccgtgttctgaagtactaattaaaggatatatttaaaatagatgtagtcctatcagtctccctcagttcactctgcttgtccttcccacagtgaattttaggaaaatgactcgataactgcaacggtgatgtcatgtgtgtgtctactttagagagcagatggtcgatctggtgctaatttgcccaatacggtagctacgcggcaatgaaattccaaaactggcacaaggcgggcctggttccaggtgagtggtggcctgagaaaacagaaaaaaagaaaatctgcaagctgcagcaattgattagatgtgaagatggggaggtaaaacaaggaaggggtcagagctaaccctggggtgaaagtgaaaagtgagggtgtcatgtctgaaagtggaggcataggagagggatggcctggggaagaaggtgggtacgtggtgtgctggctgggactccaaatacgtgcagcaaagattttgaaaagggacaaagaaaagtcaggcaacgccaggaaacgtgtcagagctgaatatcacagcatgtctcctaagcctctccctccccaaataaaccatgccaacccggatactcgcagctggcatgtccatttgtgtctggagcactcctgccagcctgtgaaagaagttccttggaaagtccaggcattaatgccacggtccatgtggctcctggcccggggactctgattctaggtcagggagttgcagagcctgcgctgtggtccctgctaccaggcctgctgtgggcctgcaaaggtgcaggtactttcccttcctgcccagtccagctccataggcagctcctcccaggggaggtacaaagggtcctgcaagctggacgaggcaaacaggggagggagagaaaggggagatccccagccaggtgagagagttaaagcccagagctccaagccttacatgtccaacctgatgggggcaagaggaggacaaacccttgcagagatcactcagtaaaagttgttactttttccttcccaaaatgaatccaaatgcccttccttgagctgcaggatttccacgaaacttgtggggctacaggccagtggaacacttccaaagggcttgacaccaggccaatggccttcttagaacactgtcatcattgattctgtatctacagaagtcatgtaactgtggctgcctcttttcaatggaaacagagcgaaatacaacctggtcagctaaatcgtgctgaccttaaaaacactgcatcctcttaggcaaccactttggcttataaaccacatgtacaatattcctgctacttcaaacatgacttttttaatgagccaaaaaaaaaaaaaatctaagtttgtaaataaaccgaattcattgccataatgtttctagtctgtaaagaaaatagctactcttcaatggagcatgtatggttgttttcatcactaaagcatgtcatttcattagaccactctgtaacacaccaccgctggatgtttcacacttgatattgattatttaactaatcatgtttactaaactggtctctacctttcccctcttcttctggttggatttcatgctgtctgggaggacacaaaacccccttgcacatttgtctttaatgaaggagaagttaaggaagatcattgtgtaagggtagagataaatgacgatggcaaaactcaaaaagaatagaacgaaagtcaccggcaagattacttgtcggtctgcacaagcctgaaaacaaacgattagcgattagcgttagaacaaaaacagcatcctgtgtaaatgacaaggccacgcaaacacactaagttggccctccagggatcccgatgggcagagcaacacttagataatcctgtcagagggagttgttggaattaaagaaccagcttctctttggttcaaggaacacttgctgttgaaggccaagctgggaaacggatgaataaaagagatgccgaccagcatataaacaaacaagactgaattatttttgtgagtcattgtgtgttcatgttttaatgatttgataaaagaatttcaaaactaattatgcctagctgttaagaagctaattttatattttaaacctctgccaatttaccggtaactaagaaggcaagcaccaagacacatacataatcatgtagttttatattatcgtggtatggtattaagttacatccagcatatattatggtacatatgaatttatgtataaatacattctcagagtcttctactacttattatttataaactgtaattgtgaattgatccttcttttgtttattaatattatcatcaattaaagcttattaagccaaatttttccaaataaagtcactgcctccttgtaaaagagcatattcgggaggtaaattaactgcttttgtcactaggtacaatatagcaagtgatggttgtgctgaactagagagtcaaactgggttaaaagaagtactctgatttttcagatagctgaaaaaccagaaaggtctatttattttatttgcttagagactctagattagcattatttaatagaaatagaacaaaagcaaaaatgctcatcatatgtgtaattttaaaatttccagcagccacatttttcaaaagaaaaaaacagaagttatttaaacaatacattttatttaacttaatatatccaaaatattaccatttaagcaggcaatgaattttaaaatattggcatgttttatattcaaaatctagtatgttttacacttacaccacatctcaatttagactaacaacacgtaaagtgctcaatagttaccataatgctatattgctaagtagctgccatatttgataaattaaccctagaacaactatctgcactcagaaacacatacaaatatatagcactagtacaactattgattcactttttaaaaattcattgtgagaaaacagagtagattttaaaagactgatatgattaaatatcctttagacttattatttaattactacttcagaacatgaccatatttggaaatacaacatagtattggagttctaatcatggaaataattcattggagataatatttgctgtcacgtgtcttttatacaaaaatagatggctatacagggaagcagctgatcagaaagatttgtatgcaatattcttttaaagcttcaatttgatttattttctagatagctacaacttagtggaaagtcatttctaaactgtaaatatcagtaagattcttccgatatgtgtcttaaaatacaggcttgagaaatgctagacaccataatactaacatggacaaaaactaaagactatgataaaaactgaattatacatgagaaaaacttgatcttcggaaaagagttgggcaagcttgccccttgcttgtgcttagccatattaaatagcatattggaaggatttgatttttaggcctccattaagcacagcagtgttctaacgaggaacacttcggcctctggatcagaaaagggcaagttttgctcccatctggcgtataatctcttcaccagaggggatggcttagtgggttttagactccttggaaccaaagattcagcctctgtgaggctgactcagcccttactcatccaacccatctgtttcccatagaaggtctttgagatgaagctctgaaaatgggtcctgaatccatcgcacgtgtgattaaaggtcgtaggctgtgtgtagtatgagcagagtggttgcgtctcttggggcacttgagtgcatttcaaattcttatcttttagggatcactggatctaaaagaaaaaatccaatgaatgatgcatcccactggcattccaaagagcaagtaaacaaaagaaattatgggtttgggctcagaaaccccaacccttgagatttcagaaaacaaaacgactcattggcaagaggcactgtaacgactcaggttcaaatcccacctctgttatttaccaattgcataactttcagcttcagtgtgacctgaccctgagctttccaatccaaaaatagaagtaatgtctatgtcatggagtagtcggaatgattaaatgagatgacatacacaacacatcgaacatactgcctggtacaaagtcatcatttattattaattaattcataggtccaataagctttaaaaagttgttttcatttttatactaaaaaaaaagtacacactaagctatttaccaaaagacaaagtcaaagcaacctgaaaaattcagtcagaacaattgattttgtcagcatctatacctaatttattgttcttgttagctaagtttgcccagtgtatagaggttccagggagcatgatgcagttcccatgtcctgtctgtggtatttcatacaatcgtatgttaatgtctcaaaggaagcctggggagaacatatgcagatatttcctgatacttcagttatttggaaagcaggcacttatttctagggaccatgacatgaaagcgagttggtatttcctaaggacaggggctatggggggcatcgaatttgcactccgctgagcctgccattcaaacaggacagcaacgagggcctctctttctcagccccgcaccttctgtgcaattcctccagcccaatgaccacggaagcacaagacagcagttgtcttttgtataaaaaaaaaaaaggtgacaggataggctgaagggggcaggttaaatgcagcagtgactaaagaactgcacctgccctccttccactttctttcttcgattgatttgaaaaatacagcagtggatttgtcttaagaaaggtgtgcagtttattgacacttacaattatgtattcccttggaggaagacatgaaaccagttttcaggcagggtttggttaggaagatacatgtcaccaacacacgggatcttctcgtgccaactgcttcgtatttgtaaaactaacaaattgagtcagtgtctactataatgagatgctgttcctgctctatgcggtatagggaagtaggcaaagcattcgtgcaagagtcttgctgcctgcattcgattcttggctgtgccaccaactaggtgtgtgactttggataaatcacctgacccttctaagcctcttagagctgtgagctgggtgtagcaacagaaccaactgttcttgggaaaacttagaaaaggtttattacaatgtcagacatataactaacaagcatctttttgtgagctattttctggcaattgaaggcttcaacttaatttttttctaaatgtctgaatgaatctgtagcttgccaaaatgatagcaatacctgtcatttttgagttcctattgcttgagttccttagaaagtttaggcaacccatctaaggtctcacgcctggttcatggtgcagccaggatttgcacacacacattgagcactctacgtctatttaatatggtaacaagcccacagatggaaacatgaccctatggtggtgctgggaagagacagcccagctgaggctggaggcagtccctcttcacaacactgactcttccaccaagaaagaccactggctatggcacagaggggcatgagctaaacaccagccttggccaccattttaccctgctcatgagggctaaaccttgctgtattttgattatcttttttttttagacagagtatcgctctgtcaccaggctggagtgcagtgatgtgatctcggctcactgcaacctccacatctcgggttcaagcgattctcctgcctcggtcttccgagtagctgggactacaggcgtgcaccaccaggtccagctaatgtttgtatttttagtagagacagggtttcaccatattggccaggatggtctcgatctcttgacctcatgatctgcccacctctgcctcccacagtgctaggattacaggcgtgagccaccgtgcccagccttgattatctttttgataaaatgatccagaaagttttctccctgaggactttttggtggagaagccttagtgcacacacagaaacacctcgactatctgtcaacttcacacagtgactgccggatggagtaataggtgctcctcttcctcaaaaagatgaattttattggcctagagacaaaaacaaagctattaacctgagaaaggtaaaaatcgtgggcaggtagaaaagtcttcacaaagtcagacttcttcatttctatctacttgtttaaaattgtgctaaaggctaaaacatattcctggaaaagaccaagcaaacatagctggagaccaggtaaacccagttctaaaattccaacctatttgcctattataaatggaagccttttcaggaggaccttaagaaaaggcaagctccagatatgttcagtgggtgcagacctagacagggctcctcaggcctgagcttcagaagctgtgagttgggttactaaaagcgcccttacaaggaaacccctagtccttcccaggtgagtatgccttccaaggcaccccaggggcagctccttaatgtccaggagtttcttccttgcccagctccagtgctcagcccagagccacactccccccagagccccctggccctgtgttggcttcctgttgcctctgcagaaaatcactacagaccatgcggcttcaggcatcatagatctactgcccaacagtcctggaggcaggatgtccaaaatgggtctgactggcttaagacccaggtgtaggcatagctggctcatgctggacactcctctggaggatcattgcccctgcctttcccggactccagggctgcccacactccttggacacactgtcctgtcacctgcttcagtcggctttctctgtcacgtctccttctctctctggccttcctgccttcctctcacaaggaccctgtaattacatgggccccacccagataatccaagatcaccccccacctcagtacatttaactaaatcacatctgcaaagtctcctttgcctcgtaaagggacatagccacagattccagggagtaggatgcgggcaccccgggggccattccacagcccaccacgtagcccaaagggatgcaccaagcaggaactaaagcagacgctgtccaggcggcttaaagcagggagggctttaaggagcggaccttcccactgctggggggctgcctttctacagcaccatgagcaccatgaggctgttggttttatccactgagaatgaaataaactactgagagaaagcttttatctcactaatagatctgaagtcatgccctttaaaaaatgagaataagagataaatgtataataataaactatgttgcaatttccaataattaaatgcattccttttttatattcatatattatggggttttccattagggcatgttgttgacgctgacattttcagaaccattaagtttgtttccacagctagttttcaagggccaataaggaaaaataatagaacctaattggaaaataaaacagaattgagcccagaacatctcagttaatgagcaatagagattatattgatttcattttataaataacattaaccctcaatagcaattaacacacaaagagattgattgtttaagttatctgataaaacaggttcatacattcagagtattaatctaaaaaaggatattagtatccaggaagtcattgatcggttcaccaggattaacgttgataaaaaccttaccagttctgcacattaaagcacacaaggaaaactgaaaccttcctgcaactagtgataagagaaaaacatattctggctaaaaatatactttttaaagctggttttcctgtcaaatcatcaatggaatgattttgtactagcttattcattctagaacacttatggttatgatcaaaaagagaagaaaagaaaagctgttaaggtcagcatttgcaaaacaagttcaagtaccagagcaagaccacaatcaacaaatctatgactaatggttggaaattttaaaaaccacttaccatcctaccagtgtgatggaaactattcagtggatcaatttgtaatctttattgttctagaaggcaccatcttttgctctctaaatccttccactttcttcagaggtctctttgacttaattgctagtttttgagtgttgactatttttaagggagacacaaaatatccaaccaactaaccatgaagcaacctcagttggttgttcctgttctgggatcctctggatggaacacattgaaggttcatattttctgcatatttcctactgcaaagcaacagattagaaatggatccaatataatttttaagatcatctacataatctgctacagattaaattaaatctcatgggtagtttaggaataccatcaatcaatgcacacaatgaaacctgaaaccttcctgcaattggtgataagaactagcgaaaagaacagcgtggacagaaagcaacaaaagagtccctagataagtgccaagaagacagactgcaagctgagaaagcgggtggcaccatctttttgttggcattagggacacaaagattctcaattcaccatttccggtctctaagagctcaaaggaggagataatcacatcaacaaataaatatatgcaatcaccacagcaaaaggaaaatttggtcaaaaattatttcgctctaaggagtcagtcaggtcagctgtagaaatgaagtggcatttgaactgagtattgaaagatgagagaaaaatggaaggaaattcccccaagaggcaaggagtgggccaagtaagacaggacagaaggacacggtctttggttggagtggctgagtggacacgaggggaaggctggagatgacagtcctatgctgacctgtggtgtgacgagatcactgcaccttgctaaagcacctggccacaattctctcagcaatgaatgttaaagcaggagagtttcataatcacatctatcaaggatatcatggggattctaagaagggggaaagactgtgatggaaagcaagttaggaatgcaagcgttcagacaagctaggctagggagaagacagtagaataagcaagatgccaaggcgctccactggcagactcaccgaagatgagtgagggcaggtagctgtccaagacagctctgagattctggttcagaatggcagtgccaatgaccgagcaggaaaggtggaaggaaaaaatacgttttaaggaaaagatgattctctcaggagcaaatggaagctatggtatgtgcaggcatgcagagaagagatttattaatagttggtagcaggaggtataaacctggctataccagccagaagaggagtggcaggcatgggagcaaatgaacacatgctaaagaaataactctgtgagaattcatgttgctttgcctgatattaggaaggaacatagtggagtgaaaaatacatcatcctggaactctcagaagttactagagggaaaaatttaacacaagtctctggaaataaaattatcaaaatgtattgagtcttctagatatttcacttctaagaatttatcctaaggaacaataaaaaatatgattaggactttactttggaaagagactgtcctgaacattttaataactaaatttaaaaaattatgcagatggtcaaaaaaaggaatggttaagtggttccatatagtaaaacattgtaccataactaaaaagtcatgttgtttaaggaatatttaataccatgaaaaaaatcctcatgatgataactatgagatatgatggagctgacctattataagatattatgcaagcttagaaaaattgtcagaaggtagtggcattacaggcaattttcattttcttctttttattttacatgttgtctatatcttcttcaaaaagtatattagttttatgaacaaaaacaatttttaataaatggagagagatataattatgtatctagttacgtcattggtggaagagaaggaaaaataaaataaacacacttgggaggaatgcaaagaatgaaggacagcagaacaaacataggaaaaaggcagcagaagaaaactgagcagctcactgaataggggtctaatttttcccctgaggttccttgagttttaaaaggtacagattttgttgcagaagaaagctaccagcttcaagactccaacatagcctgatgatgggaagaatacagtggtcctgtctacatagctgtggaaggtatttctcattaaataattagaagtttccattttggagtcaaacaaacaagaaacaaaagatgtgccatcatgcatctgtactgcaggaaagcagagacggttaacaccaccaccctcagatccctggcttactctgatggcttctcatagcagttaagcaacatcgattgcaagactggtgaatatttgctgactatatattgacaaatcatctcattcactatttgctaagtcaattggtaatatcccagtgcctaaacgtcataaaatgaaatgatctgtggaaatttagcattcgaatttggatcaagtttcccctccccaccttaaaaaagtctgattatttttattatcggtggcgccaggctacattagaaggaactgaagcaatacgacgaaggaagtgatttatttttgctgacagctttcttgtatttcatagtcacatgtccaaggattctttgatagtgtagcttttctttgatatttcatgtgcaattgctttcctcttgggttttattctcttcttgtaatccagctagtagcaaactacgtaatttacatttattgcaagcatttatagactagttaaaaaggcaacatatggacactaagaagttagaggactatgtaagataaaactaacaaaatgcttaaaaagtccttcttctgctgaaggcatgctcaataaatgtttgttgaagaaatgaatgaatgcagtagcaaaatatgtaatacagaatataagtattttgtgcaataaattacagagaggtagaaagagaggcaaagaagcaatgggagacaaattaatggccagaatttggaaagcaagaagtcactctaggtaccaggcagcattcagcagagctcagaggcaggggacctgttctttaagagctcatgagagaacttcttggggcagagttatatccttatgctgcagagcaggacaagggaacttgaaagagtaaactggttctgctctgaagatggtctagactggagagcagggactttggacttgaatagcaggcaccagggaagctgctggaagctcttgagcaagggagtatgatgttaaagacagtgttttgagaaggcacgttaaatgggagcccacagagatgggagaaaggggagaagtggagaagacttacctctcaagctggggttgagaggagagcacagcctaggatggtggacacatgaataaaggcactgaacagcaccaggaggtaggtcaaaggaggaaagagctgatttagtgacttatttggctacagggaataaaggaaagaatagagaaaatattttcaattttcaagtctggttgcctgggacaattatgattcattaaattcagtgaagaatttgaagaaaagttaatgcagcctaattatgaatttaagataccagcaaagtgaaggcaccatcattttacaaaataatttgatattttagaaaaaaagcacgcaaatttttgtgctgggaaacattagaacttaagactttcttacacttcctctgtggtttagtctttgtggtagtttgggaagatggagtcatataattcttttcacttttgagggatgctgtagatactagaactgggcttgggacataataaatttgaaatgagaacttggatatctcattagatccaacaggccattgataaaatggttccgtcattcaccagactcagggctgtgaatgtaagaaggaacttaccaattttattttgagaagagacagctccaccctgcaaaatattaacattttttatagttcactgtagtctttgactatctctatgaatgccttgtggtcgcaataattatgcatgcagttgtgtgttctgggtttttccaaagtagtctcagaagcagttctccataattctacaggattcacaaaaatcgttttaatagctgcatactattccatcaagtgatgtatcacaaatataattccccatttccctgagcttttgatttttcttcaccatagataaagttacataaacattttctccaccattgataatgttatgttaaacatttttttcctattgaattatctcataaaggatgaactctcaggaaaccaaatcaaattatgtaagcaatgtgcaattcttaccatgttgcttttatttttattttgttctgctcatgaaatagttactcgtattttatacaaattacaaaatttatagaactcccaagcagagaaaaagaaaattcctcatgatctgagctcccaaaagtaataactgtcaacaatttgtatttatcttcccaattactttcttctctatgcatgcactgacatattattattaatttatatgaaattttgatcatgctgtactcatatgtaaatccttcattctccttaacgaaggcataggctgtctttgtatagttaggccatgatttatttattcattcccctgataattatttgcagttctttgccactagaaacagtggtgcagcaaaagtgtgtgtatgcacatgtgtctatcacacttttgtgagtgtttaagtagaattcattcacatgcatacacactttcattgtaccattctacgtctaacaaaaaaatgttgcattcaagggtacaaataattgaacgtaatagttgttctgaaattgtgctcaaaagcatatagcataagagaaagaagccagtcacaaaaggccacatattgtataattccatgtatatgaaatgtccagaattgataacttcacagtgttgaaaagtagattaatggttgcctagggctgggggccagtgggaggagtgactgctaatgagtgctggtgtctttttggggtgatggctgcacaactctctacatatactaaaaaccatcaaaatgtaaaacaaaacaagcaaacaaactacattgctttgcaaaatcaatttctgaatcttcgctgaaccctcccatcaccttctctaaggggagtttgtcccttccacaggacagcactgccttcaaggccttaccaggggtggtctcccatgccctcatactgctggggctggaggagaatgtgtgccctctgctcctcattcccatttctcctccctcctccttcttttctataaacagaacaaaacaaaccaacaagcaatgatcaagttgagtctcacatcattagctgcacactcaggcctcatcactagttccctgaagatgggagccccaggtcactcttactttcttcagcaccactcctgtcctgattctctgtgatatcagcaaccgcatagatgttcctgatctctcagttccttggttttctctcgtaatgacattgccctctcccttaactcctaattatgccccatacatcaccatatcaattattgcataatctcaagttcaggcattcactctccagccaggactgtcttcctaattccctccagcaccaccattccaatcattttccagcctcacaggaacaaaagagatcctccctcctttctcaatgcctcctcacgctcaggcctccctcctgttctctcccagtgtgaattccctggttccagcattgtaagaattaggagccatcacattagacttcaatgtcttcccccttcttcctcctctcctggaaaaagcacaattctgtttaaacacagttcactacctgctttgtacttgtgctcatgcagttgaatgtgctgggaggtcacaagatgatactgacaggtctcactttgaattcatggccacaaacttccagtggtctttggtgctgctgggccatcactatgtttccctcatccatccactttcctttcttctagatgatgattccatactttctattcccatagaacctcccatagttcctctcccttcctggggcagagatgatgaccttgtttcttatttcaccaagaagacagaagagctcagaagagcagttgacacttgtccaccacacaatgtccacactgcccagcactgggcctgccatgctctctgccttccctgcaggctgcagaacagctgaaccacctgtgctccacttagcccattcctgcctttctcacctgcttgaggacactgtttcagcaaatcaccgttttctccctgcatcaatagtcccttacttccagtgcttcattgcctgggacatacaaatgtgcatttgtttcttctattaattttcattgttgtcccctcaattctctctctagctaccagctccttactcttctcctttggagcaaaatgtctccagaattttctatactcagtttcaaatctctctcttcccattatcctgaaattcacatcaatcaagcttttgcatcactaaagtggctttggtcaaggtccccccagagccacctaggggtcagacggcagccctcatgtcactcacctgttaggagtactgacgggcagctgccaactctgctttgtggaaatgattccttcacagggctcctggggcaccacaccctactggtgtcttccagcacctggctgtgctgtctcaggtgcttgctgaatctttatcttcccatttccctaaatattggacgtcccagggccagtctttggatgtccttccttctcagtccacacttactgccttgcgccctgccctggtcttgtggctttcaacacccgctgtgtgtgcatgtcttcctaaggtcctcctgggcttccacctgcaaggtggcttccccactgccctgggccctggcttccatcctgctctgtccacgcaccagggacccctccagcccagggtcagcacagcacatgggcccagtgagccacatggcccttcccctcactttcttcaaatttgtgctgaaatgcccccttctcaatgagtttttcctcgaatgccttattcagaattgcaaccccattccatccttggcatgtcctaatcgcccttcttgccttttatccatatcatgtacgacatagactcctgtgatttagtttgttatgagctgtttctcaccccactccactgtacctaagctaaatgagggaggaattcgtgcattcactggtttatctctagtgccttgaacagtttctcaacaatgaaacgctgaatgaataaaagaataaatgaatgccaacagcagtttatcaatgtgctccttctattataaggagtgttccaagtttaaaaaactgttcatttagtaagttttaaatgaaacttcaggtttcctaatttacagttctttaaaaactatcaattacttaataaaatttctattttcttaccgtgcctatttaaggcttagattttggaaagcagcaagactgttttccatttgtttgccatgatctcatgcagcaatctaaaatagcaaatgtgtagtgaagcgtctgatgatactgaagtaaaaaatgctgcaccctgagaacgtactgttattaatagcctggagccaggaaaagcttcctcaaatcttgaaattaaagtgtgttgtttatttctctaataagaacattacttttcttccttgaatttggtttgaaaagtaaaatgcagaaaaatagcactctttaaaagctgagggatcctatcatgaaaataagaagctgggaagattcgcattaccaccagccgtgggtggctgttaagaggcaaacacagctggtcctcactgacatccacggcaaaggtcaaatgtgccagattctgaagatttatcgtgaaaaaaaaagaatgtacaatcttttattaatgtgtttattttgattacatgttaaaatcatcaagttttagagaggctgcattaaagcaatataggcttgaaattaatttcaactgtttctttttcctttttaatgtggttattagaagatttaaaattgcatatgtggacagtgctgacaatttgaaacaaaggctaaagagacataacaacaaattgcaatgtgtgacacttgattggatcctggtttaagaaataaacaattattataaaaaacattattgaaacacttgcagaaatttgagtatgtactgcgtgctagatattatgaaattatttctatggaattattgttttcttagatataataatggtatcacagttatataggatgttgttcttttaaaacaaatgctagtataattaggggtgaaatatcacgatggctaaatttattttaaaacatgtggccatatatatttataatttaacactttataatcatatttgtatttaaatattttatgttattttaaaaatatattttatataataaatatattttgatcatgttatatttatatatttacacatttacatgtatttatacatatatatctgtgtgtatacatagagagctaaatatgaatctgaatgaaagttaacttggtattcattgtgccattcttttaacagccattctctttgttaggcatgtttcatgacaaaaacttgtggagaagttcacagccccccaaaaacaccttttgactaaaatcaaatgtcaaaatcataccacagtgacaatcagttggaagaaagcctgtataaagtagtcacagttcagagagtcagattataaatagctattttaagataatgtatatattttatgcaatcttatagactaatttatctatgaatatacaaaatccccttaagtcttgaagttgtttgttttgctttgaagaagcaatactttgaggtataccaaagacaacattttacctgctagaaattgccattcatccatttgagagtagatagatgagtattcactttctgaggatggtaaccttcagtccatgtctttggtgtaatagtatacatcttttgaaccataccaataggccctacccatggtaatcgctctcaatctgacagctccaatttttgcattcacatccacatccacttctacagaacttaatcaacagtaatagccttaaatactgcctgagggtttcttctattaggatgacatgcaaaacaaagcttatagcagtacagaagactaatgacactgtgcttgacaggtttaaggactgagtaatactggttgtgaaacagaagtagttttttggtaacatatttatttggaagcaaagactatggtatcaccacattacttcagtcagagaatggttcttaatatcactgcaaacattaaatggcaaggaaaactaggtttgtggaagacaattgtttaaatttctttaagtacaaggagatatttgacgtttataagaaaaatctattatggtccaaagaatatgtctttatgatatcacaggcaccaacttaattcctggacagctctagctcttgggacttcaggagatgatcctggaagtcaatccaaaggaaactggtgtaagatcaggtgccctaaagaaagttcaaatgtaaccagaatgtctggagtgtggcaaagtcaatatataaactacatattcactatgtaatgtaaatattcttctggagttgtcctaccattcctctccatcttgaattgcccagctcagaaaacccattcccagggacctttcctttcccaatcctgccaaggaggcccatcatatcaacccttgtgcctctgtcatgctttcttcttttcctgagaggatacttgacatttccttgtcatttccttatgcccactgagcttgctcgaaagcacagctgagcttttaaggcctttgatcttgccacagagcctggatcacagtaggttctcaacatatgctcagaggagtggctttcaacattttttgactgaaatcccccatggtcaccaatacttttttggggggtggggaaggcgtctcacactgtcacccaggctggagtgcagtggcatgatctcagctcactgcaagatccgcctcctgagttcacgacattctcctgcctcagcctcctgagtatctgggactacaggcacccaccaccacgcccagctaattttttttgtatttttagtacagatggggtttcaccgtattaggcaggatggtcttgatctcctgacctcatgatccacctgccttggcctcccaaagtgctgagattacaggtgtgagccaccatgcccagcccagtcaccagtatattttaaatgcagctcagcagacatgcccagaggccttgcctatataaactggaacaagtatttcattaaaaagcatttaatcttactacatgaaatgcatggatattttttaatgtactatagtttggtttttataaatattgttttttaaaaataaatatcaataccattcaattgatttcaagtttaatgaactctacttttaaattgcagaagttacccacctgctaatgatcagttaattggcttatttaggataagtgcaatgaaaaaatagtctttcaccaaaggtaaatgtagatttccttggggcctgttatatttattgctagtctaatataaatttagggaaaaatcactgctgtggatgttccatcaacttcttaccacctattacccacctaagaaggcatgacaacatcagcctcagcattgtctcttatactatgacctctgcagttacctatatttagcccctgctacttgcttggtacagattccttgcgatctcattcctttagtcaatctggaagaaagtggatataaaccttagtgccaccattcagtggagtagagcagtaagtcatactcccaaaactcaggattaagaggctgagcctcaactctggctgccatgtttgacctccccatccctcccaagtccttggtgcccaagctgcccacgaattggaaaagtccacagaatcctgagtgcctgtatatccatcctgtagttcctctgctcttctttagacctgggtttctgccttgaaccccaacagaagctgggatcctgggaccctagttcaatcttgccaaccttcctgccttttgcaccctcaggagatcattgcttggtgctcagtaggtcccatgtcctgcactgtgctagcatggagtaggggttgagaccacatgcagtggcctttcttagagcagccctgctgctggtcaggacatggacctcctggggctgcctgctgcccaggctagctcaccagttaaacagctttatgagatcatgagcaaccacataccatggttggtcccttagggtcttgtccttgcctgctgcattctttttgcactgtggcttgaagagctccatccagagccccagagtgtggattcaagcccttgccaactgcttccctctcccactcaacctgtgttgcagggtctcagccactgtcatagccccaagaccaagggacaggggatggaatatgccaaatcctcctctggaggtagaaaaaatgaaaaacgtagggattgcctgaagaagcccataaacaacatgtatctctccaaaagggtctgtggttaaatgcccttcttagggcaaggagcctgagatctatgaagtcagcccattctgacttttgttttaggtttggttaggtgattaatgtggagaagcaaagtgagcatgaactccagatcccactctccactcacttgctctgtgaccctgagcagattacttaaccctctgtgcctcagtctcctcatctgtgaaactgggaaaataatggtgcatatcacttagggttgtgatatggtttgggtatttgtccccttcaaacctcatgttgaaatctgatccccagtgttggaggtggggcttagtggcaggtgtttgggtcatggaagcggattcctcatgaatggcttagtgctatccttgcagtaatgcatgagttctcaccttagtagttcccacaataactgaatgttaaaaagagcctagcacctcccagccttgcttccacgttcatcattggatctctcttctccagctcccctttccctccaccatgagtagaagcagcctgaagccctcaccagaagcagatgctggcaccatgcctcttgtacaacctgcagaaccatgagccaaataaacctcaagttccccagccccaggtattcctttatagcaacaccaatggaataagacaagttgttattaggatcaagtgagttaaagaactaatgtacttagagcagtgcctgcaagggagactaagtgtgataacggatcacaggaagttaaggatggcaggtacctcagggtctttcacatgagggcattgagacccaaggcggtgaagggacaagcccaaggttcatctcacaaagagaaagtgagaaccacaagaagctctgatccttccctagctggtttttttccttcactctagtttgtgtactttggaggcatttataggtagcatgatcattaatctggtctgcaagaggcataggacaagacaataaaaatattccaaagtcccaggagagagagcagcccctcctggctggccacctccttccccagtgcagatataattaatgcacagaagagaagcaggggtgagtttacatggtccaaatgcccctttctggtatgtcctctaaaatatgtttagcaagaaaaaagggaaaaaccaatattaatcaaacatcctcctgccaaccattgattaaaatcatcaagataacttgggaaataaataatattcccattttacagatgaagaaactgagggtcacagggttagacaatttgtccagtttaagcttgctctttagggtgaagttgggaatcaaacccaagacactgactccaaccctgtgtctgccactgacttacagctgcatcctttaccaggtgagatgtcttccctcaacacacatggccgttccacccaggaaaatctgaggcatccaggtgctgtctctcactcactcaattgatgaaactttgtgagttcataaaaaaaggagcaacaagaattttttccacacttttccacatttttattccatgagtagtttcataagtagcttattgactgtgagacctggaatctcataaaaagtccataaaaatccatctgatgatagtgggctatgtctttaggagtaagcccctacttgagttggggaatggttccttgcattatagaagaatcttccagaagcaacctttaaacaaatgcttactcaattaaactccagttcaac

SEQ ID NO: 1773 - DNA, 791963 bp, Homo sapiens
  BAI3 gene - 69404158 - 70156120 of chr6; NCBI Entrez Gene ID: 577; Build 35; sequence includes 20,000 bases upstream of initiation codon and 20,000 bases downstream of termination codon of the gene
attttatatttaaggaaactgactatgattggctgggatggtaatcagtactaatactccttacgattaattccacaacaactgtccaatgtgaggactatttatcccactccaccttactgttgaagaaatcaagtttcaataaaagttaaaaaccttaaatgagtaagtggtaatactacaaattaaacccaggattctaatttcggaattaaccctcttagccaagatgatacgcaaaatataatcagcaatatcaataccaatgttgatattgatttatttatgcagtatttaaattaattatagctggcgccataacgtttctcagggaggaaataaatatctttggaaaaatgcattagtgggttgcttggcagtgtgatttgatgacagaggtacaaggattacaagagaagataaaataaatttttgctcattttttcctggaggaaatgagaagaaattggagaaaagaatatggaaaagaaaaagggctataattaaagaaaattttaggaacatgaatgtctaatgtgcaatgtcaaattgtgtgttgaggggtttgtaatttccacaagtatgaaattgggttttttaagcattcttattaagatatcaggagacatagagaactcctattaatatcattatctatctatctatctatcaacatcatcatctagatagaaatggaatgcttatgttaaaaagaaagagtaaattaaagtgtcaaatttgtcaaatggatgatataggaatttgatcaaaatttaggtttgttaaacctagaatctggttccatttcacattccaacagacatgaggaaaatatacaagttggaaagaaacctcttttgatatattattccagatcttatatgctgtttaggtatcaacatcaattttctttacctaacaggagagctgatctgattctaaaatttctattgaattctaatggaatttcacaattttttatgaactccatgggcatagatgtgagaatttgatgtctttgctacatagtgattatttacagagactcagaagaataagatgtatttgtcccacaacatgtataatcttctctcccaaagtttccagtcctgttttctttttgcattaaagtaattgacagaatccacaaattttaggaaatgaaaatactggtagttgtaacaaattaactcttacacataataactgcctagaaagaatgttgcaatttagtaacacatagtaatgatcctagaacaccacttaacacattttgaaacttcagtgcctaataacagctatagagtttaaccttaaattttaatttttatgatctaagtttttaatgatgattacaatctgctctttactgtaagcacatgacagaaatttaattttctaattacttgagacttactacagaaacactcaattatactgccaaagtcatatgctgtaagtgtttttcagaaggttaaaagtagtctgacattagctagaaatgttcacctcagaataaaactttacattcaatgcctctttcagcaaacttttaatcatgtagattgaaataaacatgaaattgttatagttaacacatgtcttgactccattattttgccactcttgagaattaaggtgattactattaaataatcaagaatgaaaagtaggtttacagattccagtactactttctcatttctgtgagtactttgatatttaatagatattttgagtttattatttctattttcacagaaagaaatcaaattttgaatttaaaattctaacatttttcctgaattatgggctaatttttcattacccaagtttgattaaataaaattctttgacataattcgggatatatctgaatgctggttttatatgtcacttataactaggcattatattcagaaataaggacagatttgtgttttaaatgttacttgtaaaatcataaatcaaccctatcatatacataatatctttgaaatcaatttaaacatgttcagaacttacagataaccagtcagactcctggttatctctaagttctgaaaagttctcataaaagttagtgcctcaagacaactgcttaatgcatatatatatatatgctctttttaactttgctgagtgcttgatatatttgataaggcaagtagtgtctaggctaaatgaaatgaaatgaagtagtgtctagaccattgttactatgtgaaatatagaaccattttctttcactccgctcagtgctatctccaatatttcagatcaaaactttcctttgccttaagaacaggagcttttcgtatttgtctttacttcctctgtgtttaacccagagtcatacgatatgcttgtcaacagcactaatagttaccacttcttaaagttcctttgacttctgccactgtatttggcatttcctatgttattcttaatctttatattaataatataaaataagcagtattatcctaataattcttttttaaaaaatactaaaatttggtgtaaaatgatttgtccaagtctacaaagtcataggaggctgggtcagaattcaaactttggtctgtctcaaaagcgatactgcttcactactgtgttttggttgtctttgcactgtgggccatgataatctcctttgagatttcacatatggcatatgtgctgctggaacaaaagcataacacatattcttcttaaatgaatgcattaataacattttattagttctatgaatagctctttcacttccatgaagtccatttataattttaattaattaatttcaaaggaattagattgcctccctgagtattcaattgtactcatcaacacttccagtggttataagatgtttgatcaactctctatctgggccaagataagacaaggtaatcagagtggcttcatatcaattgaagggtgcctactataagcagttctaatgcaagtcccaggaaataatgcctatatcttaacaaataagaaaagataatacagcataaatttgttcaagtaatctaatataatgattaaaaaaagtactccagagaaaaaaataaataattatctcacttaggaatttaaagaaaaatatatcaaatataaatggttttgaaaatgtgaaaaagtaacagaccatcaaaacctggattctcatttcaacttggtcattacctctctgggtaatcctgggctgttcactcttggtgacttgtgtctcagtttccttatctataaaccaaggacctgaaagcatatcatttctcaaacttgtctgatcataggaatcacatgtggttatagttaaaaatataagcctaaaaagccgaaagaatcagaatcctcgtggaaggatgtcagggtgtgcatattttagtaaacacaccagtttacactgatgatggaacaagttcaagaaacacagcagtaaattgttgctatagaatgatagagagtggataaatggaatgattcatcattgccaatatttgggcttaatttagattatttttcctaatttataagttagttttgaaaaaattggcttggtatatatttcgttgttaccaagggccctgaaatgaggacagcatgcaaaatgaaattctgagtcaaattaaaatacagttgcatgtgtgaaacatgaaattcttcctcttttatgcctccagttattcagaaggtaacatttgttcaatgaggatacttcattcgtagcctatggggaaactgaataaactgatctggagctgcattttcttatcttaatgacagattaaagtgaaggttttattatttctaattcagtttgattcaagagaggcacaaagggaaaaggattaataaaatgcatgttgaatccctttccctttcctataacaaagatgtgaagatgcattcagataattgatatcaaattaccagtttgtttttctttttaagtcactgagtaattgctttatagttaatgtcctaaggattaagatgtcacctgagtgttatgcccgcaatccgggcagcatcaacttcgcaataatacttaatgggctctaggacataaagaaattatttcagatgttgacattgaaagagccaattaagtaggtcagatggctttaaaataaagaactttttgagaagctatttaccaattttccccttaggaaaagcaattaagatcatagaaagacagtgttaatatagaaatgacgaatctgcttgagatttaatcttcaatagtaaaatcaaagaaaaacctactataaaattgtcttctccataattgagactgtcaaattctccatagtattaaaaattaggcatatataaaaaggactttggtaaacaaatttccccccaaaaggcttgaaatttttgataaaacattttatcttaggccaggcacggtctctcatgcctgtattcccagcaatttggaaggccaaggcaggtggatcacgaggtcaggagttcaagcccagcctggccaagatagtgaagccccgtctctactaaaaatacaaaaattagccaggcgtgttggcgggcacctgtaatcccagctactcaggaggctgaggcagagaattgctcgaacctgggaggcggaggttgcagtgagccgagatcactccactgtactccatcctggcccacagggtaagactctgtctcagaaaaaaaaaaaaaaaaaaaaaaaaaaaacttcaagaaattttgtttaaatattaaaagaaaataaatttctgaaaatgcataatatatataaatcttattaattatgatgaaaataatacaagtcatttgtatcagtagaaacccttattctaagattttttaaaaaaaggatattagaatgagagaagcccacataaagaaggataaaacaagtaaaaaatttcaaatgtgtaaaaataacaggaagtgtgaaaaaagttctgccttcatggcacagaatgtttaatgatataagaaaacaggaggaaacataactcagttcctgctttgattccatcttcaatcaaaaaagaattatttttcactttgaaagcatggaccaacaatgtttaaaagtaaaataatacccaagaaatcaagaaaatgaaagaatccttaggtatgttatcattttttcaaatgtcctggtctagaaaaattacatcacagtatacttaaagaaagtataagtgttcttattaaagtatttccaactacgtttgaaaaatcttggaaaataggtggacacaggaaacaaatagtagtaggtgataaatacgggctttattttaaatgggaaaaggggctgaattctagaaatcgtgctttattaaatttaataaactttaaatttaatagtggtctctgtaaaaattatggaatatgttacagaataggtggtttgtgaatttatagaaaacaaaatggggataaatagaaaccagcctggctatactaagaaataatactattaatctaacaactactgctagggatgtcacagagcagaatgttgtaagcatagtacatatgcttcttcttcttacaaggtatttgaaataatctctcatgttcctgaagaaaggaaagataaatatggattgtttgattaaataacattctataacaactaaaaggatctcaattagtgagctagaaaaacaatatttatcaagtgctgtccaaaggctgatattatgggataagataatattcctgccctctagaagtttgcattataatggagaaatgtttctagttgtatgtcactgacactatgttgaaacagtggccactgacttggaaatcacttcagatatgcagatgtcattgattatggaataatacctaacatattgaatgatagaatccagcaagaagatgtcaatgaacagagtgtacaccacatatcacacattctttaatattcctttcattgagaatggtgactacattaagaactagtgatttttcagctctctccctcccagcccagcccccctccaccagcaccttgaagctgaacaagcttagtgactgtttgactaagaataatgtcagacatgaatctgtaccaatttacagacctaggtcttaagacactgacagatttcttttcctacattttcgaacactgacttatgaaagacagctgcaatgctgtgtggaagagcaagcagccctatagaatggcctgtgtaaagaggtactacatcccctgtgttacggctcctactgagcccccagccaatagctagtgccaaatgccagtcacaggtggagctatcttggacatggacccttcacacccagtttattcaagatgaccctgaaagacagtgtcaaaagacaagctattccaacagaaaaggactccccagattgcatatttgtgagacaaataaattgttattttctgtcgccatgttttgtgtgtgtctctctgtgtgtgtctctctctcccttctctctctctcttgcacactgtctctcaagcacacacacacacacacacatttaagatcacaaattcaattgtataaagtaataaacacttaattctaaatataaataaatatctagatcaacgtattttaactaactgtcacttgaatatgaaccagcagtgcatacagcagattcactaacagagactcttatccagatccagtcattctccttatacctaaccattgacacattctattaattttgcctccaaaggtctcttggacacttctcttcttcatccatactgatgccaccattttcacttatgtaacagtttcctgacttgaatcttcacattcactcttacctctctcaaatcgctcctccgactgaaatgaaaattagttgttaaaatgtgtaaatctgagttagtctctgtttacaatcctttcaatcatattattattattacaaagactcactgattttttttttttccctgagatgtagttttgctcttgtcgcccatgctggcatgcaatggcgcaatctcagctcactgcaacctccgcctccagagtacaagtgattctcctgcctcagcctcccgagtagctgggattacaggtgcccaccaccaagaccagctgattttttatatttttagtagagacggcgtttcaccatgttggccaggctggtctcgaactcctgacatcaggtgattcacctgcctcagcctcccaaagtgctaggattacaggcgtgagccaccgtgcccggccaagactcactgatttttatcctaatatttagcaaacaatttatcagaaatgttgtcaattgccactgacctctttgtcctttttattccctcaccttaactttctttacctagaatgtgttccacttccttctgcctcaatttttttgtacactctgttccctttgatgagcatgactaaatttcattagtatccttcgaattgctggtcaaccgttacgtattcaggtaaataaatgttctctgcccttccatactaggtcatcccctctgttcccacaaacaagactccacacctctcacaacttcctttgtctcttctctgagacatttgacacacttgccattaataattatctggtggcttgctgttcattggctctcactacaaatacaaggcattcatcagaagggcagggactctgtgttgtcgtttcagtttcccaaacaccttacaactatcttatatggtgtaagtgcttattaattatgtgttaaatatgtaaatgatcagttgacttcagggatttgaaagccttattctcctcatatgagacattcatcattataaattcacagtttggctacatagatgctccctgtttatttctctggattgaagaaataagggtattacaaccatgctgagcagctgaaatctggagtattttgtttaattgtggcatcaaagaactgtgacaagctaagatcaattgaaaacagtcataaagatgaaaagtctggagaccatgtcacctgagaaatttctcaggaaatcaggaatttggtacagggaagagagaactctagctgagttgttatgcaggaatacgtgagctgttggaatagatatttctccaatggacacaactaatacccatatataagatttaccatgttgttcaacccatttattcactaaagacctaggaagcactcaccatgtgtcttgcactactttaggcaggagtttgtaatgatggagctaacacactcataaaaaacaaaaagatgaagaccaattaaataaaaattggtaactagtataaaacagataggccccagtgtgtgatgttaccatccctgtgtccatgtgttctccttgttcaactcccacttatgagtgagaacatgcacacgtatatatctatgtaacaaacctgcacgtttgcacatgtatcccagaacttaaagtatatacctgagtaaaaaaacaaaacaaagcagataagtaccttgaaagagaacataaggagagatcaccatagattgggtggttaaaaaaaaaaattaaaaagctccaaaaagggaattttcaagatgaaatctgaggcatgagaagcgggcaggtcaggcctataaagtttctcctagcagtagaaaaggggaagtgtattccaggtagaataattctgacattggaagattgtaaggagataaaaatgtagcgtcctcgtgacttagaaaaaggtgaatgtagcttgggcattatatgtaagcagaagtgtgacacaagatgaagttagagagaggagcgagaatcagatgaggtagggcactgtcggtcacgattaaaagtttggattttattatttgtgctacgtgagaagtacctggaattaaaatgtttttccatttgattttaaagggatacgtttttgaagtataacttattagagatagattaacaaagaatattgaatgccaggtagaatagactaagcaaaaactacgtacatcacacacacacacacacaaaagataacagtgaaaaaagaaacaactggttaggtttgagatctatgtattgcagttatatcatgagctgaattgtgcccatctctgcacaccccaaccccatttgaagaggcagcaagatggcagccatgtgcaagccagagaaagaggccccagaggaaccaatccaatatggaccttgattttagacatctagcctccaaaactgaaaaaaaataaatttctgttgcttaaaccacccacattgtggaattttattatggcagccctaggaaacttctacaaagtggaacaggcaatatttgtcaagggattagatgtagagtgatagaaaattagcagcaggtatcattcccatgtttgccaatggaataactaggtggatagggatgccatttcctgaaacagaaagactgagggaagagcacatttctttggagtaatcaggaatttttcttcaattaccccaaatctgagatgactgtgaggcatatttagtagagatataaatcacggcagctgattatttaaaaatctagagctcagaggagatatctttgttaaaggaatatacatggggtgtctattcatatatgtgtatgcatgtatgtacatatacatactcattagggagtggattattcactccctattattcaatattagggagtggattagatcaccgaaggggaggtggtagagaaataagggaagtacatccaacacttatctctaaagcagtcagcatttcaagttaatgtggaagaagaacaagcaaaagacactgagaagtgtctcagtgtcttcacagtgatcagtgatgtaaaagtacatctgggagagtatgataaaacagaaacaaaaatagaagtggtttccaaaaggagggcattgcatttaaaatgctgctgaaagttagagtaagatgagaaaaacatttatccctttaacttggcatcatgaaggtctttagtgatttttgacaagatttttttcagtggaattgtgggggtggaagccagaatggattgagatgagaaatgagagggagtcaggaagtgaactgaatgtgattgctttttaaaaaaagattcattatgaagtgtatctgagaaacaggttgttgatcagaagtttttagacaggtagtattgctataaaatatgtatgctgatggaagtggtccaggagagagggagagattattggtgtgagagccaatagaagtaatatccaagttacctgtggaggggatggctcttagataagagcagtatctccctggagataggaagacaggagaaaatgggtgaaggtacaatcagtttaatgaatataagatattttccatctaatcacatctgttttataaataatgaatgaaaaaaggttatcacttatcattcaagagttgaggagaagcatttttaataatcagagaaaagttacaaaatattcatagggtgtaataagagagggagcttataagtaacagtctgtgtggtgagatcatgagaacctggtgactataactttacagggacatctaactgcctgagggtgtgaatttcttcagtaatgctctgctgcatgggtcctggatcaggaagggcagttgttcatcacagtaaacgtggtgatccagccagaaaaatgttaaatagctgaagactgttgtaagtaaattattataacaatgggcgtggaatccatgggatatacattagttacctatatttgcataacaaattatccccaaatttagcagttggaagccaaacattcctgatttatagtgtctgtaggtcaggaatccagaagcagcttagctgcttgattctggctcaagcctgtcatgtagtggcaaccaggatgttggctgggctgcagtcctctcaagacttgaatgaggaagcttccacttctgagctcactcatgtgtcttttgacaggcctcagaaggccaaactcacatggacttctctatttagggctgtatgacaacatggcacctggcttactggcaaacaaatgctctaaggaagagtaaaggagctcccaagatggaaaacacagtcattttatatcttaacatcccattgctactaccatattctgtttgataaaagcaaatttctaaatctagcccacattcaagagagagacaattacacaaggacacacatatcaggaagtagggatcatttgggtccatgttagaggctgcttaccacagggtataaggaggaaagtgaagataagagcagaaattggtgggaatcactaataataaaaaaaagacctgaattttgtgaaagacttgattccatgtggttacttaggaggtgagtttataaaagcagaaggttgtaattggagaattgaaacattaaattttaaatactggaagcagtttagtcactggttagactttttagttaaagaccatagggaacctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtatggacatggatgaaattggaaatcatcattctcagtaaactaccacaagaacaaaaaaccaaacaccgcatattctcactcataggtgggaattgaacaatgagaacacatggacacaggaaggggaacatcacactctggggcctgttatggggtggggggagcggggagggatagcattaggagatatacctaatgctagatgacgagttagtgggtgcagaacaccagcatggcacatgtatacacatgtaactaacctgcacattgtgcacatgtaacctaaaacttaaagtataataattaaaaaaataaaaggaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaatacataaataaataaataaataaataaataaaaggaaatacacatatgcaaaaataaaacataaaaaaaaaagaccatagggaaatgtggatgaactagtagggaaacacacagacacacacacacagaaatagaatggagaagctagtatgtcaggataagacatctgcatgggagctgaagtcatgagaagaggaatggaagtcaggtagacaggaaaactgccagccagcagctaaaagattccatgaatggaaactataacctggaggaagaggtaaagctgcaaaggcagatgccttggtctctacagaaaggtgagcatgaaactgaaataaggagtacatatttgaaaccaaaggggagactaaggatactgattctgccactgacccatttaatcagggtatggaagcagcagacatataaattgcatctgtttgacacggttggaagagatgccatgtcttcataaaagagcaggcttcagtcaaggaagtgggtagagaatattcttcctcttgtttgttggtataaaaaagcatggagatccagaaggcaaaatgagagaatctgccaggaagagaaatggtagagataagtggatcagaattggtagaaacaggactgaacatgaataaatgttcagaaataataggtagtccatagacttcaatacctggtgttgataaagctcagcagatgtgctgttcctggcagccttagttattgtcatcattaatgataaagtgggacttctgtcaaagaaaaaaattatcagagtgggagaggaataaaaatggaaaggactgtctgtacctcagaagatgatagcaagggagaaaggcaaagctagtaaaactatggaggttttcaaaattgtgatagaatagagaggcatttccaacctgtgagtgggaaaattgtgattctttctagtctaggatttaattgcatttttctctcactgcttccatttcttgtgagacaccttctgttatttagactatgtcaggaagagccttagacattattcaatcaagctcttttctgtgagataactgaagtccagagaattcatagcttcttgtccttaatgaggtatatacttagtgtcagtttcgtgagtaaaaatgaagaatcttgatttctagtataattgaaatttcagggattaaagataatggtgtaagtatagtaactttatatgagaaaataactagctgaaaaaggtcaaatttgggggtgaatgtatgttcgattgcaaacccatattttgaggttttaaagtccatattttccaagatacttctacagcacacaaatatgacattatgtgttacctacttacagcatttccttaatatcaccaatgaaatcttgaaaattgatggccaaaagtatttaccgacttttttttaacttgtatcgttgtatagggaaataatgataaaaaatggaaacctgatgcaactgggatttttgtaaccttgactttgcctagcatggaataggactacacttgaactaacccaggatagctgttctatgacatctcccttaaccccaagtctatccctttattttttagtacttcaatgtactttctattctgggatgtccaagtagaaaatgaccaatttgtttttttacatagagactagaggatatacagcttggtttctgagagacttccttttttaataataataaaataatgataataaacaggagacagaggagaagaagttgtttaactttatagtaaatatgctaatattaaggataagttctcataacaatgtaatcttgtaatattttgatcatttaattaacattccaaagctttgtgtatgtgtgtgtatatatatgtgtgtgtatatatgtatgtgtgtacatatatatgtgtatatatatatgtgtgcatatatatatatgggagatactaaatactaaatactaaaaactaaatactaatactaaatactaaaaaattaaggcatatttaacaagaaataacctacaaacctatccatgcttcttaaagccttactgaaaataacaagtcacagagtttagaatgtggtaatacagtaatatcagaaaaactatgacagaaagaaggaaagagaaaatactttctaaaattgagtaaacatattctagaaacattcttatttgagtatgagaattctgcaaatgatactgaattttaagcaatgatcctggattatagggttattctcaaagtggagggactaaacttagcacatacagacaaaaagatgaaacagaaataaatcacacttataacctcatcattccaaagtaatcttaataaaataatagcaggagagataaatttgaaaggctttaatattagatacctgggtcaatttaaaatgccataccagactatattttgatgtgctaacactgacctctcaatagttcttctgtaaatcatcaaggaaacttatgtaataatcaatttatacaattaatgtggtagttttggaattaaatgcattaccttataaaagagaaatacaaagcaatgtagtgaaacttcccaagcaaatatatgtgtatcaactgaaatacacatatacatatcatatacatatatatacacacacgtgtatgtgtacttacaaataatgcgtgcatacatatacatatgtatgtataaaatatgtgtatatgtgtttatatatgtaaacataaatatagacatagacttgtgaaagagaccaatgaaagcagataattataatttgaaatggtgattttaatatgtattcagtcataaaagtggaccaacatcaatagaaaggaaaggacagagagctgagggtgtgtaaactgctgctctctttttgctgttgggtcaacatgtcagcaatgctttcatatggagcagcttgcagacatgaaacaaggtggttcctcctttctttgcctttggattgtgctgttgttagtgtccagagaccagactgtccatatagggttctttttgtgattctttattataatcccctgaggaagtcagacgagcctggggttactggagacagtgtcttgcttggcgtagttatcatccacaaatcatctgctataaatatatctcagaaggatcatcatcaggccagctcagtagcctgcaatttatgaaggttatgagaaacaatgtgaagggtgaagcgctttattaagggtggctttcttttctgaccctgccctgacttctacttgaatataaatgatcctgggagtaagtgaacctttccatttaggatttaggcttttaaattgtccctttcagctgttattcttatgccactgtgtcatgactttaagaatttctaagaaacatcaaaatcagtgttacaagataatatgagaaatcactagatgcaaaatagaggtataactgaacctcacattacattctttcctttttatgtataaaccatccaaagcattttttcctccgtttttattccacatctgtcatgcttttttttcctctggataaagtaacagaactgaccaaattgccttgcgaaaatcataattacgatctctagggaagttgaaataaataaaatgtttttctcctttgtgttgctcaatgttctttgtttttaaaagaaaatgtgttgcttaaacggtgtttcaaaatttgttctggacataaaccctaattatttccttttaacatttccttaaatgaataaaaaatattgtaaagaaccaaaatgacacaaaaccaaaatgccacccaggctgctctcttgccggtgatttgttactgggaaaatagttaaagcctgctggggaattattaactgtttccccttacagtgtttatcccaggcattcgtttaagacgggaaagccttgaagagggtcactctattaatatgcattaagaagtaaaggaccaattttaatatttcaaacaactccagtggataacagaccataaacttcctgttttcactatcaatctcttttaaaatggtgttcttggctatccataatcgccccaggggagagaaacaagcggaggaaaaaaatgcaagagtgaggggaacaaatgatggaaaattgctttattcaacttcacctgccgctcgagaaactcacccttacgaagattccagcactttatatgaattacccattatggtttcctcccaccacatcactgcactattttagcacttgttttgcaaaccaccaactgcgtttacaagtagaaacataatcaggaggcgaatgaccttttgtagcatgtatctgaagctggtttatcagacacttcgtcagccaactgtccaggaggcaaaatgactatctatgatgatagatagacagacagatagatagttagattaaaaggtggggaaacatcccttttccctttttcctttctatataatctggttttttctcttcaccccttttctcgcttcttcccaccccgtccccaaacctgttactagggaaacttgaaaaagaatcagatacattaagactacaaaacgaaacaaaagtttagaccccgaaaccatgattccattgccaagcacaaagcaatgcaagagcccaacgtcggtcgccgcaccgcgatcctgacaaagcctgtatggagccagaacaaataagatgttaattgcagcctcgcagagaaaaaaatactattgttccagccagagacactcagcagctcggtagctgggatgtgccccctccgctgcggactggatcaattctgaatcccggtactgaaatgacagctctctggctgcgacaggtctgcgctgaaagaaagagaaagacgatcaagtccagcattcacttcccacccttcagagtcgccttcccatcctccgcacccccctgcctcgcctcccagtgagtttctcttacagttggtcgccgccagccccagcggtgggaactgaggatgcaaaaacctcccagacgcagaaaataccgctttcgggacgtgcttgggtttgagtagccgtgacgtgcaggcgaaccgcggccctggctggagctccgtggagcccccctcccgccagcctctcccccgccctcccgccgggactccctcctctcccaccccgcggctcccttcgccttctctctcacacacccgcccgcgcccccggcaggcagaactccaggaagtcgcagcggccgcgccgcgcgagccgagcctctggcgggcggcggggcgcaccgcagctgtgcataagaagggcgcgcggcacccgggacgcgcgcgcacacgagcacgcgggaggccgccgcgcggacgcgctcccgggacacgcgcaccccccgcgcgcgcgcccaagggagagcgagcactgcgcgccggcgcgcacacccgagacagagctttactatctcgctccctctcgcgcctccctcctcgctgggcattcaaacagctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccgccgccgccggtcacttctcgtctcagcgctttctttgcttcttggtttgttgggggtagcttttatgaaacaaatctttgctattaagccacttacattttggggggttccttagagtctcccttgggggggcttctccctccctttagcccccctcggtttggaggttggattcagttggatacggcgcaaggttctgggctcctgctggcttttttttcctctctctcatcgacccccctttggttcccaccccccaccttttgcttttcgtatgtatgcatttttaaaaataaatcctgattttggaagctgagccggggaaaatgggcaacggtgattgggaccgaaggggagtctctccgtcactgttgctgggacgcgtgcctgtgctggtgtcttagagcaagagcctccctgagctttcggagtggaaggtaaggaagggggtccaggggtcaccttttctctgccgggggtcgccaccgtggagctttgggcttaatgtttgagaagggaggaaaatgaaaggaaaggctgttgctggcggatggggaggctgtgagcagatccgactgtctgcatttacttaaacgccgcagttgaaaagttagagaagtctggttttcaagagatgtgctgggtcagaaggaataagcggagagacctagaaaatctggcagttttgtgtgattggggtaattttatgaggggaaaattttaggttaaaaggaagttaagagaaggcagtgggtcttctattggggggaaaaatctgtggagtgatggcgccgtctatgttcgactaaactaaagtgtcacccagaaaatcagttttgagaatagctaaactcaatgctggtttgcttctcagcaagagataaataaataaataaataaataaataaataaataaaacatccttgacacctccgtggccagcctttgcccccgcccccaccccttctttaagagggaaacacggctttttgaacgggccctgcagtccaaaggggggtgagggtaatgatttattttttattatttagaacaaaataagactgtgtactccagactgattaaaaataaagagcattatattgagtgcgctctcttgagcaggcattaaagtgaattcagagctatttcctcactctctgatcattgatgagcacggcattgcagacatgcactgtcaaataaatgaaagcaaaagtaccaatttcattaggaaaagacatacgacctctttttgagttcctgattataaaatgaagtcccctttcatggatggaattcctaatttagacacttattgtcacattggctctcaacgcctacactctatcctgaagaacactgcgcagacctgcattgcctgcaaagtgcaacaccaaaaaaaaaaaaaaaaaaaggaaattatttccagaatttcttacaactttctctgtttttttttaacctttaaatgctcattggctttattttctcatgaagaaaatgcattattcattgagctatttgcttgaaacagagaacactgttttgatggtcccagcagttctgatgttattttaaactgctgctatatagagatttagagttggggctgtgtttgcctatatcaagacatagaatttgaattataatctggaaaatgcagatctatcttcagggacttcggtcactggatttggtgtgcatgcgttggtgtgtgttatgcaatgggaaggaagagggttttatcctttgattcagagaagacccaggcaaaggcatgaaaactcttaactatctatatgtctgtatgtctgtctctgtttacagaacagtggaagagactgcagcctaaagacttttaaaattaacttggcatcacttttatcagctcaaaggctaaacaaacaaacaaaagcagtgtcatttattctaagaaataacttcttaaaggttaaagctgaaaaatattcaagttatttttggataacaacttacagaggtaaatataaccaaggactactttattatccaaagccagggttaaaattaaaaaagaaaagaaaagaaaagaggagctttggagttgttgttggaaagggagcaatttaataattgaaatctgctaggaacaaaaatgttaatgtattttattaccatgtgtaagccttaaattacagttgataagataatttttcaaaaattaaaagactgaaaccagctcaattactatggttctggattttttttttttttaactgatatcacctttggatacagatactaatacagtgatccactttatgtatcccaaaagggcatgtcacattgaaatgactgccctaaatcctggttctcaatggtgatgttgaacaacaagtcttccctatgtatttatccatctatgccctttctcaaatgatggttttaaaattaactaatccacatgaatgcccatgtttttgcaaaggaatttctgagcagttcacatggtggcccctgcaaaggcaagtggggcatttgggagatgatgttccatctgtaataaattattatttgtgcttttaaaattgtggccataatttatcatcattacttttcacgtttaagaggagagaaataatgtgatgacagctgttcccagattatcagattagattttgtatgatagtgtttaccgcagaggacagagagagaaaaggttgtatagactatagactgattaatactatttcgacaattaacatttacattatgacgttttaaaactccatgttttcccttttcattcgatagaatgataatggacgtggaggatatcctagtagataagttagggcattcctattaataatctattaaatgttatttttaaattgaatgttgcgaatttgaccattgtgaatggccacatgagggcgctgttcacacagcaacagataattttcctgtgttataaaataaaaattacctgcccttcttttaaaaagggctttttactgaaatcttgaaaacagctggctgtaatattgaaaggagtttattttctcaatgcacgtagactcctacttgcattttactttcattgccatttttacaggccaaatgacataggatgaaggctgttcgtaacctgctgatttatatattttccacctatctcctggttatgtttggatttaatgctgcccaagacttctggtgttcaactttggtgaagggagtcatttatggatcgtattctgtaagtgaaatgtttcctaaaaactttacaaactgcacttggacgctggaaaatccagatccaaccaaatatagcatttacctgaaattttccaaaaaggaccttagctgctctaacttttcactcctggcttatcagtttgatcatttttcccatgaaaaaataaaggatcttttaagaaagaatcattctataatgcaactctgcaattccaagaatgctttcgtttttctacagtatgataaaaattttattcaaatacgtcgagtatttccaactaatttcccaggattacagaaaaaaggggaagaagatcagaaatctttttttgagtttttggtattgaacaaggtcagcccaagccagtttggttgccatgtattatgtacttggttggagagctgcttaaaatcagaaaatgggagaacagaatcatgtgggatcatgtatacaaaatgcacctgccctcagcatttgggagagtgggggatcgacgaccagtcgctgattttgttaaataacgtggtgttacccctgaatgagcagacagagggctgcctgacccaggagctgcaaaccacccaagtctgcaatcttaccagggaggccaagcgaccacccaaagaaggtaagtgccaaagagaggggaaggtgagcgggggagcacttttgggggatggagttaaaacgtgctgtttcaacacacaggcctaattatttatcctttattgtcactttttgattcatttgatttgtgctattcactgataaaggtctcttgagctagttttaggtttcaaggttttagagagggcggtgaggactggatagctcagcagcatgcgctggaagtgagggtggaattttcaggagaaagatgcagaaacctagagccagcatgcactagagattggtgaggagggagaggggtttctttattcaggctgcagcccctcatggtgacacacacacgccccacatgtgaagtggatttatagacatctcccttctgttccagcccagcaaaacgtccactttacttcctctctcctatccccacggagtccttccctctcactccccacccatttccaggtctgatcttggggcatcttgactaaaaggtagtgcaaacttaatagtttgcctgtttggaccaaatgacttcctgacacatgaaggcaggtgtaccccccttctcccctggtctggaattttatttgaggtgcttgcgcaaaaatctcgcacgcttgctctttcttgggtcagaaggaactcactagaagcgcaaactctccaggtcttttggttctggagtcacctgaggacggggtggaggggtgcaatgaaaacacatagtgatcctttaagaccccatcctcctcttgagagtgaatttttgcctttatcttcttagtccccggttgacgtacacgaagagagggaatgtctcagagctagctgggggaaaggagggggaggaagtgcaacggaaatgcggaagaaaaagaaagtacaggaatgatttatagttttcacccaatccccagtgggggagctaccagaggatttgagattgtgattatgtttaataatgcaagacagcgtgacatattttgagaaaatgacttttgttgtttggaaggttaatggatgttgtgttccactcctttaaggacactgctgatacatattagttcttgcttcccaatcctgaaaccagagagtgtgttgatttcttatgcaggaaatgttttctgattgccacaaagatcccagtctgtggaaagggacagccaaactccagtcgccaagctccagtccctctttccttttcctcaaccaacagaagttgtctttgtggccaatataaaattgacacgttgttggagaattttctttaagtgtagccaaggctttgtaaggggaagtggagggatggagaaccgaaatagcctaatgctatttctctgctggctgcaatttaagggatgggaattatggaagagcaatggtaggagaggaaaagacctgttagaaaatgaatgcagactaatggcagtgagagaggggtgaaaaccttaaagatttctgcaggtcagtgtttcactatcagctgtgactgaagaaaacaaagtggttttaaattacaggagttattttctgtagtaaaaaatcccagagaagcatttgcaactgcagggatggtatttaacaccatttaaaactaattagtgtcccctagaataagaagctacagtacacacaaaaaatgtgatgttacaaactggctaataaaccattaacataggaagctggtttttgtttgttttactgttgttttaatacagtttagaaaatctgtttcttcaatggttaaattgagtactgacgacagtggagagtgaattcagtgtcacaactcttttatatgaaaggtggtaagtgacaaaaacaaagttgttgtgtgtgcattaagcatgattttcaaagattttttgatcatgatcccgagatgtgggttaagataatgctgggatttacagaagctactagatagccatttgttttgtaagtgaagacaaataagagtgattttagacagcagatgtataaatcatgggagacaaattgtatattgtcattaattcactggcaaaatgaaaaagaaataccttcactgacaaatatacttacatttaaagtgcagtatgatgttaatagagttgaactagaaaaagtttgtatcataggggaacaacatatgctatgtcagtaaaagcacatagtctctattctgtacattctgaatttgtgttctttgtttaggtattctgagttcagaaaggtaaggataagtaattactgatgacacatttgtaggtgatgtatttgttaagtaattcttacaaaatacatgtaccactctttaccccagttaaataatctctttttggctaggctacattgtaggaaaggaatgtgaaaatctattgacctttgatttaatcaaatttaagcaaagtatattctatcttcaatatttgatattatgatatataaaatactaataaataattatttaataccattttaaataaactaccatataatgacatagagcttgaggttaatcattacatatagctgtactaatcatatctcattttattccagagtgttattttatatgataacatgaaattccagcttttaaaattgggttttaaaaattccacttatattttatattacttggtgttttccatttcctattaaaaaaggttgtctcttaagtcagcagaggaataaatacaagattactctcctttgactcccattttattcactaataaatactgactcagaaggcctgccttgagtagaaatatcttcaacatgtattgtaccatagaagtggcacaaatttgaagagtcttcacacttagtagatgtgattccagattgttttgtgtaatactgatggtgatggcaaagatatatcaaatgttgaatattgtgagtgtgtccactggtattatgacataatatttggtatttagtattgaaaaacaatagactctcaggagtgggatgcctactttgagataggatttatgctagaaccttctttaataatatattcatgtactgaaaaatttcatagccagaaaagaacggcaagaaaactattgctgtttttagtgacaccaacaattacagatgttatcttgaatatatcatacaaagtaaattatttgactaatgcttcattaaagtattacatttgagtacatttttaaaatttcttgtttaagatcatatttgacatatttgggggtatcatgtgattatagaaactcagttatttccctaatttttatatgaaattgtgaaagccaactaagttaacaaaatgaagccttttttttttttccaaataaaaatgtcttatttcaggcagctttttaaaaacctcttaacatataatggctataacttaaaaaaaaaaactcaaataacattatggtttaccagtttttaggtacaagtcaggagaaagactggtatttattaacaaagtcatctttaattgtcctgaggtctttactatagtttataggactcttttgctgaagataattctggactatatagctgagatataaaatgtggaataaaaatatcttatttcttaccacttcatttataataaatgattaaaacagttttggcagaaaaattctacaccaggatatctaaatcacataataagccttaatggaatctttgtttcttactgacatcaatggtgctacttatgtgaaaggaaattgggatctctgtatagattccaggaaatctgaacacacacactcatttgtctttctactctgcctttgctaatccttgatattctactccccaaaggaagtctcaccataggcctgtgtagactttagttcatgcctgcgtgtgtatgtgttgtcatttttagggacatatttgcaatctaatgtgatttgagtctatgtcagtttaattgtccccatttctttttacctttgttctgtttgccctcagataactttaggagtcatcattcacctttctctttacactcttcatcttccttttttttttttttttttttttcgtatgtcactgccaggatgccatactctatcagaatgcagaacgatttactgaatctgttgttccttgaagaaacagcctgacagtttgccctgtccctgtgctggatcccacagacctttgcacatactgtacttcttttctagcattcaccatattgcagcgtgattttacatcaatattttcatctcggctggtcgcagtgtcttgcacctgtaatcccagcactttgggaggccgaagcgggtggaccatgaggtcaggacttcaagaccagcctggccaagatggtgaaaccaccttctctactaaaaatacaaaaattagccaggcatggtggtggcagcctgtaatcccagctacttgggaggccgaggtagagaattgcttgaaccctggaggcagaggttacagtgagccgagatcgcaccactgcactccagcctgggtgacagagcaagactctatcagaaaaaaaaaaaaaaattccatctaactctaccagactgagttcttcaagtaaaataaaaacaataaacaaacaaacaaacaacaaacaaaaaaaaaaccctgaggctttcaattatccagcacactctgaacatggttttagtaaatattggttgaaatgaatgtgaaataaatgaaacaaaaaaactcaataggaaagacagcaataaataggttacagtaaaaaaaaacagaagtacatgactttgggaaagcatctaccttttacttacacctttattaggggaagattgctattatttttataatttccaattttattaatgcattattgatgtcagttcctgatctccaaggtgttattttaaaagtttttaaaataacaaggacttactaacaaatattcttaattatttatatgtttattttaaaatgtcaatgataaatagaacttgctatgtatgcccatctagaaaaaaaatggtaagaaaattagccattttctatctctttatttgacttcatttctctctctgtttctcttttctggccctagcattacttgtacagtaatgacattttgcaaatcctctcctccacactttgaagataaacataagctgtctttccaagaaatagaaaagactatttatacatcagtttcagtgttactgttattcactcttgattatgatctatgttagtgatggaatattattaaaattataggcccggtcaagtataacaaaatgccacaattattccgtttgccatcttagaatttcaccaattaaggagtagttcatgtatgtagcaattaaagaaagaaaactccattacatggtagcatattttttgtagacaatagatttaacatattaagaggggtgcgaacacttaagtgcatttgtttgtatgtatacaatgtatacacacatgtgccaacatatgtgtttcagaggatttttacaacagctgtagattaatgtacttcaagttcattttctatcaaaatcgagataggaattttacttctcttaaaatccagctttttgcatgttttcttttacttcctttcctgacagaagcaattttattgttaagctgattttttccatatatctaatttataaatcatagtttttctttaggctcagtctggtatgtattacctataaaagcagtccggcccttggaaaagaaatcagtgttcatttaaaaataagattttgtaattttttttttctaaattgtatatattgggttttaagatcatgaaccaaagagagctgagttttaatttgctgttccttataatggctactactctatattatcactttcttcttttcagagtaggctagtaatgcttatttctcagggtacaggaggataggaaatgacatcatgtatgaaaaaaattaataaaattaatgacttggaatatttcagttcctgtcagtgcctgtggaaatttcttcccgattcaattaactaataagaaatcagagataatacttttttctaggtgtgtcacttccttgaaatgagaagcatgatttggtataagaaaaactttggtccctaaaatgactcagccacttagtagcacctttgacaagtgactgagcttgactaattaataaactgagaataatacctactgcaatggagtgtcatactaaatgagattgcttgtatgctcaagttatgttaggccctcgataaatgtcagtgctcttttcttttttcttttttgagacggagttgcattcttgttgcctaagctggagtgccatggcgtgatctaggctcactgcaacctccgcttccagagttcaagcgattctcctgcctcagactcctgagtagctgggattacaggtgtgcaccaccacacctggctaattttttgtatttttagtagaaacggggtttcaccatgttagccaggctggtctcaaactcctgacctcaggtgatccacctgcctcggcctcccaagtgctaggattacaggcaggagccaccgtggccagcccagtgcccttttcttttccctcaaactcccttcttcagtttctggtagatcaaaacaatttctgattaaaactcacattctatttcagacatatctatattcttatgcaattttctcataaaatattaaaaattgtttatcatttgtataaaataaaattacccagacatgatgacctgtgtccaggatggaaaaagttaacattgaaaatgatagacttccagctgggcgtagtggttcatgcctgtaatcccagcactttgggaggccgaggcgggtggatcacgtgaggtcaggagtttggcaccagcctggccaacatgatgaaaccctgtctctactaagaatacaaaaattagccaggcgtggtggggcatgcctgcaatcccgacttctcaggaggctgaggcaggagaacagcttgaacccaggaggaggaggttgcagtgagcagagatcgggccactgcactccagcctggccaacaagagcgaaactctgtcaaaaaaaaaaaaaaaaaagaaaaaagaaaaaaagatggacttccaagtgctggggaattgataaaaataaataaatacaaatgataacactgaattttcatactacttcatatgtttttatttgttgttttgtttgtttgttttttacctttcataaaacttgtgtatacaggactggagaacattttattttattttttgttttgtttttgggtaaggagaatggcaaggaagagaagaagtgacttgagtaactatgtgatgctacatagcagttatatgggtctgcaaagttttgagaaccatttgaaacttttaattgtgtaagagtgtgtgtgttgtggagaggaagggttggtaacattggtttaaaaacatatcttctctggtatttttattattatgcaaacatttatttatttactgattaggaatctactgagtgcttgatgttttgtgcatggaattcttaatgagtataatcctggggaccagagaagggaatttgggttggaaactttaagaaggatttccgtatttcatgtgtgtatggttgaaaatatgaatgaacaaagcaaaattgaaataaaagaatactgttaataatgaagttgttgagtgtggaaggtgtagtagctctctagaatgagacctgcatacattaagcatggatttcttataacctcttatcgtaattgaaataaattttcactgaggtatttttcattatgtttaaaactgcttatgtttctttgtgaagtagaattttatttaagtattatgtttacacttgaaacagttataatttttctatatatttttcattatacgatgtcattatatggtatttaatgtatctagtacccaaccctttaaattttatttttgtacattaatgtacattaatataaaatattctcttcaaatcagcacagttttggaaactttgtttttattcttatttttggctataaaccatagagaattgataatcaataatgatttagagtgccacttaattatttgaacttgactatgaatttagagcatttaacaaaggatcataaagccatagagatatgtgtctgttttgtattagatgaagaacaggtaacatctcaatacctttgtgttgatgaaggcatgactaataatacacgacttagatcaagatagtggtgtgtgcatcatcctgggcctggaaagctgtcctttgaatatcattgctgatcggcagcaaagctatttaagttaaatgatttccgactattttaatctttgctggattctgcaaaatgaggtttatgttttgagatctattttgaaaagaaattatcttgaaatgctagtccatatttaaacacttggaaaaaaggatgacttagctggaatttcattcagtgaattctgataagttattagagaccaatgatcccgaatatccccccacaatgcttacataattagatactaaaaaaaatcaaaaatggttagcatcaatttgagaattctgatattttcataaggtaaaatttaaaaatatcatctatgagactctatgaaatgccacaggctctacattcaattatctttcaactatcctccaggaattttgtgcacttgcagagaatgacctagctacacggctgtaaaagtttaataaagtatttctagtgtgtatggaaaattcaataagtaacaaatgcactaaatacatgagcatgtagctgattaactcaaaattaactgaatgaataggagccttcctgaaattttaaatgtttgctgatgtgcatttttcctataaccagtccctatcacacaatgatgatgcctgaggcatgttataaaatatgaaggtaaaatggttactgtttggtttctgtttctatcatgtaaaatgaaataatttacctgctaacttaatcctggataaatattttctcaaattatttctactaaaaaacaagtttatttggggagtgtgagtttttttgttttttttttcgaaagagagcaaatatgggcatgagaaagacattggaacgctgatggatccagattgcaatatttaggatgtagcaaatgtactcagacgttaatgcttaaaaatcattaagaaaattgtggagtcaaccacggaagattatgtaggtagaattacttcttaacaacagttatgttaaggtaatagaaatgtcacagaaacatttgctttcctgggtggttcatactagatgagtagtacacaatattcatttcatgacatttctcctggtgttccttctttttaaggtgatttttaaaattttgataatttttttttaaatttctatatttatgtacctaaacactaataatttgttctccaataagatgcatttttaaagagaatctttacatatcacccttaagaaaataaagaactaaagcatttaaataaagatttcataaatacaaagaatataataacacctatcattcagaaaatgctttctagtttgcaaagttctattgcacatattgttttgtatgggcaataactgtgtcagttacatattatctgccccattgaagtgtcaattatgcagaatactctaaaaatcatggtctttctttttaaataattttactacaaatcagatcaaatgaaaagctaaagaatttcagagctataaattttctcactccctcttatgtctggagtacttttgaaactgaatcacaaatattcagacttataaagatctttcaacactatttagtccaaatcttacctgattaatggaaccctaatctacaaatatgtaatgggaccatcatttcagataagcataactcttttggaatacacattcaacaacatctctataagataaaagatgaacagtctaattgactgtctaaatgactatttgataaatctaatcattaaaattacctgatatttattcaggacaataatcagacattgtctgattgacatactacttaatgtagactagtgtctacaaattaaagctttcattcattagattttttgtactattttgtatacataatttaaacaaatatgagataggtctcaaaaaaacgattgatttttagtctaagattattaaatttaaagagcatgtatttcaacttcagagtctgtatagatttactaagacaatctatcttggatttttactttattatcattgtctggggaaatctatgttttggagaaataatgtgcattcttggttaccttgtgatacattgagaaatagcattgaaggtgagaaatgagcaaagtcagggtgtctctttttctgggcttctcgccttgcattgctgtgggttggctgcatgcccctgtcctctgttgaaggttacagcttctgtcaggtgacctccctctttgatgctctggtgaccacgcgccttactcctttaagcctatgggcagtaatggctccccactgtttctagctctgggcactgaactatctttccttgcttactcaaagcactattcatgctgttgtacttgcttctcataataccttgagaacaacaggtttcttactgggaccctgactaacaccaaggtgtatagttgagttagtgaggtgatttcagagtatatataaaataaatcggaaatcagtgttttatattgtggtccttccatttaatgtactaaaggtcttatgtaataattatcccttttgcagatgggcgcacagagtagcgcaagtgtacagagaaataaataacaatgaagtattgaaaattaaaatatcaatatgtgtttgtcttaataactcttctttgagtttaggccctctaggtttttttcggtatttatctgttggtttttttttaattgcatcacaatttttaaaaattgcataatacacatacgttcatatacatcatacataatatttattttcagtattgatgagacaatggaacatttgcactgccctagatgttcaaagaaatttgtgtgagctgacaaaaacaaattacttcaaggctcccatataaaacataaaaattcctgacagattaagaatttagtctaattttatatcattttaaaaatggaaagatgaaaataaaaatagaattttggttgctgttcaagtttcattttgcctgttgatctcactgtctcaaaacaaaacaaaaacaaaacacatacacaaaatgtatttttgtgtatcttcttcgttttattccggaaaacaatcaaggcaactaagttttcctttataatttcataaggaaaattacagctttttatttttcctttttgtttgtccatttgttgcttttcacatcaagaaaggagcctgagaggaaaagaagtaactgaaaaaaaattaaaaggctgacttttcttctagacttctattgaaacagctttatgattttttttgaataggcaatgcaaaacagatattttatgtctgctggatgtttttggaaatacttcttatgtttactacttataaaaattgtaatgtaaaaagagggcaacttgggaagacaaaaatctgtttactttatataatctttccacataaatctggcaaactttcaaagatctgcctctgcactgtagactgagaaatgtcagtttattttggcttccaagagaggtcagcttcctttacagatatgtcagcctgtggtcagttctctttggctggccttggtttttgcaacttaaagggcaaactgtatattttttaagtgctgcttgagaaattagccaattgcaatggccattttatttttcaacaggctttgctttcaaatgtgatgaagtaaacagccgtggagcagcatcatttcacttccaagaaagagaacattttaatactttagcttgtagtatattaaaaatctactcttttaaaaacatatgagttctttctgtttagtggtttccctggaattttctaatgatcatactttggtgttcaattgataataaagggtcacaaatgaattctaggtataataaatattacatgtgcttgcctctggcctctgtgttctgagaccacagaaaccacaaatatggagcagtgggagtttaggagagcagaagttgatccactaaataaagaactgatttaggcaaaagaaataagtaaatggtaggatgtgaattaatacaacattatctccccttagcagtggaacctttttttctaaatggaagccaatatataagagccttttaaaaacagagctgctttggatgaagtgggcagaaagcctaaagccgtgcctaattagtctctcctttcttcctatattggtaggagaggcaactcctcttgaaaaaccactgcagaactataaatcagtgtctccatatgtagccacatacaagaaattaatgttttaaacttccttccattgaaaactaatgttttcaattttatggtcaccaagtatgtgtaaggactgtcagtttgttcctactgtgttttgcttagaacaaaattcataatttatctaggatcctatggcctgcatatctatctgtgcttaatttttttccatactctgctcttccccacacaacccaataattgagtttgcctgagtctaactcccaccccttatgcaagtcttcagctttctctatggtgcttctcaggtatcttcaatgcctgctgggtagcgtccgataagcgttctctgtcacttctctaccatgcctcaccctgtctggtaggcatttgcaatctcctgccaggactcagtgtctctgcttttgcttagcacagaccttagtgtcatgaaggcaagctgtctttaagccagcagtgagactcccgctttcccactctatgtcacacttgtgaaataacagatctgctcatgaccgacctcttgctcctggaacataaacactttcttcagactctgtctggagcgagtttgtcctgaggccccctgttggacatcaagacaggcaccacatttctccatctttctctctggtcatctgaactccagacctcttccaccctgggctcccaaacaaaaatcctcctgcaaattagcttactccaatcatgtgtttttctcacatactagtttaattagataaatatgaatatttatttagaatcctttaaaatttttaagtacaattgataaatattcagaaggcttaattttaaatctttataaatgtaatacatttgggtggtattcattctgcctctcctttattgttttgataaccctcaaatatttcagtttcaaactcaagtttcttggaataagctgaagttattagagcaataataattatgcttaattcctttggtgtttacacataatgaatatccttaaccgaagacatgttaataaaatagcaacaaaaagcttattagcattgacattacttagatatcagtagataattgagatgtcatgaatgtttttcaccaaattgttacagactcctaccattctgggtttctgtaggaattgtgttactggcctactaatggttgtttggggttatatgattggctctggctaatgagttgtgagcaaaagtgacattgctcacttctgatctgagtcattttattgctggagtaagactgtgaaagtgtctttgtttctagcatggatacctgtacctaaagagaaggggctcctctctcagctgagttcttaagtgactaaaatgagaagagcctctgctctaagcctttgcctgtctatgatgactgtgaggcatgagcaaggaataaaacttccttttttgagacgctgagaagttaggggttggtggtgtcactacagcctaatctatcctattctgacatatctataatgtccagttgaggtggattggggaacagttgtggtgtgctaaaacgtgattagttacattggtgatgtgttctgtaatccagatgtaataaggtgatgggcatgtcagtaaatgatattttgggggaagaatgtatgcacatattccacattgtactctgaggtagctgcatatattactagcaaagcactctagaacccattttaggtatgatttatcaaaaatgatcttgttttagcctacttaaaattaataaatactaaaataagtacagtaattgtatatttttataggagactattctttcaacatttaaagatactcgagtttttctttattttaaaactacattagagagaaggttctgtggtcctttgttgaaccatgattgttacagaactaagagaaaaacatttattctagcatggtggttttgctgaaaggtaagaacttgtcctgttctctttttgtccttcctttccttcctgcctatcttccttccttttcttctcttgtattctttcgtcttttctctcttctatttctctcacagcccctccctccctctctccctctcttcctcctttgttattttactccttttttttgatacataggctataatttataaatgttggtctataggttggacattgaaataatttgcacggaatctgttattaatatacatgtaagtgtttggtaaacaaatatttctacaataggtcatgaggaacttgtaatcacttagtaagcactgcttcattaatcttaacaattttcttgtgaggttaattgtgtaacaataattaacatcccctttgagtaggtgggcttttgtcacactgagaagtattcttatctcccctcagaggcgggagaggaaaagtaggctgttgtaaactttaaataagactctgtgagttacttagtggggaggaaataattcttcccaatgtgagtggtatgctggcaagctttgttctacgtggctgtgccttccatttaatttcctggctttcttattctcaagaagtttggattatgatatgctcattaattataaaacagacttcagtagtcagagaatagtacacataggccattgagcaagtaggaaattaaaacaaaatgaaaaaataaacactttctgctttttttttcttcttatgtattgtgaagaaaatccagggatggagtgaattatcagtttagttcccacctttgtatatctgatctgtcacacacaaatccacatatacacttatatgtgaatatatggcattaaatgctcacaagcagtctatgcatatattatttgaaaagataatcatttttcaatagtttgagaatatattccctgttaaactgaatttactaactaaatatttactaaatatactcttaaccagggtgatttatgagatcataggaataacaaagaataaaaataccttctgcaaaggaagctttaaattttaatttgatttgtttgaaaattcacatgaagtctttgtaatcaatacattcagatcagtattctacgaatctttctgcatgtcagaaattaaaattttatttaggattgaagagtaaatcatttgccaagtaggtttctaaaagtgaaaacaaatgtcagtttcaaaaaagaacaatttagttttacatttctgaggaagtcacatatattatgtattaataaattaacagtctcacattctctttgatcattgattgtttcttggcagtttgttacatactagattctacacatctcacagctataaattcagtaccagaatttagggagataattttaatgtaaaacaaagattgttgtaagagacaacatgtcatagtgtttaagggtcagactccctgggttccagtcccaatttccagctctgtggcattgacacttttacacacttctctaaacatcagggttttgttttgtttcgtttttttgttgtttctgttttctgtgaagtggtgatgattttagtgaaataattggaagactgaatgaggtaatgcatgtaaaatacttagcataatgtttggactgtgtagtaaaggctcaataaatgttaaattccattaattgggtaatcctggaactcttcactgcaattagaattctttattacaacaaataaaattttgattcatcataaaaagtaatcaatttctttaatggacctcagagaaattaaaatgcctcctggactgttaagtcctcagaaatgtattgcatctttaattctttatttcctctgaatactcatgcacatgagaaaaaatttctaagttaagacatgtctattctcctttagtcctcatttcaaatatcaaccactgtttacagtatcaccactttttccttttaaaatggactaatcagttttatttagagattgtttgacaaagggtgattgccccaaatgatggtttcctgaagaccaggatataccaaccaagaaaaggcaagtatattttgtccacctaagtaacttcttcttctgtgtatttttctgcaaatatggatgttcctttggactagtcctttctcaatcatattgaagtttaaatatatttactttaattggtaaaatcaacttaaaaatctctattctgattttttcctaaggattggtatgcatgttaaaagtaaccaaagtataatttatgtcttggcctgtattgaatgcctttttcctcctgagcagagtcaattgaaaaatatcttgcttgctgcctccatttttaacatttattcttaggcttaatgtaggaaactagcaataaaatataaatccatattctattttttaaaagatcatactgttttattttcaattttatgaaacttttacttttagatattacaaacaagagaattagaaatgtgacgttagacttttaactctctgtagtcctttgtatttaggagagaatttggattagaaaaccaccttctggaggagattttgacattactgtgtgagcaaattcaggcaagtcacataatctcttagagagaacttcagtttgctcagttataaagatcaaaataatcatctgtaacacactggattatatggaaagtgtaatatacacgaaatctatttagaaaagtgaaaaccagcatgcaaaaatgttgttgtaattattattattgccaacataaacttgtaaatttgttcacatttattagtttagttcattggcctgtatgtatgtgaaataatggtccagtcctttgatgataaatatcacaaattgttggatagatttgctgggtttgacattttaaattaagactctgatattctgttaggaaaacatttatttctttggtttttctttttactttctatatcactggaagcaatgagtttcggcttcatattcacatatttcagagttccactcccaaccctgctttccactagtatgacctttggcagtttgcttcacagtttggttcatagaaaatatgaactttattttctgcatctgcaaaatagaaatcatatctattctttcttaatatagtctgtaccaaaagcaatattaagattaatgcacaaataatgcagaagtgggaagttctcttaattcaggttttttaagtaatctaaaacgttgttttaggctgcccatagaaaatgaagtataatgacttcgattttattcaattccagttttactcatctgtagatgaagatcagaaatataatgagttgctttataataggcttccactcttacatcaatcagacaagcagcctaaaaataaacacatcctttctgtccttgtgtttcctgggaaagtcaagagttagcattaaaggaaaatgagtacaaatgaagatttatcaaaaaatttccccaagtgctaaaaacaaaaatggtctgggagatattgtagttttacagaactatttgttttctgtagggggcaaaggctatatataaataagcctaggtctcagtgccatgtcatgtaactaagaattaaatgtattagtctttaaagaatgcaaatgaggtaaattttacatcagtaaaaatttttaaacagacgaaaatatggaaacgtgttaacagagcttcaaaattttatgctatgtttttgaatcagtcttgaaaatactacagattggtgtctgtcctcctctgcaggtgataggtgggactatttcagaggacaaatgtgatcaagcagctggccatggttttgttctgatgggattactcagcaaatttagtagataaactaaacattttcctattactttctacttaaaatacttactcaacttgtaaagggttttatcaaaccttagactttgtaaacacttttaaaaacactcagttttgtgcctttgaacaagtgtagcaaaattaataggtgaatctatatgcaaatttgtatagatctttgcttaattcaggtaatatcagcctaatatatctattttgattaattatgtatttgattaattaaacacaactggcattgcacaacttaaccccaaatgtataaacttttctgttaacctggcatctatgggaaatggctattttagtaatccgttaatggaaatttaccatctgtagtagatattttgagaattcaaatggaacaaacaacagactactaagcccatactttgtatttatttatttgtgtatttcataatcacaatactaatgaattattcctgtgtgtcagataaaattttaaatattaactctttcattcttcctaagagccccatgagatagctgttattattacttttgttttctggatgaaaagactgagacacagaaaagttaagtgacttgcatagtatcacattgagaagaggcagagctgaattcaagttcattctctgagcccttacactataccaccactctgtaaagatacatataacacaatattagttaaaaactcaaaaagaacttagcttatcccatgttttgtaactataggacgtttcaaatagaaaaatatatgtattttaaatcctgcaaagtacatctccagatatgcttagtggcctctgtctggtaatgtttcttccacctagtgttttccaagctatagcctgcatgtatcctcactaataaaaggactttcttctttaaccaagcctattgctcaaagaattctgcaatctcatctctcccaggaaacctccaagtgataaaaaatggagtattgatttcgacctgctatgagacatgcaaagtttactttttactcactaatacaaagttttttggattgctacattttaaattagtatacatatttatttagatataagtttagtctatgtttaacattttgttttagaaaaatttaaatgtcttaggttacaggggcatagatgttaaaggctttgctgtttaattaccttgaactttacttagcaccatattaacacaacgagctgcttaatcttttctgtaattatgattatagaagatcaaaataaaactagaattacaattatcttttaatgattttaagttggtaagatgtcatttctactagacaaaaataatttatagttagattaagcatctctagtaccagaagatacaggatacctgtaaaagaaagagaggtgaaaagttcattccctggcttagagaatattttatttaatttttgtctttaaaataattttcataagttcttttgtaactctcaacttttatttacctgagaaccaaaaataaatatcctattagaaaaaaataaatcctgatccattctaactaaaataatttttttgtgctattttcttaattgtggtaacactcaattactgaaaatcaagctgatgcaattttttttaaatgataagtgattcaatgttttggggatgtgacagtttcctcagaggaactaatcaaaacaaaattatttttcttgataaaaaacagctacttcattttttctaaaaaaaaaagacaattcagagaacttatgtaggtcattgtcagtaaaaaaataggaaggagaaaatataacaaaattaattatctgtaaagtacataagatgatttaaagtttcctttttttcttatttattttgttttcttgaatttatttcatatttatatatgcgaagaagcatatttccccataaatatatttagaatgacttttattgattttttaatgtaatttgtaactattacatttatattacaacacaaatatatatcctgtcatctctaatatgaattatttttatatgttatctttttaaaagttgtatttaaattactccagaattcttatatcatgcgaattatgtgaaaggactttaggtacacgattaaaaatattctagcatttgcataatttaacagattaagaagaagaatttagaaaaccattctagggcaatttacttgttttgaacatctggttaacacctggagtaatgaaacttaacacagcagtaaccatcttttacactgatcctccatgcacacacaattgctaggaaggattaactactattaattcttgctttcttttgccatagtgattttccttgaaaaacaaattgagaatcctttactgtagaatagctgaaatttatatgcataatatgaatatcactgattaaaaccatacttcaatttaatataaatgtgacaaagaaagccggttcttgaagttaatacagataattatgatagaatgtccttgaaattcgtataagcacattttaggcaataaacaatattatagtaatagccaatgtcatattcagcagaaattaatgttgagttgactagataaagactaggctcacaacttttcagatgtttaatatatttttagattatatattttataatatatttcatataagtacagtattaaaatatattttaatattatgtgtttttaccttttttagtgaatcttttttatgtatcacttcctttttttttcatttagtatgttgatactttgggatactttcaatggaaggtgttaaatgagcctgcattctcagatcgcagggaaaaaagttacttttctaagttaattttaaaaatgaataatcattatacacacaattaccttgtgtaggccataccagaagttaatgatgtgaattctcctttcaaggtacaaatgattcagagccactcaaattgatattccatccttttaaaattttacttccatatatccaaatttctaggtatattgtaggcttatttaatagaatgacaataaagataagattgaaacacttgtaaagtaaaccatgatggacttcttttaaaatgtctcatctctagctaaatgcttcaattacatagcaagggatgttgttttataattactcttacacagtaattccaatttttaagatcttatcaacaaataggattgagttttgccataagtttcttgtcttcagcaaaacgttaatttaactcatgctatgttacaatagttgtggatggcaggcatgtacacaatttatatgaaataagctggataaatggctgtcagaaaatcatgattcttagtgttttccttcttcttagtctaaaatcattttgcaaaaattatgtatttgtatgtatttatttataaatatataattactaacatatataaagcatcacagtgaagtagtatactatgagttcaatgattttatatacaaaaaaatgttttttggaccttaatttttcaagaagtgcctctaggtatagtattacatgagatagtaatggcaaacaggatttatttgtatattatattattagccttcaagtcagagccactgaatataaatagggaatatatttaataaatacccaaaatgagaagattatttaaggtttttgccattattgggaagaaacaaacattataggtggccaaaatatatatatatatgtgtgtgtgtgtgtgtgtgtatatatatatatatatgtgtgtgtgtgtgtgtgtgtgtatatatatgtgtatacatatatatatgtgtgtatacatatatatgtgtgtgtatatatatgtgtatacatatatatatgtgtgtatacatatatatgtgtgtatatatatgtgtatacatatatatatgtgtgtatacatatatatgtgtgtatacatatatatatgtgtatacatatatatatatatatatatatatatatatatagttatgacctatggctatttggatttagattggactttcaatgattggcaggaatataatttgagtgaaagaaacagctttaaataaagctaaataaataaatacaggctaggcgcttttgattttaatctaatggtagtgggggaacttcagaaggaatttgtgatcagggtggagggagacaggcaaatagttatcatgaaggaggtagaggttgagtgaaatttaagctagcaaaattagactatctgggaaggggaatagggaaccagatgccttaatgggaccatgatgaggcttctgcagtaatccaaaaataaattgattacaacagaagtaattgaaaaacaatgatgaaaagcagtgtgatcagtttgagacatttaaagtgacaagggatcataaattttttaaacaaagtaccagagggaaataaaaggcttcacttttgatgattgtgatattggcacaagtcaggaatttgcaaaggggagctggttcaagtcgagccaagtatggtgcagaaatgatgagtgtgaggttttggcagataattaaattggcaatgtcctgtgtaaaaacaaatagaatttgatattatagctctgtcacttaatggctatggatttaccacataacaaattaacaaatctgagcagcttagaatagtccttttcatgtaattttagtgcttactaattttggggaaaatatgaaaccattggagaggggagtctaagttaattttcagaggtaaatttattttacattatcaataagaaaaataatctaagataaagagagaatttaagtgaagttcccaggatagggcgagattttgggtattattccaatttagtcaaatattgaaaagaaaaatcagaatactgaggcttaagtaaggaatgttttgtgaataattaaagctgtggtcacaggtcatgcgttttagaagttgtattaaaaattataaaaaaatttctttcaatatctgttaaacaattgctttaggagtctgagttaaagataaaagttgtattctagtgtccgtacacaaaagtgataaatgagtatatctcaaaacagtattagaatataaaattcatctgctatagaaactttagaacacaatgtatcatctataaaaatattatttgtagctttaaaaatcagttatgcatatatgttaatgttatcccaagagaatcatgaaaatagtatttagtgcctttctttattgactcgatttgacaaattaactacaaaaccactattttggaactactcacttctaaggaaaatgggaagacaaaaaaaattaactcccaaggtttccagaattgctattatttatattataatatatagtataagtttttttctgatattatataaactttttggttaaatagataataactttctagtaaacccattacgtcagctttcaacaatgttatatggaagtcagctttcaacaatattatatggaaaagtaaatcgaaatacataagataaacatttaaacaacttttattttattttgacttacctctgttatttcaattcattttcctaaagtttcataaataaatacaaagaagactaaattttgagtaagaattttcattgcatttgtaaacaataaattatagtttgtgttcatcatataatttttagtactctgctccattagacccattttgaaaagttgttggaagtgcttcctgatttttgaatcaagctttcatttagattttaaaaatgtgtgatttaccaaatttgcataataaatcatataaaatacaaaattatattctagtacttgaaaaatatttatattttattaattatttttggagttttaaacttgagattaataggataaaaatatacatttgaatttatgcaaccaattttgtacctttttaaattgtgtatatttgcttagatctgccattactatccatgtgtgttttgcccatagaaggcaatgcattgtagaacttcagggttaatatgaaagaaatattttgctttaaagaatcgcctgcttcaatttttgccttcattccttaggagccatgaatagaaacttttgaagctttgaatagaaataattttaaagtggcagaaattctacaactatcaatgagcaagttgccttgatttcatcatgacttaaatatgaaaagccgaagagagcatttggctttctactgtttcttcttcatctagaaacttcgttattaaatatgtgaaagtcaaatatgattcaagtattttagcgtgctacacattgtgatctttagagttacattatctataaattacaagtagcccaactaaaacatctgcagtgtggtatttttgtgcaatttaattttcactaaaagcatgagagtcaataggaaagtcaccatcagcaaaattgaattcagaaatttcattcatgggataaaaggattattttaaaatgagtcgaatatgctgaatgatatttgtcgtttttaaaatgataagtgttctcatttgtcttaatttacttttatttctcatagcatcctacatttttagaacgtaataaataattttaagcacattttttatggtaacatcattactgaaagctgatgtaccctcattctcaaataccgatttttttttagtagtatgaaaatgtttgagatgtgtttgatattatatttaggataaaatattgttagagattgaatgtttttgccatccttcaaattcatatgttgaaatcctaatgctaatgtgatgatatttggagctggggactttgggtcacaattagttcatgagaatggaactttcgtgaatgagattattgcccttacaagaagaggtcaaagagctcgcaagttctctttctgccatgtgagtcataaagaagtcaatggctaagaacatggaagagggtcctcaccagaacctgactatgctgacaacctgatctcagacttctggctcccagaactatgagaaatacatttcctttgtttatcagccaccaaggctattgtgctctgttacacctgcccaaactgactaagatagatacctctgaatcctactatttttatgctcttctggcctatataagaaagttgtgcagagagttaagcgtgcccagggattcacagtggtagaatgatgatttgaacccaggctgtctccagagccttcaccactgtactttactgcctccaaatatttgtctgaaatattgcataagggagggtgaagggggcttttggagggaagtgagcacaaggagagtgtggctgacagtgagtggactgcagcagcttccatcagagtttagtcttatacacattcttactcaatctttgggtgggagctcatctctcagtttttggtgttcatgtactgtgtatgtaattggattcgattctttaagtcacgagatctctcccctcccaccttcaccaggcttcaccttcagccttctttactggccaagatactttagggaatgctgtccttcttgaaaggtgaagagtgaaggaccactctttatcatcacttctcatttcatggtattttgtaggttctcggtgctctacacgttcagagaaacttctctagtaacaaactatagaaatgatccctgaaagtatagtcttggtattttgtaggttctgtagtttgtgttttggggtcatggtattttcatttctttgctgtaaatggatagtttttctttctctttatatttgttttgttgtgccaattgggtttcaagagttggaagaaaagataaaaaagatgctaattctttgaagtatttaattggagtccaaaatatattcctcaaaataattttatctaaattaacattatcggaccttaggtattttggtataacttgaatatctctggaggaaaacaacaacaacaataacagtgcctattgcacagagctctgttggggtttaatggagctgaccaacatatgcaaagtgtttagacaagtaccacataccatgatagttacacgataatgttaaactatcatgaacatcatcattgctaattggggcttcatttttctaatattaaatatgtttttgcttggatatctctttaaattcttcaaattaataactataaatactttattctgaatatactaattagggaaataaaatatttccaataatttatacttatgatttggattataagttaacacctttgtattcatgtacagagctcttatgttaaatactatagtaatataaatgtatatcacataaacatcctatattagtgtctaaattttgtaatcccaagattagcagtgcagtatgatctcttagaagtttatctaacatcaaatgataaataaacataatatttggttttatatagtgacatttaactattttggtgtgcattccatttggaatatattcatgggatttatttacctctgaccttaggcgagacacttcctatctttgagtgtcatgttcttcattaataaatatctcatagacaagatctcgaatcacaaactagcagacctgagtctacctgaagaaacattttgatgtattagctcagtgtttaaggcatgtttgaaacttaaatgctttcagtcagggcatggtgtcactagttccttcagtctctgccactcagaattagctcatgtgtagccacttcatacatttatgctagttgtgtgaccacggaaggaatttgagattttggctcttgacctatatctctatgttctcttccaccattaaagttgtctattcatgtgactgttcccatttagaagagagttgaacaaatgggtcctttttcaatccacttgtccctatcattacactttttgatggatacctgtaattgtcctagtcccctcagaagaaatgctttcttctgttctgttgacacgcaagttagtcataggtcccagagaataacattgtggtttttgtaaatgctcattgtaaagtctatcaagatattttgagaaaaattttattcttaatttctctgaaattaagaattataaataaagtagcaaattaaaattctaccttatcgtctaattttgtcattaactatttttatttcttcttagaataatttttgaaaacttattaatgtcataactagaacttattttgaacttaataaatgtagttggatgacttaccctaaaaaaagaaatgataaatgaccttgataagaaatacatggaattttagtggccaatgattgagataatgggataatttaaaggaaagtgttttgtactctctgaaaaaaagtatcatatccaaattaatgtggttatttttagttctctacaaatatgaagttgacccactattcttagtattaataatactacttggaaaattgtagttgtcattcagtagttgtaatggattactgtatagtcaaactgcattataaaccatgccagaatatatagaattatattatatatagaacatagagctggtacttttttaaactttaggggaaaatgtaatgtaacttttataaaatataaagatcaaactggtatcattggctaagttcaacttataatcataattgtagaatgattagaaacactcccattacttaaaaggaaggaacttgtaagatttacaagtgattatttgttcatagtgcaattcagctagaaatttaatgttatagatttaagcaaaaccatcaaagctacctggtggtttcacagttctactaaacctggatgtgcatgctaaaatgctaattcataggtcttcccctgcttagtgtctatagttctgtgtcttctctttaacctaatattataatcttgaaagaaattttaggaatgattccagtctgaatttatatccgtagaacctgagaaagtcaaacaatttttagaataatatgtgtttcagataaatatttacatcagtataataaatagttcattcataagaacaaaatttcataactaactttcttccaggaaaacagaaatttctgagactccaaggtttttttatacctaggatcccaagctgcatgttgttatttttgccatattctatttgtcaaaataactattataacaaggccagcccagattcaagagtcagtgaaacagagctgtaaaattttcttgccatgttttcaattaactatatcatgtgatatactttggccactggtacactgaaaaatgtctgcgactagggctagtgttctggaaaataagagaccacaggagagaggccccacatttagaacaatcccagctacactgaacaattccagccacaccagcctcggacctacatatatgaccatccagccctagcagaacatcctggggatcagaaccaccgagccaagccacataaccttgtgaaactataaatgttgattgtttaagctactaagtaccatgtagtataagctaactgatgataatcccctttcctgcaagttagagaacaggaagttaccatgtagaatattggttccaaactgtagcagctgctagagccaaaaaactgaagcctcatgctaaatcttttcataagcatcaatagtggaatgatcccccaaaggacaaaatgctttcatggccatctttatggcagaaaaaacatctctctttcaaatcttgtataacagtgtctaataagctgaaactaaatcacatccggaaccctaccgacagggaagtctgcaaaatgtagattttagcccttcaaaattgacagcacaggaattcatattaggaagctataatagacagtgagctccaatccatcatatctgctataatcagcacaagttctttttcctttggtaattgtattcatttttatggattttgaggatataatttcctatcagtttaatgaagaaatatgtcaaaactcatattcatagttttttagatataggaaataatttattttcaaattgtgaactaattaacttgtatgccaagaaagatggtgtttattctctaggaccagagttccctgtaattttcttaagtttggaatggtgggaaatgctcttctttccagtcttcatcctcatcgcctgctagcttactgttaccactttttaatgctttaaggcccatatataagctattacctttactagaacctcgagtttcttttctctctacctccaaagtataattaacacatacccatctttcacttcttaccctaagtatcactttctggaagagacttctccggactcccccaaagttgatcaggttctcttgttacaataaggaaaactttataaagtaatcatcccgtagcattgtatatttcttcctgtggtctggtgaataagagatgtctaaattaattttaggatgggaacacctaacaaaggagctagcactgagaaaatatttgtgaatgtatgtatgtatttatttttataatttttaaaaaaatgtgtgagcgcatggtaggtgtatatatttatgggatttatggaatacatgagatgtttccacaggcatgctatgtgaaataaggacgtcatggagaatgaggcatccatcccctcaagcatttatcctttgaggtacaaacaattcaattacactcttttagttttttaaaaatgtacaatgaaattattattgactacaattaccctgttgtgctattttatagcacaacatctgttctatttcttattcatttgttctaactatttcttttgtacccattagccatccgcatctacccctcaatcccccactacccttccctgcctctggtaaccatccttttactctctatgtccgtgagttcaattgttttgatttttagatcccacaaataagtgagaacatgccatgtttgtctttctgtgctgagcttatttcacataacataatgatctccagtctcacccacgttgttgtaaatgacaggatcccagttttttatggatgaataatactccattgtgtgtgtgtgtgtgtgtgtgtgtgtgtgtgtgtgtgtgtgtgtgtataccaaattttctttatccattcatttttttgatggccacttaggttgcttccaaatcttagctattataaacagtcctgcaacaaacataggagtgctgatatctcttcgatgtattgatttcctttcttttgggtatatacccaacagtgaatatggtagctcaatttttagatttttacagaacatccaaactgttgtccatagtggttttacaaacttacattcccacccacagtgtatgagacttccatttcctccacatccttgctagctgttgttattgtctctttttgatataagccattttaactggggtgagattatatctcattgtagttttgatttgcatttatctgatgatcagtgatgttgagcacattttagtatgtctgtttgccatttgtgttctttcttttgagaaatgtctattcaaatcttttgcccattttttgattgggttattggatttttttcttatatagttgtttgagttccttatatattctggttattaatcccttgtcagatgggtagtttgtaaatatcttctcccactctgtgaattgtctctttacttcattgattgtatcctttgatgtgcagaagctttttcaactggatgtgagcccatttattttgccttggttgcctgtgcttgtagggtcttgctcaagaaacttttcactcagaccagtggccacaagattttccccagtgttttcttgtagtagtttcatagtttgaggtcttagatttaagtctttcattcattttgatttgatttttatacttgatgagagacagggatctagtgttgttgttctgcatatggatatccagttttcccagtaacattttttgaaaagactgtcttttttctccaatggatgtttttggcaactttgttgaaaatgagttcagtataggtgtgtgggttctctcttctgttccatgagtctatgtttctgttttttatgccagtaccatgctgttttggtgactatagccctgtagcataatttgaagtcaggtaatgtgattcttccagttttgttctttttgcttaggatagctttagcttttctgggtcttttgtggttccatacaaatttttggatcttttttctatttctgtaaagaatgtcattggtattttgatagggatttcattgaatctgtggattgctttgagtagtatggacattttaacaatactgattccttccatccatgaacattgaatatttttcaatttttttggtgtcctctttaatttctttcatcaatattttatagtttttttatggagatctttcacttccttggttatgttaattcctaagtatttaatttgatgtgtggttattgtaaatgggattactttttaaatttatttttcagattgttcactgtcggtatgtaaaaatgctactaaattttgtatgttgatgttgtatcctgcatctttactgaatttttatcagttctaattgttttctgggggaatctaggttttcctaaatataagattatatcatctgtaaacatggataatttgacttctccctttccaatttggatgtcctgtgtttctttctcttgtcggattgctctaggtaggacttctaatactatgttgaataacagtggtgacagtgggaaaccttgttgttttccaagtcttaggggaaaggctttcagtttttccccattcaatatgatactagctgtgggtctgtcatatatcacctttactgtgttaaggcatattccttctatctcaagttttctgagggtttttatcatgaagggatttcgaactttatcaaatgcttctttcagcatcaattaaaatgatcatatggcttttatcttttattttcttgttatgatgtatcatattgagtgatttgcatatgttgaatcatctttctgtcccaggaataaatcccacttagtcatgatgaatgctctttttaatgtattgttgaatttgatttgctaagattttgttgaggatttttccatcaatagtcatcagagatattggcctgtaggtttttgttttgttttgttttgatgcgtctttgtctgattttggcattagggtaatactggccacatagaataagtttgaaagtatttcctcctcctctcttgttcagaatagtttgagtaggattggtattaggtcttctttaagtatttggtagaattcagaagtaaagccatgagtcccaggattttctttactgggagatttttaataattgcttcgatcttgttgtttattattggtctgttcaggtattggatttctttcttgttcaatcttggtaggttgtatgcatctaggaatttgccatttattctaaatttcccagtttatagtcatttagttgctcatagtagtcactaatgatcttttgaatttctgcagtatcaattataatgtcttttttcatctctgattttatttatttgaatcctctctctttttttttcttagtctggctaaaagtttgtaaatttgtttaactttccaaaaatccaactttatgtttgcttgatcttttgtattactttcttcatttcaattccatttgtttctgatctgatctttattatttcttttcttctactaatttttggtttgatttgctcttacttttctgattctttttttaatgcatcactaaccggtttatttgatgtttttcttcttttttgatgcatgcacttgtagctgtaactttccctctgagtactgcttttgctgtatctcattggtttttatatgttatgtttccactaacagttgtttcaagaaatttttactgagaaaatatttaataaaatttaacttaatgaatggataaggcccttttatattccaagaaatatcttcatatttacctttggtagcaaagatcacagggctgcctggtatacaggagtgcgcaatatctgggttgagcttaccttgaaatgagattactgtctactgcagagtttgatagttaagattatgtgtcaagttggctagtacatggtacccaggttttggtcaaacactagtctagatgttgctgggaaggtatttttttaaatgtaattaatatttaagttagtagactttcattaaagcagattactctccataatatgggtaggcatcatccagtcagttgaagccttctgagaaaagactaaggtctcctcgcaaaaaagtacttctgcttccagattgtctttgaactggagctgcaatatcaactcttccctgcatcttcagaccacaggaatgccctgcagattttacacttgctagcctccacaattatgtgagccaaaattccttaaactgaatctctctctctctctctctcagtaggtgtgtgtgtatacgtatgtgtttgtttgcatctgtctgtgtgtatgtttgtgtatgttaggtgcaataataattaaatgacaagaacgattaaagtcaccttcaagggttcgaatgggtataaaaataactgaaaataagtagagattcttatccttggtagataagttccctcatttccctttctgactaatagacagcatagaaggaagagagggaagtaacctaccaagttcaagaatctttatttactactagttatttacttctcatacaaaccctgggaagtaagtttaattactattgccatttaacaggagaaaaactcactcccagaaaagataatatgtacagcagtgtgtggtatgaagcaatgctgaaaactcagtgttatcagtctccataacctctgttattctcagattatcttgctacctgctgtttgtgagaggaattgtttgactatccttgtattagctagaaagagagagcagtgtgttcctgaaataaaagagactctggaaactagaagagggcaaaagataaaaccttaacatgttattggaaacctacataattgtcactggggttttactagcaatctttatcctgctacttcccttaatttcagagatgataaaacaatttccctggcttttttttcagggcttttttccagacccttattttttgttacccattagtgaacttgggaaggtttttatttctaaatttagtgcctaattctcctgaagcaggtttcacatttggatatttcattaagattgtcctgggacaaatctttgtccttcaaatgcagagggaatagggactatttacttcctattctgctatctctatgtgcctttgagtgagaacaattactggaagagttgccaaaattatagtaaatttaaggaaatttaaaataattagatttcttatactataaaataagggacagccttcaaagtccaaagccaaagtcatttctaaagatctctattatttagaagttccctggaaagcatctcacacctatttttagaatcataggatatgatgaccttaagacactatactagaggcaatttatctgaggctgtctgagtggttggcatcttatacagttagagagagaaaggattttctgatgttaatagtgtgctttctttgattgatttttgtttggaatgctgtcaaaatattttaggtaataacatgaattagttgcaacgtaacatgattttaaaagctaaaaaaattttagacggcatgaaacattgtaagacaatagaagggaatttttttgccacaaatagtgataaaaatattatacattaaaaatgcaaccacttttacacaaacatgcataaataaatgtactagatgtcacaggggaaattcaaatgaaaatcttatttttctatttttgagatgtttaccacttattaggcgtgacaaagcaaatacaaaggaaatgttagaagaactagaatttaatcacagcttgaaagagctataaatacggtactactcttggtttatcatgcaaagggaaaatcgatttcaagtccaggtgacctatgagctataccttgaaggacattttgtatttcaacatgtttagatgtgctgaaactcttccagaaagaggtgcagtctatagagatgcaaagaacaaaaggaagaagagaacggcattcatttgaagccaacacaaaagcagtagctgaaataatttttccagagtgccacagcagttaagtaaaagaggcaaaatttaattcaaaatgtttctagttccaaatcgtatgtttttctaaaactgtattgggagagcagaggaacatactcagcgttcataggttctacctggagtatagggtgtggatcagtgtaaaatataagatagggaagttaaagattatgttttggaccctggttcaggggatgtccttactgtgtctaactgatgtgtttcaggctcttccttcaatatgtattgcgaatagtgagatttattacacagtcctaacattgatgcagtttagttgcttgtggatggtgttgtcaggaaaaaaggtaatattttcttctgaactcatggttagaaagggcaggagaagctggaagtaagatatcctccatcctccttagacatatttacatcacctcttccaggtttgcatattgcttacaatcaatacagagaagagaaaacaaaggaaatatgtgataagttgataaattactgctacaaaatttaaattctggccctaaagcaataacaaagtagaacatagtgaaacaagtacacaaaagatttaaaactggggatacagaagttccaaagcaaggagaaaaaaggaaattattataactggacttaaaattcaaaaaaatggtatttagaactaagaaattaatttgagtgaaattaatgttagaataaaaataaaattgaaatcaacatgagggaagagtctaaagcatgcatatatgattgaaagagcaagacaactcacaggaaaagctaaaaatcaagtagaagcaagattttgactggaaagaagcagcacgagtgaatggatggaaatgaaaaaaagatctacagagatatccactgcaagaggagttttcatcgccagggcaccagcttctccagttaccttcccctgtaagtgggaccacaggccttcctgtggaagagccctcagtgactaagcagcatactctgcttttctcatttctccctagtggcgaagcttcagacagggtcttcagtcattctcttatttggaaacttctcccaatcatcaaaaccccaaatgagtagaaattgaagaatccgctttttatgaaaccactgctactctaatctttttattcttgtatttttctaattacatatatcactatttacctccattttgtctttcacttacaatactatttgcttttctttgcctcattttaacatttggataaaaaattatttgtatgtatttacacaaagtgcttcaacttaaatagtactgttctttaaaagagagaatgaggcctggcgtggtggctcacgcttgtaatcccagcactttgggaggctgagacgggcggatcacgaggtcaggagatggagaccatcctggctaacatcacgaaaccccgtctccactaaaagtacaaaatattagctgggcgtggtggcgcgtgcctgtaatcccgctactcaggaggctaaggcgagataatggcttgaaccggggagtgggaggttgcagtgagcccagctcgcaccactgcactccagcctggcgacagagagagactctgtctcaaaaaaaaaaaaaaaaaaaaaagaaaaggagagagagagaatgaagttgacttcaaaaatttggttggttgtttcttaaacgaaagcctgccatttttgtggatggtattatcgttccagaatgctaatgcaataacgacattgcaatgaagctaattcatagccagagaactgctgtttaagcgactatgttgtgaatctctttcaaactacatttttatgcacgttgtttttgtttcctaatatttctatggtcttgcatttccagctagactgtgtaatcccttaggacagggacagtatattttatgtccttcatagctctttgtagagtgctaagtaaaatgactttttaatgaatgtgtggtgaattaatgatacagttcttatgtgcatataacaggactcatgtggcacctctaagttaccaagggtttcaagttaacctgcagttaaacgaaagtgactagcttcttgaaaaaaataagctttttctaaattctaatagtccctaatcaaatttgcaaaacagacaagcaaaaaataaaaaaacaaaaaatgaataaaacacagttactcaggagccagccatttcagaatattgtttattcaattgcattttgctgatttattccagaaatcttaaagaattcctgtgtagtgcacatcttttcattttgacagagatatacataaagagtaaggattccatacattactatttggcaagaatacgtactatattggcgaggttccgttgtttattttattcagatatttgtatttcttaaaaggcttacatggaatactgtgtgtattatgtaaaactgaaagttcattcttcatgctgcatatggttttcttttcctaactagtaaaagatgtactgtcctcagtgcatttatactggctctggttcaatgcaaatctttgataacttagttttcttaagagttattttaagttgtttacttcttgtcactgcagactagcttagaatctgcttcttgggatctcactactttgccattatacagtctttctttcccccaacttgaatgtttcaatggatcattcagaatttatttataaatagtatcataggaatttttttcttttttttctttttttctttttttttttttttttgacaggtctcactctgttgttcaagctggaatgcagtggcatgatttcagctcactgcaacctctgcctcctaggttcaagggattctttcacctctgcctcctgagtagctgggacgacagacgcgcaccaacacactgggcgaatttttgtagtttttggcagagaaggagtttcaccatgttggtcaggctggtctcaaactcctgatctcatgatccaacacagggctaatttttgtaatttttcatagagagggagtttcgccattttggccaggctggtcttgaacttctgacctcaagtgatctaccggcaaaagtgaggaatttttaaaggactttcaagttatgatcaagtgggtgctacatgaaaaagacatccaaattttcttcatttactttattcatgaatttttttttaatttgatgagatatcaccctgtaaaaataaccatcttgataatccattcattaataaaaccttagaaactgccacatttctttagattatgttaagtcaaaagacaggccaaagtatctgtgctctctaatgatcttggtctttattttcttcaccaatttaaaatacactttcagggcctgggtactgtggctcatgcttgtaatcccagctctttgggaggccaaggagagactctgtctcaaataaataaatgaatgaataaataaagcactaggccagcgtttccataagacaacatatgcagccttatccatcagtattaatgaatccatccatttaaaacctcagtctatactgaccacagtggctttgataaaaacaggaaggtcaacattattttcaagtgagaaaaaataaacaacaatcaacctgaggaggcatagccttctccatttatcacaagtcccacccttcccggaaagtatgatgcagagaccttgtccaccccttcagcccctataaactgttgagcttgtgatccttgctttagaacatataaaagacaggtggatagaatgaaaaactgtgaggggtaatagctgacttcattcagaatatgggtgtaatcaaaggaaggttggatgaagtaaatgatctgaaattgaggaatatatccaggtttagatcatttaaagaattcctgcctttggatctaacagccagttttgcatctatttgtgtgtgtgtgtgtgtgaattgctcatattcatgtaatttcactttgatttttgttacgtaagattgatcgtattgttataaaaataataacactgtattgattccaggattcagtgaaactcttgaatttaataattaaaataataatgctaatagtagtaataacaatatcagagaaacattataatgataataaaacatttcaaaaaggatattacttcaagttgtccaatgacttacctgacatgttttgaagttatgcacacaaatacaaatggtggctttttgtaattcaatttaaaaaatttcttatcctattttactgagttattctgatttttacattctataaattatttctctttcagatatctatcctagaattctctaatttctaaattatataggagtcatttgcataaaattcaatatttgttagatataaaaatattcaagtctagacaaaaaaaatcaaaatcaattgtgcactagtttgggtaatgtttgctgctgtaataaaccccaaactgaacacaatagaactttatttcttgctcatgtaacagttcagtgaacgtgctcctgctttgtgggtggcttttcttcattgggtggtgcaaggattcagatttcttccttgtggatctgcacccttaagggacatagggtctcttgaattcaagtagagaaaggggaacgcttgcacagaaggcacactggctcattttggaatggaagagccacttctgctcacaatttcattggcaaaagtagtcacatggccacacctagacacaaagagtattggtaaataaagtccctggctaggtagctgcttttcaggaaaaaaaaaatacatgaaaggagaagcacaaattttggtgggcaacgtgccatccaccacaggcagtcttatctgccagcattaatgaatcattccatttgaaatctcagtctatattgaggtttagactgaggtggcttaggaaaaataagtggctctgataagcagggccatctttttttttaatagagaaacaagtaaaccaaaatacactttagtgatatgttcaatagaaaagcatcatttaaaaattaatgtagtatatttttcctatagagaaataattgagaacagtaaacacttaaaaaatagtcaaataacaaaaaatgcttttcataggttgctatggtctgaatataacctcttaaaattcacatgttgaagtcctaatcccaacggaaggtattaggaggtagtgccttcaggaagtgattaggtgatgacagtgggattagcgcccttacaaaagtggactgagagagactccctgtccctttcactatgtgaggacatagtgagaaggtgttgtctatgaaccagaaagttggttcttgccaaagaaaggatctacctcgaagttagatttctagcctccagaactgtgagaaataaatttctgtcatgaataaacaacccagtgtgtgatatttgttatggtagccttaacggactaagacacaagtatattgttgtcaggtaagtgtaggaggaggaaagaagaatgcaactagaaggaaaaaaaaaccaatacattaaggaacagaaaaaaaaagaagaaagcagaaaagatagaggcagtaaaaatagatccgtacaaagtaagcagcagggcaagagagaggagaaagagaccagtagtgcacagggtagagagaggcaggttttgaagtgtgtgctgaaaggtaggcccagctatgcactttggtaacggcctttagagcattttggactcttcatctatttgaactgtggtagagctggttaaccttgctgagagctcttcaacccctttaatcccaaagtctttgaggctccactctgaatggaataactagaacaacccaacaggatagaatttaatttctaaacctggctatcagcaaccagaagagctacatgatatcagtggcaattggtcttatagttagttcattcttcctttgaggcatacattcagataagtaggtaaatcatacacatgtatataaaataggtaaataatatataagtattaagatctctattggacttggaaattagattagttttagagcagcattaaacaaatactcaaaaatctgtcataaatgtacttaactaactagcttttaaagaaaaaactggattgtgtgcctccatgtcttagtctattttgtgttgttataaaggaatactggaggttgagtaatttataaagaaaataaatttatttggctcacagtctgcaagctgtaccagaagcatgatataagtatctctttttggtaagggcctcaagaagctttcatcatggaggaaggctaaggggaataggcagaaagaagagggcaaaggagagtgagcaaagaggtgtgtcacctttttgaataaccagctctaactaatagagctagaatgcactcattatggtggagaggacaccaagccattcatgaaaaacttcccttacaacccaaatacctcccactagactgcaccttcaacatcattgggcatcaaatttcaaaataggtttttgaggggacaaatatccaaactatatcatgccactttattttattttattttgttttgtagagacagcatctccctttgtttcccaggttgggctcaagtgattctcccacctcagccccccatgcagctaggactacaagcatgtgccaccacatctggccaatctttctcatttttgtagagatggggtctcgcgatgttgctcagtctggtctcaaacttccggcctcaagaagtcctttcaccatggcctcccaaagtgctgagattacagcagttagtcaccacacctggctccattgtgccacttttaactaaaaggcacttttttctcaatatttatattctctttcttttcaaactactaatccaggattagataactagactagacttagacaagtctctacacaagcaaatcataacaacatcaaaaacaacaaaaattagattataataggactaggcactaggttagtgtactttagaatttattttcatttaatccaacagagattcaatagctgttcattccaaatttgatatccataagtatatttttaaacttaacctaggaacctgtgcattttactctgtctggtatgacaacgggattaaagtgttggctctagttgagtagggaatgggcaacaatactataagtaaagagcaatgtgagacagacaggtcaaataataggaagttactgggtgatttagttagccagacaagggaggttccactgtcatggttgaccatgaatccaggatccaaggaagaagtcactggccactgcaattggggaaccagttgcagatgagtgtcttcccactctacatttacagctgaatctttctttccaaaacccactgtgggtcagatataccctcactgaattttaactgtattttacaagaatcaggtaatatttcaaacaatttgaaaataaagcattatttcaagtgtacaactaacccagtctgtttttacttgaagtaattttagcttattttgttttacctccaaatagagaataccctatttgaagataaaagctgttgtataaatataaagcaagataacaatcagggtagcctgaaggttgaaatcgaaccaaagaaaataaattcagaacaacaaattactgtaatacttttatttaatttgataactttcaatcatataatgcactgcacaagttatttggcaagaacaaaaatagtgtagaaactcatatcttaccatatatcaaattaagtttcagaaatattgttagttaaaagaaataaaaaattataattcttcgtaaaatttatcagactatgctgttagcagcaatagcactatttatcatgaaagtcaaaggaagggaccataatgaaataactatatttgactccacacaattaaaaattttgtataacaaacaccacaaataaaatgacagaggacacataaggagttgatgcaatgttttctttttctttcacttttttttttcttttttttttgagatggagtctccctcttgacgcccaggctggagtgttgtggcacaatctcagctcactgcaacctctgcttcccgggttcaagtgattctcctgcctcagcctcccaagtagctgggattataggcacctaccaccacgcctgactaatttttgtattcttagtagtgacagggttttgccattcactgtgttggcgaggctggtcttgaactcctgacctcaggtgatccaaccaccttggcctcccaaagtgctgggattataggcatgagccaccgcgcctggccaattcagtgttttcttaaaaaaataaataaatatttttaaataaaaatagttgatattggttagattaatatacacattgctggaaacatgtaaagttgggtacatgtacctatacatttttaaataaattgattcataattctgttttcaagaatttattaagcaaaagtaatctgagatattgataaagatttacatggtgctagtatttataataccctattctagaaactaagcacccaaacatctggcaataattaaattatgatatcataagataagatgatacagccataaaacaaaaatattttcaaaaattttgttgatttggaaaatttgtttgcatcattattattaaatttttaaaagttggcttacaaaaattatatgtactaaaagcaactagtgcagtgattgttttagacaatggaattatgagtaatattttccctttacatgttttctatttaatttttctacaatatgtattgctttatattaaggaaatgtttatatgaagaatatttgatgggccactggaatcaagatgaattttgtggcctatgagctgagattgcgtcaatattgccaggtctttggcttccatttttcctgagatgtaggactaatggaagattgtgagcagagaagtgacgtctgatttaagtttataaatacctgctaatagtttccttcattatacctttacggcagtgtccctctgtctttgcaaatgccccatataaggcatagcaaatgcagtggcctgcttggaccaagcagatacttaagtggataaacagtgacagatgtaagtgcataggactacctacactatgtggctggtaggaacactaataaactatctgaagaggacatctgcttctcagctcctcatgacttctgtcatttagaaatgtgggcaagtatttcctgacttgatatgttattaagaaaaactggaaatatagattttttattaattttaaattttctgaaatatgcggcaacagacacggtataaatctagcttggaatgttagttttcaatctttctcttgttctcagtcatagtgtcctagaatttgtaatgttcctgtatagtcttgatagctctcatgtctgccctctggttgtccctgtcactctggatttaatctacttggtttatctaccttgtcagtcttacatattgatctgaatgttatttatttttttcctgagtctacacaatgcctttcctagacatttacttcttagttttcattctattgcattgttacagtttaaactatacttttttaaagctcaatttccatctttttataataatcttgctaactcagaggcaaacaagttacaaaagatgtattttttagacaacacttaaaaaatacagaatttgaccatttcttgagatttaatcttacattttataatggggtcactgaaatctgaattgacatgtctggcctacttttaattaggccctcttttaatataacctttattaagaggaacttgatttccattgggagaaaaatgagtgcaatgtgatataaaaattgcaactatgagagattctaatgttaatgtagggaaaatttccagagaaattttgaggatgtgtttatgatatactagctatacataaatagattatttttaaaaatagaactggagccatatatcataaattcatctaatttaatttataaattattactagtcactcaaatcaccatatattcctgaaatcaagtaatatttagacttggctcctgagtatcataagagcatggggtaacatgatggacaaactcggtgggtaaaatactcaaagaaaaaggagagtatgcttcattttcttactcttctcaaccctaaatattggtaccatttaccttcagggaaagactcaacagaccctgggaaactcagactaaaagttttcaacatatttaaacattgaatatctctaacagaaagctgaatttgcatttctgtgaaattcattgattagttgtaccatacacagacagaggtagagtttccaatcaacttattcatgttttactcctaaataagttaaggaatacccataaaattaagaatttaaataaaagaggttaaaactaccctaaaaatgaagattttcagggtgccaaagataaatttaaagaagttataaattattgtcctgaattaaatgtaattgtatattgtatctctgaaacaaaaagtgaattatatatttttaaaactcagagaacaagagagaactttgagaaattaaaaatatgagagccaaaataaaagttcagtatatgaggtggaaatagaaaatttaaagcaatagaacatagaaaaaatagaaagacagacaatggggaaggaaagaaccaaaaattaaagttctttaatataaggcaaattctgtgttattgtgctgactcaaacttgagaaagttattcatttttatgtagcagatatgaaagaaccacaaaagtctgtggaagaaagggaattaaaaaaataaaaatatactttgggaggccgaggcaggtagatcatgaggtcaggagttcaagaccagcctgaccaagatggtgaaaccccgtctctactaaaaaaaatacaaaaaagaaaaaaaaaaattagccgggcatggtggcacgcgcctgtaatcccagctactctggaggctgaggcagagaattgcttaaatctggaggggcggaggttgcagtgagccaagatggcgccactgcactccagcctgggcgacagagcgagactctgtctcaaaatatatatatactttatttctcaacataagcttcctaaagtgtaagacgcttttgtaagtgatgataccagtccattcctacagaactgagtgttctcgggacttaaccatgtcaatataatctttttacattactaactgaagaaaatatgtgtcctttaaaggctttcttaagattaggaagcaaaaagaagtcagaaggagccaaagaaggattgtaaggtggacacctgaagatttcccatcaaactcttgcaaaattgcccttatttgatgacagtaatgagcagaagcattgttgtgtggagaaggagtctctggtgaagctttcctggatattttttctgctaaacctttggctaagtttctcaaaacactttcaaaataagcagatacgatttttctttggccctctaaaaagtcaatgacaaaatgccttgaccatccttaaaaactgttgccatgacctttgctcttgactgatccatttttgctttgactggatcacttctacctcttggtggccattgctttgattgtgctttgttttcagggtcatactggtaaagccatgattatctcctgttacaattttttttgcagagaagcttcaggatcctgatcctacttgtttaaaatttccatttaaagctctgctcttttccatagctgatctggccacagtggttttagcacacatcagtggagtttgctcaactttactttctcagtcaaaatcgggtaagctgaaccaactgagatatctaagatactggctgttgttggtgctgtcaattgtcagtctttctcatttagggcacgaacaagattaatttttcctcacaaatcaatgtggttggtttcattttgaacatcacatcatcttctcctttcttaaaataagtcatttgtttgtaagctgctaatttctttggggcattgtcaacattaacttttcataaggcatcagtgatttcagataatatattgtctcattaaaaagattctagttctcaagaaggtataacctgacaatctaaaaagctattatatgaattttaaagtgatttttaaaaatatgctttttgaaaaacgtgcattcagtgactttaagtagttttgggatatatatttttatttacacacacattttgccatatgtatatggatcttctatgtatcatatatggatatatacatttatgatatatatcatattttttctcatatatagagaaaatatctatatacatgtggtagaatttctaacaaagcctaaatatatttttaaagttcctaaatatcaggtttgattcagagaaaaagattccattattagtgttatgaagaaagacatttaaatttcatatcacgtatttttcttttgaaagttttatatatataaatgtacacacatgctcatattttatatacatgatcttcaaaaagttcatagaaaatatatgttatgaaaaaactatgcatggatttgcaatgtttttgcaccaaaataagcttataataatttattataacatgtctgaacaggatctggtttgaggcaccaagaaggctaaggtatcagttttcaggtatatgcgatgcatattttgccatgtatgtttgtgtctaaattttggaaatgagctaggtatcttcttttcaaataaaaaaaattgtggccatacttgtttctattgccttacatgaattaagcacataattagccagcattcattcattcactcattcattcatgaataatcaacaaacacttactgtgtatttattatgtaccattcactaggagcgtcacctttcagaggaaaaaaacagaaatgtaactcacacagataaatgtacaactaacaattctgataagatctgtgagggaaaaaaagaaagtgctatgagaatgaaaatgtactttaatatactttgttttcatgtgaaaaatacctgcaagttcccaagattatttttctccagtgttagtatgcataaaatgagttttctgtggtacattagtcactaaggtacactaggttttagtagaagaacaatataatttttcaccattcctgccaaacacattcagaaagagagaaatataatgttatctctatgtggcccttgaggaaattgagtcaaaaggagattgagtaacctgtccaaaaaaattaagtcatggaagctggagctctttacatccaggcactgtttataagatcaagttgtcatggttggcttaagatggagaaagaacctaagaaacacaatgccaaccccatcattctgcagataataaaattgaggtcaagtgtcttgcccactgccacaaaagtgctgaagcttaattagcatgcaggtgacttggttctgagtcccctgttcttttcactctgacatatgccatgatcgataaatttaacattagtttcagcctaatgtttaaagattttattttctcttttaacttaaatattctatattctaagatattataatttcccctccaccaacctaaacttagttgagttgaatacttgatatttgcccaaacatcaagcatctagagaagattctacaaaacccaaatataaagaatccaaaactcaccttcaccacaactggatctcaaattacccacggccattgtttagccactcagtaggaggggagaatgtaacagggataacgttttcttggaaagagacaatggtctttattaattataactgaaatatctcatttgtgtaaattttacaaaaatgaattatcatgtaaacatatttattaggtcccctcccagggccttgggagtcctctgcaagggaaaggtcctgaagcttaagctttgttgacttcacaggaaatgaacctcttgtttctgaaagcttagaatcaaatttagaacgcacctttaacaacagaccacaggacttgattggaatggatttctgaagtctaacattttctctggcattatttaatccttgcattaatgattccccattgtcctaatcatttcttattttactctgtcagattatagatttcttccaaaaatgccttgtattggagttccaccaagacacagatgacaccctccaagggtttacctgaggaaacccttagagggtgacttaactctgaccatacgtctgtaaatagccgtttaaggataaggaccttttacagaggtatggtcagagttaagggtgaagtgcccaaggaaaagcaacagtgggaagttgtcagctacccaatgcctgaagaagcaagtggagaaaactatggtatctgagcttgaagagagctcagggtcctaaagggcagggttgggggagggtaggtgtcattagagtcaaggcactgaggcaggcaggcagaggactaagaactccctcagaccccaccacttcaaactcctgttggagcctcctgactctggttgctgctaatatgagctaggggccaaggaactttagatggtgcagttcatagggtacaaagcagagcagagaatggcagaccgcaaatctaatgaggggaacaaaccaagattaaccggctcaggcctgaatacccttaaaataaggtctagaataatgtagattactatttaaatacctgggtacaggtttatattaatatttaaaattatgagaatctctttatcagtaattcaaactccatgaaaaagagagcaaaattgacatagatttttggttggttggttgattttattgtttcttctgttttgtttgtttgtttgtttttgttttttttatgatgaaccaaaagaaaaaaaaacaacttttaaaagccgataaggagctgttaatttatgtagtcatgtaatacttacgaatttattactaaatatatttgtgaaggggacacattatcaaaggtggatgaattgtaatttaagtaccaaataccttattctgaaacaaaagttcagaacagttttcttgaccccaacattttcaagcctgctgagattgttttgcctgtctcttcacatattttgtcattctggtcattatactcacaactcctgcatcaataacttcctggaaaccactttctctttagccttcttagcacagtccttgtccattgtgtctgtggttataggtgtaagtgggtgtgaaattgaagcacttggactcctggattgaagctgtgatgcaaactctcactcaggcagtgagcaagtagggttgtctgctttccttttctgtcttaggtcattgaatgtacaatcctctatgcagtgagtgattaatgcagatacaaagcttagcctttacgtgctactgagctgctgagaacaatttataggactaactacaactctaatgtgtgtgcaggaagtttttccctaaaaagacttggaaatattacaacgtacctttgtagtttgggtgcttttgaggcatggaaacacagactaaaatatatttagggatacaagtttccccctttcaaaatttgtcacagtaggagaaatgccctttttgtcacataataatagatttgctattgtcagaatgaatgtattctgccccactagtatgatctccatgaacaggatcaaatttctgtatattttagatttacagagaaactaagaagattagtttgcatttcttgcccctgactactatccattctcctggggttatggaaagaacacaaagtttgacttagaaaactttgggtttaattcactttactagttttatgaaattgcttaacctctaagcctagctttcctcatctgtaaaacctcagccataagagattggataacagctacctactataaggattaagtacaattatatgggttaaacctctaatctggtatatagtatatgaccatcaccccaaatccaacagttctcatctttcattttatgccatgctttattattttatgtttattttcccatttatttcgtagagaacacattttgggttgcagttttgttaaggaaaggaaaagactatacaaataacttttaaggaattctaataatcatttcattaaatcgggccagtattttttttctgacaactgaacactttatccaacagtgcaacattattttacacatattaggaaattgatgattgccaaaaatacttttaactgattttgtttcattttttgttacttcaggacaaaagttaaaatgcatataggatcaagtataattatttgtccatttcagttctaggggaatcagttgaatatttgaatggatcttaacaaaactgaatgtactttatagagtacatgactttttttcttaattaactatctgaattgtgatagacgttgtggtaagtttctcatcatgttttcttgcttttctctgaaatagctgctgactttgtaagagtgctaagtcacagctgcatgaatattcaatagccttgaaacaaggaccaggcatttggtcgattgatagatgaatgtgtagtgtctgagttttattcctctcagggaaattttgaaattgatgtggctatggctagcggcaacttatatgcactatttgaagctcatttattacctactatctcagttgaatcctctgattgaaaatagtgtatttaaaattatgatttactatgcaacaatctaaatgtaactgattttaaatgcattgacttttgttgtcactatcttaaccaacaattttagatatgatttaaggataatatattatttaattcacattttcacattcttaaaataaattttttcagtacatatgagcatcaggtcactgattaattcagtacctagctacaataggtgctaatgttcaccactaagtaataattataagcatttgttaaagtaccaatttctatttctactctacttgtgagtactatcctaatccttaattagaaggacaattatatatatatatatatatgtatgtatgcaatcgagatacttaatatatagcctccattggatatctggattgcttaataaatttcaaatacattttattaacaggtactaatgaaatcagtgaaagaagcttgtttttcattcacaaattgttagtatattgaagatttacaaaagaatggccatgtgtacacattttttactactgtgcacatatatactcatctgcaaaaaccattatggatcaattgcagtacttagacatcacaattataaatggaggattttaataattatttataaaaataatttcaaatgtattccctagaaaatttaggataaacattttctaacatttgaatcaactatgcaaaatcacttgcaatcagtttttagagcccattaactttgatgtcatttcaaatgctgtttacatatggaataactactttgattatcccctaggaagttaatttcgtgtttaaagcaatgaaatcttctttcttccatatttaaaattacaaaaaaagtaaagaataacaacacagcaagtgaggatgctgaacaaatataagtcatcttgctcaaagtatatttactctttgatcttgaactcttcctttttataattttttccctaattttaaaaagtgagacaatgcatttaaatttctgtatgctacaccgtttcttcaccttggtttaaaacagaaaatataccaggggttacttaaacctgtactctaggtacccaaaggcccatgaaatacacatttactagcaatgttcaataacctccaataggcaatattagtctcaaacaaccactttaaaatatccctaaggcttcctttgctggtttgattttagcattaatgttgtacaagttatttatataatataaaattatatttcttcatctgtaaaattgaattaataatatcttttatttggttttattgtaaggatcaaatggacatatagagaggcagatatagatataaacagatataagatacatagctagatagatgatagatattagctggctacacaaatgctatatacatgatagatatagatacagattcgtaaacatatggtattgtaactattatggttatattataatatatattataaatattaccacttatttcaaatttaaaactaaccaatgaaatacaaattatattttgatttcattgaattgtcttgcaatttagaacactttggaactgaatgttttttatgtggttggtagtgtggaaaactgggaaaggtcaattaaaacacagaaatgcaaggtttagagaacgtttaaatgaggtagcaatgaggaattgctgtgttgtgttacagtaattttgaaattgatagaattttgaaacttgatatcactgttttaaaagtttgccttttaactcctactcctattttgacgggtgggaaaataatttttcctacagcacaggggttgtaaagagaaatgaaaatggtagctactagtgtacactccttaaaaatgtcaacaatgaaataatgtttttagaaggcctcttaaaaatcaaagcttgaaaacatatactaaaaaagaaaggtggttagtggggcttctctgatgactcagctccatagaatcaatttaaggaaactcaagttgaaagcaaagtgtcctcagttttaaaggtaagtgtgagcttaagaaagaaaatgatagtgggaaaattgttaaagtcaaatagtttctaataaaatgtctactcatttgtgggttcagtgtatgcagttttttcttgtatgtccctgtaattccaactctgggttttaggcttatgaaaattaactacacaaccaaccaaatgaaatgagtgaaataaactgtcaggcctgaggtctgactatctattgacgcataccgcagtgtatcatgaatgtagtgaagaaaactttgcattggtatgtttttaagcgatggtcttcagtatttaagaatttcaaatttttgaaaagatagtggtagaaccttccatattattctatatgaaccagttaactggaccatggcatatcctgactccttacaaagaattttggagtttcataaaactaagtaatgcaaggtatctcattctcttagtgtttcttttctgtgatgtatattggtctttgattttcatgcatatttatgaattaccaaaacaatatttttcattctgaacttatgatatcagcaggactggatgttctatactaattgacaaattagatgcatattaatcaccaggaacacatggtggcatctacccccaaatttggaaagcactcaaaagtgtcatttgcaaatttaggactgttgacaaaatgggcagtttttctttataggaggcatgatgccaggggcctagtgaattgacatattgcaccttattataagaaagtatacagaggatgaatataattttatttcctaacttggttaataagatgtatagatccatttagaaccaccagccatccatttgagtggcagaaacctaacttaagtgaatttttttatatccacccccaccactatactgagatttatcgaagtttgagagggtaactagtatcaaggcactggtatgggagtgaggtggggggaggtgtgtatgaaagggctaattcaccttgtttttttagtcttctgactacacacacagatgtctgctgagatgtccattatcccatgtggccctcaattatttttcctattgtttacctcagaggcatgctgtgttcctctcctcctgatcccttaaactctggtgctctgtcccttttttgatggtcattctcttgtctccagcctacattaggaaaaggaaatgagtattttgaactttcctaactcccaataactgctcctgtccctcatctctagattctatcccttcaccactatcttcttgctccctaggccagggttcctgtctttggagaaagcatcagtctttttaaacaccattctcccaagcattgtggttaataccttggacttctttttatgtctctatgggtttagggttttagaaatcaaagtcagcaatactcatccttttctgtattgggccattttatatcccctcttacgaggtaataggcatcgtatagtctattttcagtgatatctaataaaacttgtgatgatggaaatagctacatgtggcaactgagcacctgaagtgtggctaatgtgactgagagagtgaagttttaattatattcagttttaattattttaatttaaatggctacatgtggctagtggctgcagtatgagatagcacagatagctgcttgaatgtagagaaatgacaaaggggagcaatatgataaaggtgaggcttttaaaaaatggctataattgaaaaatatcatccagtcctgaaatcatatcagagaatttcttttgacatctgtatagcatgccaaaattgaattgaaattaccataactcaaattgccttaaaaaaattgtccctccttctgagtgtaatttcttcttgcactcatttaccactaatgggagacaggtagcagggagaaaagaggggaacaaatctaaactttcagcaaaaggcctcttctgagtagattaccagtctcttatgctagtgtttgctttctcattccaagatggcgtcaggatgtaaaagaaagcctaggaacatgtcttcttgtgatggggaagggccccctggattgtgtgacatttcctcggtttcttttggtctcctaaagactgggaccggacatgagtgatgtctgggtaacttcttaactactgttaagagtccacagcgagtgagacttgcagtctattcttggtgggtcttgctgttgctgtcctctcccaatctgactgctaccttgatgggatcaaaatgctggctctgtcatacaacacatatagggatgactgagcccaaatagacaatctcggtgtcatttttcagtgcttttgaccctacagaggtaaaataactgcgtgtgacacattaaatgttgtgaggcaaaggagctggattctcagatgttcttggcttcccccatttgcatatctaggatttttgttgtggattttcttagcgccttcctgtatttggctgcgacccaaagggggtagtctcttttcaggttctgtttatctgaatctccccttcctcctctctgaaggctttccattcgtcttcttgcctggccagaacttctctgaaatcccgttatcaatggtttacagtaagcttttgtgatccgaattagccaagattaacacttaatatttagagggaacttttggaatttctcattttctctttaagtaaatcttggcacttaagattattgtgtcgctgtggaatcaaatgcttattttggaaattaaaagctgaatgtatttttttttactctctacttttctgcattaaagatacaaaggcctatataataatgttaataaagccatctataagttggattttaaatttttatagtttcctgtatttttgaaaattgacatttgccacttttcttctaaaaattaaaaaaaaaacctatgggattttgcacaacctaatttggaagtaaaatcaaaatcacaactgaattaacgaaagtttttggataaggaaattcctgaacttgatgtattattattctgacatggaggaaaatgttccttatgagctccttctaggacatttacatttataatataataagaataatttttttcacattatatgacaaatttatataattttttctaatgattaccagtaattaaatgtcagtttctaacttggctccaaatagttaaattttaaactattttaacaatcataaagtgttcaggtcctttagtcaaggacaattaaccatttatttttatattacaggaggtcaacatgaagcaaatttagacaaattgtagttaactttgcataagcattttctttaaagaaaatctgtaaactccagactactttgattaatttaaaaacctttcgtcctcctgtaaattgattccattgtgcaaatgtcttgtactgtggtacttcttactcttagagaattgtcacctgtgctattcagtcagctcagtcagtgagaataaaaagacctcagagaaccacaaagaattctaagaagatgctctctctctctcaggaactgtgtgttggatggatcaaaccttgaaatcaaaatgttcaactttgagtttatgttaaaaagaaagcttcccatattaatgtctagaaataagttttacactgttctctcttggaagggcattatttttgcattttgttgacaaaagcaaatttcataaataactgtttcatttcaattaaccagtttctttgggatttattttaagatggacttcttaaagtaaggcttttgatatttttaaacttagaaatttgtatatatggcctgctttgatcatcattgttgatcaatgcttataatactagtctaagtggcaaatgaatttttctcttcgagcatgtaaactcatttatatacttgttcttttaaaaaaaatacatggaatgcctttttgtgctggatttctttgttctctcttctattgcaggaggttaagcttttcatagtaacatttttagtgttgactcatactacttatcttaataatttcaatcagtctaatggagtgacctagctacttggttctgtataatgatgattcctgtctagaaatcatcctcagacttccttgtcttctcttttagtgaaacaaactgtacagcactgtcactcattttaataggggcaatgtcattgcttgccacctgttatttaatctttaggatttggcaaaacagacacctttctttttattccacattgccctgtttaccagatataggactagctctttgctgttgaagactttcaaaggatttgcatttagaggaacttgaggttgaattctgactccatcaattaatagtcaaataatgttgtacaagttatttatataatataaaattatatttcttcatctgtaaaattgaattaataatatcttttatttggttttattgtaaggatcaaatggacatatagagaggcagatatagatataaacagatataagatacatagctagatagatgatagatattagctggctacacaaatgctatatacatgatagatatagatacagattcataaacatatggtattgtaactattatggttataatatatattataaatattaccacttatttcaaatttaaaactaaccaatgaaatacaaattatattttgatttcattgaattgtcttgcaatttagaacactttggaactgaatgttttttatgtggttggtagtgcggaaaactgggaaaggtcaattaaaacacagaaatgcaaggtttagagaatgtttaaatgaggtagtgctcatttaagaatgtgtaagattgtaacacaaaaatagaaaccaatgaggaggcaccaacaagtaagcacttaaatcataccataaagaatgggaatgagtttttcaaaataaataggaactcttgattcttaggaaggttcgtgtattaattgcttaattttttcagtttattttatttgagattattacattcattttgttctatcttttaaatttattttatctcagtgacatcattgtatgtctgctgtatgacaagcacaaaagcatcattcttacctttatgagagttagtaatgagcacaggagcctttaaaaaatgaacctggtaatttaaagagaacatggttattgataatgagattaaaatgtggtttagtgagagggtgctaggaaagcaaatagaaaagatatttattccagcctgtggatttgaggaagatctgctaaatagacggtgttgtgatctgctttttgtgatttctatgaaagacacaggtaatagtcacaggtaatggaaggatcaaatatgctatcttagatgtgttgattgaaaatctctaataggtaggtctaggcatatagattatttgtacaaattttcccaggtgattttaatttttatctatgattccttttacttcaacacagatttatctaacttttgtataatttttccctggaggaaaattaataaaatgaatattaaaatattattttaaaatgaatcatttatttatactgaaaacattcccttagcttctacatattttggatcacaaattgtgaaacacccacttctacaatatgaatggacattaactcttctgtatttaacaacaattagagaaacttgttctttgaataatcactttacattttgcagatacttcaggccaataaatttgaccagatgggtgcatctatttgtgtaaattactcctattgagagaaaaactagcacgtaaatgaggcaattctaaagagtaaatccagctaatgtgttcctagaatttttcagagatcagtatttcaaagatctttataaaataaaacagaaataattcttgggatgtattaatttgttttgaatactggcagaaggggagaaactttcacagcttgggtgacaaattttttaatattttgagacatatttatgagaaactaaaaatattatctgtaatagttgttggtacttgattgattacatttatttctactcagacaatctcttcttttaacatctgataggttcctttgcattaagagaatctcccatttgagacccaaatcaggcctgagggcatgggcaaaaatcacaaacagaatacaaatacccagagctcttagagtgacataataagctggggaaatttgattgcgcatcaccaccgagagcagttcgaccaattagtgtgctggagcatgcccattatgaacaacagtcctagggacctctttcccttcacccaagcagtaggtggggggcatggacaaatagaagacaaccctgcctttagagggaggtgtagtaagggattcaagcaaagggcagtcgtccacactgatatttctcaggtacctcctattttcaaagacatcttcactcctaactgtgtgactcaaatcattcctttatcatagaatagtgaagatatataataaccatattagggaatctgtaaaacatataaatgcacacacacaaactcctccagggtcgagaggagaaaaaggggtaaaagaacaggtaaataaacaccatgtggtcttcaccttaatgcaaattttgatacttatacaaataatgcaaaaacacattcaggtgcctaggtggaccagggcaaagggagggacagggtcttgaataggactttaatgtggacacagggcagaagtttcaaatccaaacaagaaatctttaagaaggcattaaataagtatgctatcaaatatttatactccttaagggcaaacattacattttttttcccttgagtagatctactttattttcaaaacacctttttttttctcactgcaatcaatataagaggaggttaaaaaggaaatctataaacggttggaatcaatttagcattatctgatcatagaaaagggatttggaaagtataaatgagatctgctgtaatttttctcctctaacttctgccattaaaacaataccaaatatagtcagtgttattttatttgtaatgtgttttccctttatccatcataattaaacaatttcagtatagaaaagacaaatagaaacccctttacaactaacttgttagttgtcatggaattgaggaaattttaggtctttttcttccttgtaactaaggtaaagaaccatcattctcagcaaactatcgcaaggacaaaaagccaaacaccgcatgttctcactcacaggtgggaattgaacaatgagaacacttggacacaagaaggggaacatcacacaccggggcctgtcgtagggtggggggaggggggagggatagcattaggagatatacctaatgtaaatgatgagttaacgggtgcagcaaaccaacatggcacatgtatacatatgtaacaaacctgcacgttgtgcacatgtaccctagaacttgaagtataataaagaataaaataatttaaaaaactataaaaaaatttgttttgtagatttagtcaaggaatttcatagaacacatgaaagacttaagtatcctaatgaatatctttgattctatgccgaaattagagtaaatttaattttaaattataaaaagcacttcaaaatgattagaataatcaatgaaagttgccactatgaaactgtcatttatttttgtcagcaagaaaacggcttctgactaaatctcgcagtgttgaaaatggtacaatagtaaagccaataaatcaattccattgcctcgatatttcatagccactgactgaaacatagcctcagattattgtttgggactgggctgacaaacaagcatgactcactgttagttccctccatcctttccaacagtagacatcaatcattagtcaggccttcttcctcacctggtccaaatgagaatccagtcacactcaatacagggctccaggctgtcactaccaattgatctgagttaatatgtaacacgaaacctattcaccttcttgtgatgtatatatctttacaagataatttaatcagaggagaaaagtttgcatttgcaagttggtgtggctattattatagctcctcctcatgtcagattcatagagcagcttcttgaaaacttgcttcttttattaaatctcattttttgccacatcttggttcaaggctcttttgattgatggcttgcaaaacaacaggaccaaaacaggttcatttttcttctgtgcagtgaaaaacatttaaattggctcttcattattgttgttctgcctcaaagaagaaactcagaaatttcccacatcaaatggcacagtcgtaacacaccaggaaacatcttcctttttaatatttatccactatcctaattactctttaaagatagaagtgatgtttataaacatatgaagattttagatttttttggtgatttatttcaagctacgggatacaggagttattggacaagcacagtttattctggtttggcaggtgtattaggctgttcttgctctgctataaagaaatactggagatgaggtaatccataagaaaaagaggagtaagtgactcttggatctgcaagccctacaggaagtatagcaacatctgcttctggggagacttcaggaagtttccaatcatggtggaagacaaagagggagcaggcatgtcacatggcaagaacaggagcgagaaagagagagagagagagagagaggagagggagggaagtactacacttttttaaatgactagatctcataagtcactcacttttgcaaaaatagcaccaaggggatggtactaaaccattcatgagaaatctgtccccatgatccaattatctcccaccagtacccacttccaacattggggaatatatttcaaagtgagatttggtggggacacagatccaaaccgtatcagcaggattgataaattgcttatgagtctgcaaaattaaattggaaatatagtctttgactgcattaattcaatatatcaaattatttttagacttcttattgacttaagtgtcagtgagacagcctacagggatcagtttcgctgctctacagagtaaagcaggaaggagataggaaaggattcaaggccaaaaagacagagaactcagcactctaattattttcctttcaaatattagagccccctaatatttcagttctattaataaaaatgaacagaaaaatgagagactctacagtcagccaagataaaataatcaataaaaatcttacggtaatattttggtcttttggaaccactcacagtagtttctgtttttctgatcagaccctggctgatacattcgactgaaatataaaatatgtaggatttgcttttgttttctggatacatatgtatgtggctagaacttgtacagaattcatgtgacttttggccattattgcagggtatttaaaatagacctatgtttttctaaatattttaaatttggcattttggctattcaatattgttaacttatgttaaaatgcatcagatataagatgcattgatgggtggttggaaagattaatgaaggataggtattaaccaacaagtatggtaaaatgttagtagtaaaatcaaggtgatgggtatataactgtttactgtaaaataacttcaactctactgtatgttttaaagcggccataatgttgaacaaattaaattttgtggatttcaaaacaatcttttttatcactcagaattaataatttagagttataaattaatatttttgcttcccttaatttggtaaaaattgaaaagcaagcttaaatacaacataaacactctcccataagctactaccattgtgtgggtcaaagaagtataattttgaaattttgagcgtatcaatttatagtcataaaggtcagattcagacttgaatttaactatatatatgtttctataatttatacaataattctactccagaagaattatttttcaacactgattttgtaaattaaattatggctctacatagggaattttcttttttcaaagatttaattcatatgtttacaaaatacctaaaatattaaataaaaagaaccccattcattaagattttttttgtttgtttgtttttgagacagagtctcgctctgttgcccagcctggagtgcagtggcgcaatctcagctcactgcaacctccgcctcccggattcaagcaattctcctgcctcagcctcctgagtagctgggattacaggcgcccgccaccatgcccagctaatttttgtatttttagtagagacggggtttcatcgtgttggtcaggatagtctcgaactcctgacctcaagcagtcctcctgcctcagcctccaaaagtactgggattacaggtgtgagccactgtgcccggccattaaaattagtatattgtcattgatagatgtttctgcaaaatttaattttaaatgtcatctttgtatttaaagggggctttagcatgaagcttactagtgaaaagttgtcaatatattagtccctaatacatgtttatgacctatttgattatacagcattttaccattgaataacattttgacattttaaacataaattattatgaaacactgtgtacatttaatttgaaggttgtccaaatttattataaaatatgagaaagaaaactggactattgagcaaagcatgatgttattgaagcatctaggcttattaacctaaaatactgtatctttgttgttttaacagttttgctctgcttttagatttggggcacttagagaataatgccaacctgattatcattctcaagtgagctttcaagagttcattaaaagttaagaagagaacagcatgctctgggaagcagctatttttaacagcaacaaatttgaattcacctactttaaagctttttgctgtttttagaaaatatttctatcaataactttgagattagaagtctattaaggtcacagttcacagtctcataacacaatattctgatattttccccttctgactgaattcatgagaaccaaattattttacttaagaggagcctacataaataagcagagtgtacatatttgctctaaaaagaaaacaaacaagaactttgaaatgtccagtttaattggagtccacaggtatgtataattatgctttgatttgataaatcagtgctaaataatctgtgaaaaccttgctttgtggcaaagggctccttttagcaggtaaagcttgaaattccatcaatgaaagtaaaatcctgtatcattaggtatagttttgtgtcaaatctaaatgaaacaaacagtctttgaaagctataacatctggttagtaatttagctatatcacaaacaatatttttaattacgctttaaacatatcagtctctatttattataattaaatatttagagaaatactgggaaaatattttttaaattacaaaatgcatttataaatagttaccagagaaaagaaagctacatttttgaaatgttgtatttaaaacaaatcacagatttttgtttttctagaatgttcttgcttcctttttatttgtccagctactatttattattaggcaccaactttgtagtcattcccttccctctagctcattaccctaaacatgaagagtagcctagctatgtcatattttcaaatacagcattctgtaacactcaatataatgtttgcttgtatgttttctccactagaatttaagctcaaagagtgtagggactgtgatttctccagtgcttatccattgctatttgtgttttcaattgcacagagtaaatgctcaataaattggaatacttgacttaagttctgaagcctctcttctctaaaagtcattgtaatgtaaatcagcatttcagtggtcttgaaagggagataacgcatttcaggatctcctcctttcctttttaatataaatgtgtgtttgtttgaagaatcatgatggaatcaaacaatctaggcttctaactctgtgtctcactctgtgtctgtcagtgcccccgaccacacaccttcagaaccagatggacatgtgaagggtttaattgaagagagtttaacgaaagggttatttaaaggtgtgggcagtgctaagtggactaatctgagatacggaaacattcagggactagcgctgaagaaataatagagctagactgtagttaaagtgacaagcacagattttatttaggagctactgcaatagtggaaaagatacttcagcatagtcctggagtcagttcaaaatacagcatgggcaagtgagaagttacatccagacagaagggtgggagtcagtagatagaaaattacaaagaggaaacatcaggggtgaggagtgattctggctaacccagcttgacaggattcttagtgaaggcaggccacggtgatcagatatcatctaaaggatgatggtggatgaggaagttgatcaaatattgaggtgatcaaatactgaagtggggggcattctctctaaactgacagggtttttgctaaaattagatgatgcaaaggttgtcacagaggttgaaaggtctagatgtagttgagaaaagcgttcagaggaggcttgagtagagtttggtcaaggatagagtctttttcactagcaagaatgagaagctgttatcacccccaaaggagcaaagagaagaaggaacattatagggtctgggacttagaggaaagcagtcactgctaaaattttgacccagcaatgatggagctggctggggtggggaagactagggactgaaaaataagtacctcaatttgccataaaagatatggtgatgtgattaaagcagcacacattccttttggtgaacataggattttactatacctaggctataagaaaaagcttgttacgaataatggaggtgaccgtatgtgtatggcacatatgtgcatctgcatgtttgtgttgtttctgtagcagcagcatgacttgagcaccagctctgagccacgctgcctgtgttcatattctggctctgccacttactagcaatgtgaccttgggcaagttacttaatatttctatgcattaattctacatctatgcaatggggataatggtattgtctgctgtagaatagtatgagacatacaagttctgagaataagtttgggacttaatgagaactaattaaatgttagtgttactacaggcatatgtaataatttttttcccagtgcatatataatattgtagtctacccatagctagtcgtttataattaagattgttttgatggaggctgggcgtggtggctcacgcctataatcccagcactttgggaggccgaggcaagcagctcaccagatcaggagatggagaccatcctggctaacacagcgaaaccccgtctctactaaaaatacaaaaaattagccgggcatggtggcgggtacctgtagaccaagctacttgggaggctgaggcaggacaatggtgtgaacccaggcggcggagtttgcagtgagccaagattgcaccacggcactccagcctgggcaacagagccagactccatctcaaaaaaaaaaaaaaaaaaaagattgttttgatggaaggatttgctgacaatgactatatcagtgacaaaacagatttaaaagtcatcttttcattttcgtatggtctatttggactgattgtctaatggattatcttgaaattggcctccaaataggctgaaatctagtttaaatcacatctgcttgaattgttgtgctcttagatacgttccttctcagcagcacatctggattcatccaggtacttaagaaactccttttcggcaatatgtcctgttctagtgaggtaaaaccatttgtgtctatctgtgtttgtgtgtgtatttggaagggaaaatattcccaatatatgccatttattagtataaaattatagccaatgaaaaaatgagtttatttttacctatgtattagttgcttacatttaacataattgacataatccaatcaaatgggctaaagattaaaatacagttttctgtatttgtgagattaattgaataattatacttataaattattgagaaataatctttgttcttattaaaataagttcatcaattcacagtaatcacaatatgaagtaaattgatggataaaattgagtgaattattttagaaagaactccagtagtgtaagaactgttaagaaattagttattatcattccccctacttttcctttattagaaaaccagtctctgctcagagactcaagagggaaggcataggtacagcactaacacaaggaaggacaattagactaagtccattagctttgtagaactgaacgggaaagtcagtgcctcaggggcaaagttcctgtgcaagaggatggctaagcagagacacaagaaagtaaagtcacagagagacacagacaagcaccccagcaagcttgacgattaaccaagagcaaaaaagacaaagactatctggagaatttccacttattctgaggcagaatttcaatttgtacacttagggtccatgaaattttcaggtaacagactttttgtatttgagccagggctgacccatacattccttggccagaggcaattttgactttgtggtttcttgcttccaataaaaataataataataaaattatattgtagtgacattagtataaagagagatataacccaagctatattatgttcaactttttagtgaagcaaaaggttcaaaatgtccagaacattttcttcttttgatttcacaagaaattaaagcatttctaaagacctcaaaatgtatctggggtcctggaccctgtgcctcccactgtgcccagtggctaaattggccttgacttagccttctttgaaagcatttctattccctgtcctcgagtaatccttacctaagaaaaatgacattctccagtgaaatttcctaaagggcccagttcaaagatacataaaatctgtaaaattaacagaagtttgaaacatgtcacgtggttagattttttaaaaacaaaaccgaagacgtccaattaaatagatctaacatttaaaagttcctaaccactgacgtctgtgctaaatattgtttaaaaatgttttgaattatttcaagagtagctaattaagaagaaaatatcttactgttgatccatgtcagatttaaagcttcctttgatttcatttttaaaatagttttactgaaaattaagtgaatatttcatacttgcaaatagtatctaaggaaattctgaaaatgagcttttgttttgattttcattaatgtcgacacctattaccaatctgtacctaatgtcactttttttttaacttaataacattgaaatcagaaaaaaaatcattatatctcactaggcacaatcactgggattttgatgaaaggaaatgcatttctcatgcagtcttttagtaaggatttgtttaaaatgcgggttgttctactttaaagctcaatgctctggacattttgaaccttttactgcattaactgcattcattctaaaatacctttcaatttaaaacagaagataattgtaataccttgaagcaaatgagatgttattgcaataattaaatccaaaatgagatgcagatactttagacctgctgctatttcagctatttaatagcgaatagcttttccattggtcacactgatttctttcttttccggttgagatggagtgctgcatactaatcatattctaatgcattttacaagaggtaaaatgtgtattaagctctatcacactattttaaattaatataactttgcaaaaattataatacttaaatgacatgatgttttcatccctcacaaaaatgcatcagatttaagaaaataattttacataacaataggtaacttgaatactaagtggtttttccactaatgaatttgccagaggaatcagggggcttttcttattagttttctcaagcttcagaaactttcagtgtttaaactgtgcctcaacatttcagctggaggtgtggagcttgtccatgtgattgaatatgtgaatggctatactgagagaacaaagcaactatttttttcaaatagtgtcatttttttctctggaaggaatatcatttccatcaaggacatagctcataaattaaaatattaaaccagaatacattatttatgtcaaactacgtatgcaaaaggacgtttctgtttatagaaataacctaaatatcatatttctcttgaagaacaacttctagtagatgtatttctctcttggtgaaataattacgtgcttcagtgtttgagaagctgaaaaccactacatttttggctgcccctcttagcccttgcctgtggcattccttactgctcttctctcccctttttctttaaatcttactttaaaataatggtaatagctgacacatgttaacacatattgagcacttactgggcactggagtaatctgaggtcctggagctagtctgtggacagcaaatgtgcacctaggtggtccagctccagagctcatgctcttaacttctccccatcagggggctacagaggctggcaagtggggaggatggataatgcttttgtagaaaagtgttctgaatataacttttaacctgagatcttaacaaaagaatcattccctgtaagccctttttttatctggttctctgaatgttattacttacttccactctaactctggtgctgtgggtttctgttttccttccctccggctcaccaggctcccacctcttctgctgcagctcttattttgggtagttctcactcttctgctcctgcctttattactaatttttttgtattgacattggcatttcttaatgacaaatgccatctgttatttgggtttatctggtctctctcctggctgcagatgtgcttttgctgagtgtttaaagaagtcggcttctgtttcctacatctaaactattttcataatatttctagtttaagacagacccttctctcctcctgacacaatgaccttgagggaatgaactggaatcagtaccaatgcaccagcctggcctctgcagtgtatatctctactctggccttcctaaaagggattcctttgtagaaactactgatgattagcaggtcaccctggctccaaccctgatttcagagccttagatttggggattcctattagcccagtgtttctcatcatttctttgccttaggttcagctggcatctttacgggaattgaactcctagaggtgtgtagtccacagttttaaatctccctgtgttcttgactcccacggaagttttctttctgggaccccttttattccttctttcctcccatttcttgaaataatcaaaagactttggtggggaaatgttccctttaaaagggaaaaactttctagttcccttgatcccttttcacccttcaaactctactgtgaaattaaccccagcaagtctccattatgtatcagtacattctttgtttttctacccaggccagctctctccctgccagttctctgcatcctcatggaacgagggcaattgatgctatctttatctttccagatctcggattcataagccaagaccttatttcttttctcctaccaagagcgtgacctgcttgatttttctcttctctcttttacagttattataaaattgtcttgaattcctattccttccagaatgctggaaaactgatttccaatctctatttttacaaagaagttttcaaaaacaatatctattttgcacaagtgattatggctaattcataagaaaacaaacagaatttacgaacttagcaaatgttgagaattatgaaaatgccagaaaaaaacatttatatgcagttctctgaagtcttaattcaaaatgaaataggagctaggtttgctttctagtatgcctttggaaattgtccctaccttgactttctgcataaatggtcctctgccaacatccgtgttttgttttgtttttctttgttggtttttggctgaagaatcagctagcccaacaaagctaattacattttaacttcagcaaaactgaggttgacttgactgctgggtctgctgttagcccatcccttcaaaagcatgcttgatggtccatttctctttcattctgtatagataagattgattcattcatactcatggcttcaatcatcactcagtttatatctgcacagtcatcacattactcaaataaacatgtttcttactccttagcaagataatcataattagcatgaaaatttatcaacatacctaagctctatgtcagtgacaatatcttacctaatgaggtaagactgggaggtgttacttttagcagaatgtacttcattatgaaggcataggtttaatgggaatgtatcttaaggattctgtctgttcttgccttgaaatattaggctatggaaacaaaagataactccagggtaaatatttttaaaaagtaagaattaaatctccaaaaataatgactgagggcaaaatattattaataaatttattgaatttcaaagtgcactaaaatttttatgaaacaggagttggacagaggcttaatttatgcgtataacatcattttgcaacttatctgagttcagcagagataaaattcctttcataaataaagaggcggcaatttttggtgactgaaaaaaaggcaaagggcacagctatattagcaattttggtcttgatcgacaccacaggcattcagtagctactatttcaaattcattttaaactcttttttgcattttaatagttttgcttctaacactagaatgcaaatgtgaatttttgcctctagcgtgttttattgctaccttgtcaaaatcactagaaatctatattattctaacactacattacatttttcagaaatcagaaggagaaataatgtatgagtaaagtcagagggtatgaaaagatgttttgtgaaaaaagggacagaaaaaaatgtagaaatataggaggaaggactaataaatgggagacataggagagagacaaagaaaaacagagggaaaaatatgagagaggggtttggtaaattatgatcatggatgttgagaccagttgaatggattttgctttccctgtttacttagataataaacactttcaatttttatcactgttgttgggaatactcactgtttagtagttaaggatacttcttgcttacttgaaagtagtgtgacagctttagttttcagagttcaaagttttgctttcttaaaaataaaccttattagatactgataattttactaattaataaaataattttttttataaattcattttggaactttatagattttggtcaatttagtagatgtgtttaaatgcctctttgacattcaaatattgacagcaattttttatttatacagcagaatatttaatgctgccttgttctgaaatagctgaaggttatactttgaatcagcagatttttttacttctcagccttttctttcagataaaacttaggtttatgatctaattagggataccatatggtgtcatcaacaataacacaatgacaccatgatggaaataaaatggctgagagatcaatggattaggcacttttccatgatttccaatttttgtgaacaaattattcagataatgttcttctgaatcaaataatcaaagcatctgccatttgtttacttgctctcattgaaaatgcttcatatctggacgattccaacttccatttttttctgatttcctggagttgatgcttcttaattcttaggcatagtttatatggtcacaaaatcattcccagactgagcattggaaccattctgtccactagaacttgatttctgcctccatctttgcttctcagtctgccactctttccctttctgactatacattgctttctgaatcaactggaactttcataactctatctaacatttttatttgcttttccaactttaattacacttccctttctcatgttatttttccagtggtacctttcttgttaatagattgccctctttttgcccctacattgtaacctcccatctagtatcttttctttagactgaacactccaacagtagcgaagtataactcctctcctttcatttactcacaactctctctatctttaaacccaagctacaattttagttttacatctatgaatttgaaattaatatttattatcccatgataatttatctatttatatgtatagttatgaaagaattttatataatcattatatagatcttacagatttattatcaaatttaaattataacaatctttggattaaaataattgtttatacattatatattatgcattaaaattatatatggcattttatagaaaaggattagtatggaataactttattcatgagaaggacagtaaatagttgatgttctaaaagagtattttttggcaacatacaatccaagcactttgtactcatttttttaactataaaatgtaagctgttaattgcttgaaaacttttataaaatacttgcatgcctttgtggtattaatttgtacttcagacttgaatctctgatagctttttgaatttcaaaagaaatcactacttatatattattttaaaaacttgttgagctttcatcagggtagtctgacaacctaagcaacattttagttccaaaaaacaaaaacatatcaaagagaccatatccaaaacaataaggagatttttaattagtcaaatttttttttgtcaccatatggtgacagtgggatggctgatgtgcaggtgtgcactaaccacagctaggctcatctatttattttgcctaatagccgatctggaaaataatgatgaaaaatattgaggaggtagaaaaaacacagcttgattgaatattctgtgtaccacaaaacattggtgtattgaaacattgtgttgaaagttgttttcaatctaaaaagtatatgtaatgaagataaagggaaaaatactgaagggtttgtaaaatggtaaacttgtgagagaataaattttataatttgatatatggtatatctcaggaataacagtgattcattttcaacagactgggaaatataaaaggcatttgatttttatcttaaaatatctgctagtttaatatagtcaatgcttaaaaatatatagactttggaattacatctggaattccttttcttttctgacactttgagctttgtaacccttgggaattaagttctctgagattaagttacagatgagattaagtgatctcatctgtaaaaaaaggttactataatccatgtcacatttgaggttgtgaggagaatcaaatgagttagtgcacatcaattgtactagcaaagaacactacagtgcatagtagttatatttatcatcattacagctttgcattaaaaatagctttgattcatgacaaaacacaaaagactttgaaactatttctttcatggcagagggcaggtagtacagcaaaactatagtctgataagaaaataattggaaagtacattaatattaataaccattatggttctatatattgaaattgcatcagagacttgactggatcgctgaggagtataatagtttctataagcctctcggtagtagccctccagattgtgtaacgcacgtctgcactttatttttatcctgcttctgtctgtctcattataggggcttgtgaagaaggtttactgaggttatatcaaataccaagtatctgtgatatcttttcacttatattttctgtttgctcctcacaataatactcttcactcagcaatattagacccttttcaataaatgagcaagaggaatggagaagggcatgactttgccatagtcatgtgtaccaataagtgatgtacccatactagagccaaggtttttctcattgcctagctcattctcccactaatcttccatgatatttcaaagattgttatttgtccatatttcaaagttttgaaaggagggaaagaaattgtttagtaaatgtatgggcaattaatatactttgtttaaatcattccattagttgctttacatacatgctaattcttatcctaactttataaatcagccattttattttcccttgtgtctattagggttccatcggctacaattaacagaaaagaattaaactcacaatggtataataaaaaaggaaacaattttacataacaatgtgccccaaaataagagcagaaatgactattgagcccacaaattgcaggaaccactacactctttcttggagtaggtgtattggggtgtatgcatctggtggcgggggaatgctgaccacccttgagatttaacctgtctaaacgtcaaaaaaatgccaaatatttgacttacattgtcttatcaagactggcattatatagattaaataaagaagaaattgaacttcagctatgtcaaatgagttattcaaggttatacaaatcataattggtaaactgggcattcaaatccaagcttttctaatttaaataaaatctgtagtttcttcagtgaccacattgcttttttcatgtaaatgtctgggaatacctggagttgatccattcagctgctttaattaaaatatagggtaggtgttcatgtgttcattttatgtggagatttatttatttatttggacaatatttataagtgcaatctaattggaaagattgaattgttattatcctgcctgattcttgcaacttcttagcatgtccatgatcaagaaagaaccttgaagatattaaagttctcttcaactgtgggcccatgttttactggttctgtaatatagactgtattttccatatttatttggacccgctaaaatttgcatcacagctcattttttttttttttcctagagttgtaggggagcaactcagagcaacccacagagctagcatttctttccaactttgctttcaggaatatcacagtagtagcttgaaatcaccagtggtaggagtatttacaccatagatattgacaaacactgcaaataagagctctctccttcttcccttgcccacttcttaccttctgccctgaaagagctaattgttaaacttttttgagttcatcattgctcttaattcttttaccaggaagcttgctgacatatttaggtgatttgtggagagtctgcatccaggcaaaatgttttatcctcctgttccctagagataagctctgacttctgaaaatgatttagtttctatgagcctgtaaatttaagattcaaatattttttctttattataggatttattaatattctcatgttctttattttccatgaagagacattgtgataaagccggctttcttcatttctcacgtaggagcttatctttctacatgggatattcggcagttttcaagttctactcaagaatgttttgttgaaatggccctctctttcaaaaagtaccactacattttataacatatttatcaataaattgcttcaatttgccttgaacaacctttcagtaaaggccagtttttaagggaaaattttacttctgccgtatcaacagttttaagtgttaaacatgcacagttcttataaaggttcttatagcaatatatctatatataattcatagcattttataataattccaaatttagagccacagttatagatgctaatgtccccaattcaaattatattcaataaaagccttggcattaaaaacgatatgttttagaatgttacatcataacaaattttaatctaaaaatgttgtaggtgtccaaaatgaggaaaataaaatgaaagttattttatagaaagtcttcctaaatgggtaaaataaacatgagattttgtgtagataagtgcaaggtgatgcatttagggaaaagtgattctacttataaggcagttggctccaagagagctcctgtactgggaaagcgctggaagcaccatttttttttaagaatttcatgtacttctattgattcaagtgttcttcatatcactagccatatttaataaagatataaaaattaaactaaatatttcttaaattttataaattaataaaacattattttctatctaccatgttatgtaagctttgttaatgtgtctcaagaaaaaaatatggagaaatttcagtggacagatgatttgttctagaaaatgtgagggcaaggatgtgagtgagaacaatgaaaagaaattgtatattttatttcagaaagctgaggcctggtagaaagaataactgatggataaaatctcaatgttgaaacgatataatgaacacaatctattcactgagttgaaataggatagaatggggaggaacttcttgaaatcatattaaacagtaaatacaaaacttctaaaaccttttcttgaagaagggataaagtttcaaaatgggctcaaaatcattctaacattgttcagcctttcttaaatgttttgcctattttaaatgttcaaactctttactttctcttaaattattaaggaagggtgtttagggatgttttaaaaaaccatggatgtgagtggttcacaaatgttcgtgtgttcagagtcataacaatgtttgctcaaaatggagacttttaagccctacgacagatctactgaattagaatttttgcagattggagcccaggaatctaaattttaacaaataccagagatgatatagctaagccatggaccacttagagaattaccgctttttgttgatgtcaagaaaaaacatcctaggatagttttacaaaacatgactgcctcctactaacatatgttctagtgcctctgtcagctccacttagagtgatctgccactgactcattgaacaagtcttatgttgttacgccttttgtattttctcaagttgttccctcttgctgaaattcccttctctccatatttacttattgaggtcatattcatttctcaagacccattttatgtctcatctcttctgggaaatcttcctcagtactcagtcaaaatctgtctctcaaccctgtgtttccataagactttgcacgtacagcatttatcacagtataccttgtacttatacggagttattttacctactgtgtaagtgctaatctatcagctagagcaagaggttggcaaattatggtctgcaggcaaaacctggcccactgcctgttttgtaaatagtgtcttatgggaacacagccacgtctatttgatgacacattgtttaaggctgcctttgcgctgtaacagcagagttgagtagtgatgacagggacaaatggtcctcaaagcctaaaatatttaccatctggttctttagagtttgctagcctctgaactaaaatgtgtggtgtattgtgtcctaattatgtactagcacttaatagaatgttttgtagagagttggtactcttataagttatataaagtaattggtgaaaggatgaagaatgagttggaaatatatgtttattatgccaacagggtaaatataaactctttttctattcctgccttagttggtttttaagtccgtgtccctgatgttattagtgcttcaatagaaccttctgtgatgatctgtatctatactgtattctgtatctatgctgtccagtgcaatagccactaggcctatatggctatggaacattttaggtatgactagtgtgaccgaataattgaatgttaactttattgaattttaattaatataaagttagttaaaattttgtagttagtgaccaccatattggacaatgtagataggggcacaaataattacacctcaaaacgaacagcatacaatgagagtgagagcgtaagataaattaatttaagtcatattataaattctataagagaactctgatgcctctgtttaattaacagttacacattggaaagatactctttgtgatccctagttgtgttttggctaagcgctcaatgtttagatgtgaagaaattagaaaccagttccaaaaattagaaaagctcttacagatacaatttctcttctcctattttctttttttttcttttgaatctataggaatcacaaaaaccttttttttagtggtctttcaacatttcattgatgatttggcatcaattcaaagagcaaatgataccaagataaagtgaaaaaaaggaaattagaaacacccattgcttcacatagaaattctatgtgtgagtatgtatatgctgaggttgggcatgggggagtgataagggtcagaaagaagagagagagactgattgacagctttgggtgcattatcactggtagtgatgaaaaggagggctttcatgtttcaacaactcatttaggtaattaccattgttccacttgcgtttactgaaatttcattaaacttctttgtgcatatgaacatatttgatatgaatcctacagccgtggaaagtgcaaaatcaaggaatcaactatgaattgatatgtttaagcctatggacctgctttggggaagagagtagagacctagcttgcatatgatgaaatggagtagtttttctggaagttgatttttctggttcttcaactgctaaactagaatgtatccatagtagaaagaggtggcttctttagcatcaactgctaagacagccctaaattcatatgcctggtataaatccatggcacacctccctgatctgcaagaacacccctcaggctatgcatttctttttcataattgtatttttttcttatgactaaccttgggctttttaattttacctgattcgagttcaataaaaatgttgaagaggcaagtactcagtgaaatttgtatcagaaactctaacctctggaagggaagtatgacttatcaaagatacaagtgagattaattgattatgttaatgcagtctctttattcaaggtgagaaatgagtgttagaatactgaatctattaccatttataaaaccaagtgcattctttgcatagaataaagtacaatatctcaaatcaagaaaaaatgaaaaaagaaaagaaatgaccatatgtgttttattttagtcctgcactctcttcttcccacggttaccataagaatcccactgaatttatgggaaacactcgcctgacttctccatgctgctgtagacagtgacacacacagggtggaaggaagttgtttctgctgttacctttcagagtctgcagagcaataaaataccaggttagatgattataatgattgttgtcttcttgtcacagataatcattttaatacaatgtttaagctttctgaaagttttttgttcttcaaaatgggcgagatatacacctaaatggatgtggagaaataggaacacatttacactgttggtgggactgtaaactagttcaaccattgtggaagacagtgtggcgattcctcagggatctagaactagaaataccatttgacccagccattccattactgggtatataccgaaaggaatataaatcatgctgctgtaaagatacacgcacacatatgtttattgtggcaccactcacaatagcaaagacttggaaccaacccaaatgtccaacaatgatagactggattaagaaaatgtggcacatatacaccatggaatactatgcagccataaaaaaggatgagttcacgtcctttgtagggacatggatgaagctggaaaccattattctcagcaaactatcacaaggacaaaaaaccaaacactgcgtgttctcactcataggtgggaattgaacaaagagaacacttggacacaggaaggggaacatcacacactggggcctgttgtggggtgggggcaggggggagggatagtattaggagatatacctaatgtaaatgacgagttaatgggtgcagcacaccaacgtggcacatgtatatatatgtaacaaacctgcacgttgtgcacatgtaccctagaacttaaagtataataaatatatatatatatatatatatatatataaattatcatctcaacttcaataagctatagatgtatgtatttataataaagcgctctggtctcccctaaattatcttagcagaggaaaggaaaggaaagctctactttaaatgggtatatatgcccaacaaggtggcaatccctagtattcagtaaattcttctttcccaatataaagatttttaaataagagaagggagaacaagacaataaaaataaatgtttagaaatgtggattaagcatctttttaatgtatgatatttaatttattaatgcaactacacaataagttttcattaatcattttttcatttgcattttatgaaacaattttcttcattcttcttatatatatattctacagttgtgtctacattattcatgtttttttagttatctaacacagatttacaatataatcatttcctactaaatcattaaaaatttagcacttttgaaatctatgtatgattttattccaagccacccatatgaatttccacaaagtaaatatttttaaaaattgatcttgtggtgtttggttttctgttcctatgttagtttgctgagaatgatggtacaccacatgttctcactcataagtgggaattgaacaatgagaacacatggacacagggaggggaacatcacacactggggcctgttgcggggcgggggttgtgtaggggagagatagcattaggagaaatacctaatgtagatgatgggttgatgggtgcagcaaactaccatggcacgtgtacgtctatgtgacaaacctgcactttctgcacatgtatcccaggactttaaagtataataataatttaaaaattgatcttgaggtatatatttgtggctgccacaaaacttcactgacgcttaaaagatgaagttatataccaccttggatattgagtcaatttgtgttaaatttatttctttttcttttttttttttaactgaatctatcaggttacttctttttccaaaaccatcatttcttcagtacctttcaattagatatgtgttcctaaaaagcactttattttttttaaataatgtgattacagactgtcccgtaacatgagacatgtgtgaagacccaaatagaaatcaactctttttttcctaaaggatattttagacagtgacttcattttgtctatatttaattattatatagggtaatgttcattttaaaatcagatgaagagaacaagcaaacaaacaaacaaacaaaaaaggcaaaaaaatgagaggttccaaggagaaaaatacattcagcaaaaagcccacaaagtcatggtacactctggagggacactgtagggtttttttacaggcattcttttggtgaacttgcctgttggacatggctatattcatatcacaatgtttaaagatagtaaacattctgtcatatagtgacttcagtttgttctgattttctgccaagctaagcaaacctctgataatttagcttttcatgtaatttatttatgaaaacataatatgaagatgtgacttgtaaaagataatgtgccacatggagtcagttcttagatcagctggaccctacattttcctctatgcttttctcttttatctatttttctcaggtcaggtggttcttctttaactggtatcttctatcttcagctgttaatggattcagtgaaatcacagccaaggttagccaatgtgggagacaattgacctctttaagataactttttatgacttctgtcttacctggtaagcgacagttcgataggttagctcacagagggcaatcttatttcccacttgcactaagagtctataatccctgaagatgagtggttataaattttttctgcctcacataaaaaattgtgttaattacatatagagaaggaagtcaaatgctgttggttctgtaggttttcccaggggtgaggataatttatcatctatcagcactatggattggatataccttggggctaagacatatttgtagaattgctgagatagaatacgacgtatagtttcaaatattagtatttactatttttttctaaagacattctttcaatacctattgcctcacattgtactatgtggagactatataaagaagtataaatcaagttggtcgccactacaaacggtggttctcaactggagattattttgcccccagcggacatttgtcaatgcttgataacatatttgagtgtcagtatctaagaggtttgtactgacatctgttatcatctagtgagatttaaggatgttgctaattattttacaatgcacaggacaaccttccacatcaaagaaatatacagctcaacagtgttacagttgaaaaacatttacctagatgttaagacaaatgtaaataaattttagcatgaccgcagggtctctaataaaagtatacatgaaatattaaaaaaaaaaacaacctcagtggaaagattgtttttataccattgatttttaaattttatatggtgcttgttatgtactggtccagaaatgttgaagtcctgataaatactttccagggtcatgtagaggtcacgttatcacattagaagtccttttagccatattgcacagatgccaaattcctaacaagaaacagactttaactgtaacatggagaatatgaaactaaataagagattctatggactgttactgacttttgggaatggccaacatataggtcaattgcaggtcagtttctatatttcaatagtttattgtcctaggaagaaagttctaatttaataaattattgcttatggtgaaaacaaacatttctgcttcttggagactagcagcatcttttataatttaagaaaagcccacaaaatttgtattagaagtaaaaagaaaaataaaattttaatctgaattcctatgtaaaaaataaaagagttcactactgactatgtttctttgatttttagagatgtgattctgacagtctaagcacaaaaacccatattttttttttttttggtaaaaactcacttttcctgaagattccttataaagagaccttcccattcttttctactgatttaacttttatcattggaaaaagaaaatccaagaaccatttacttaattcatcaagcaaatgcttaaagcggtgtgttggggcactgggaatataaatgagagcaagacatggtctgtgcatttgacagaaatattgttacaaagtttataacaaaggcatgtttgcaactagcgtacacaccagaatttctagaactgtcttaatgtttataatctggtctgtttttttccgcaaatatatgtatatttattagacctgtgggaatgctactgggagtcatagaattgcaccaccaaccacatttgggggtatgagaaggcttcacagattagaaaagcattggtatagtctaggcggaagagatgggacattcaaagtcattttgtagcgtgagcatgcatcacatgtttcttaaagaataaacctgtgctcatcccctggtttgttggaggaacaatgggagccagatgtggggcttcagtctagaatttgaaggatgttagaggatatattgagaattttaggatttatcccacatataatatagatccctaaatgtttaaggcagtgagaatcacatgattagatttttgttgtagaaagagaatccaggcaataaccctgaaaattggtttgatagaagaaaactagaatgatagaagctaattaggaggctagtgcagtagtccacatgccaaagatatgaaataagccagaagatgatattacccagaatgagatgtattcatacaacatttccaccacaaatcaaaaggtattgatgaccagtttgatgtcagaggtgaggaaaacaagaacttgagaatgatgccatggttttagcctgagtaacatggaggttgctgagtacactgaagaactgttttgggagcaggtggtatttagttgcctgtacaatatttagggagcataaaaaactgatcttatctcaggagagaggttagagtgaaaatcaagatttgagcattattagcaactgcaagtggtggttgtgattctgagggtggatgagtcaacactagcacagatcacagagtgaacaagggggaccattgacagatgtttaaaggagggcctaggaaaaggagccaagagcctgaaattaaatttaattaattaaggaaatacagagagctcccaagggattgttgtcttggtagtcaagattaaaatagaggaagggtggaggtgaacaacagtgtccaattttgcagaacataaaggctattaaagaggtctatggatttggcaatgaggaagctaataatattattggctataaaattccccatataatttctagatagacaccagttcatgcagttaagtaagtgttggagggttactgtttactttaaatttagttctagtgaagattatctatcaaatattgtatgctggaaaattttcttccattatcttttttctgatcacatgacattttttcatctaaaagtatataaacctgtgtaaaaactcacttataccagggatataaaaagcaactttagagattatcttctctgccttctcaattcagagaggaagaaattaaaattagaaaagttgtgcctttctcaagatgtgcacacagtcagttgcaaaaccaaatttgggattgatctcctgattcctggtctgatatgttatccattactccatgaacagaaagatagaggtcatttctatgcagagaaaaacaaatgagctgtgtcattgcagaaatgttctgcatggtttgctgccatctgtcttaaagctcaatctggactcctaggaattgggactgctgagctgcatttagatggaccatgtggacagggcacagaaaatcctttatttggagggcttggttatttccctatatggaaaataaaggatacaaaatatttatgacaagattaagagcctagagctatagaatttttgagatctgacatcctgttttgtaagattctggccctacatgtctttttgttagacttgctgtattttatgtttgttaaaacacagttggagaacaacagtaaacattgcttttggaagaagaaaattataaagcagacagggcactggaatggaagtcactatattctaaccccaactgtgatatattatgtgcttttggatgctgcacactctgggggctgcagtttcctcattggataaaatcaatgttggaaactaagatctcttgaagctccctgaagatttgctcagtcaacttcacatggctttttgaaatttaatacctttaatcagaaatgctctcccaggttaccttaagtcctcttgtccaatatccgtgtggtagcccctgtaagcatttgggtttgtgatccctgatatccagttccttttcagctttgtcattcaatgatgctacaacagaaggattcagtgttagtagctttgtggagcaaagttttcaaagtattgatttattctgttgaaattgtgaaaacaaaggccttaaagctgtatctgtgcaacaaaaatctaatataaactcagaattcttctctaggcatattgtttgttgtggtaatgatatagttgaaaacttttggaaaaataatttaagactagaaattaggaattcttcaggttaaagaaacatatgtcattgaatgtaattaaggttatatgaagattatcagaaaaattgcaccaaaatgtgatcaataatagctttttcttggttgattgtttctaagcatcctttccaaattatgtcaatactgttctgcaaagtttggagaaaaactaaaagatgtataccaagaaatccatgctggtacattgtaatttaacctcctatttttcctgaaaagtcactctttagactaaaaaaaagttcatcattgtgaggcatcactacagttttataatttttttcactgagtctttctcaatttaatattaaagggcttttaagatttatcctccatgtgaaatttggggctttatattctataggcctttcttgaaaatccaaatttcatatgaaaaactagaaaactgatgttgggaattatttgtgtgaattcagtgaagtgtaccagttgacagcaagtcattctgggtgatataatcgttctcatcctcaatcagctgacataaaacaattctttggagtccaattgaactccttcaccagagatgactgttgaacttttaatagtttctgaaaataaaataatcaagcatttatttctcaggagcttaatataaatttcttctgttttattttatctaggcatttttattgaattgtacttgatttgattttctgactcttctatgagaatggctttttacttgtaagtttcactcaaattgacattttgatagtataacacattaatgaaattcctagaacagaggctatgttctttgaaaaaaaatattgacagagtacactaaagggacattttaaagtgcatttgatttcttttgcagcttgataacatatttggtgatgtttggtagctcccaaagctatactttccagtaacatgtccagatgagatttgacaatgttgcaatacatctttccatatctagatttatgtatgcaaattaagttcttggcagtctatgaaaaccacaaaactcttatctcccagcctaacaaaaaaaaaagaaaaagcactttttgaaatagcgaaggaatctcttccacagctactggagtttccagaccacacagagactaatttcctttaaaaactatttttaaaaacactcgtgcacacatataaacatttttctggcactgttttctaggctttcttctaaattacacacacacaaacacacacacgtaatatgtaggcatgtgtgcgtatagatatatatacagatgtagatatagatatctttatttcattcatcctgataacatccttatgatgtagggactatcattagcccttttttgcagatgaagaaatcaataaacacaaaggttaagtaattgcctaaagtcaaacaatcagcaaggaaaggcagaaccagagttcaacaaaacatcatggctccaggatcccggaaccttgccaataaactgtattatgtggccttgattttaatagggaaaatatgatgtcagaatgtattgcccattcagactgtatatttatcagaagttcttacttaagccaaaattcttcaatgtgattttttttttatttagaagcatacatatacctttcctttttccacttgttaaaatctaagataagccactctaacataggcaaagaaattagaggacataagatagaataatacaaacattaaattggtaagcaaattgataacatttttgtattcttatcaggttaataaaaagcataattaaaacggagatataagtcatctcacaggagttctcatccctctgccctgttgcccttctctgggctgtgtgcttagatggtagagctactgtgaaagctttccttggtagctttcctgatgttaccaatgctaaatctagaagtcgataccagaaatacccctggataagtagttaggaaaatatgagttctttttggaaagtgcaatcctggacataaaattctttctaaatgtaccttgactatagtacagaaatgatatgccatctgatccatcatcaagataaacagaaagagtgctacatctcttgctggagagcttgatgaatactgtggctgtaaagtcagagcatgacgagtcagaatgatcagtatggatcagatccggagagatttctcttgccccatagatccatagcctgaattttacatggtatattggtgctctaaggcaggcaattaagggcgctaagccacttttgggtcctataagaatccccaagaatctctttcccaggctatttacagattcagggccaaaatttcgattattgctgggtggttgttgcaattactgttgctattatggtgacacttttcagaacacttatatcagtgctgtgctgagggaagcatagtcagataatggctttctctatgctttattgattccccatttacaaagacacatttttttcctatattcttacactgtagatcctacttctggacaccaaaaatctcttcggccaagttataaactggcaaagtactcttatgagctctggagatacaaagatgaataagaaactagctttgcctttgagaagcttataatctggtggaaaaggatgcttgaaaaaaatagtgttttggaaataaggctgtattttattcaatctgcttacttgctggtctccataattaaatagaaaaatgttggaaaataggataaaggtcttactcatttttatatttccagtacacatagaaatctgttcaaaacttaatcagatgaatacttaaattcttatatttagttaaatgtacagtaaattaatatttaaattttagtggatttatatccataaacaattatgtgacctcatataagtactttcagttttctagaaccatcataagaggttgatgaaccatcgtaagagggaaaacaaaataaatccaataaggggaataacactttatgtatgtataatatttattaatattctcagtgctatacagaatctaaaaaccatgaaacctcattccttcagaaatttgcattttaagatggaattatgacacaaatccaggaaacatctaataaagttgatgactcaggcactgtggagccagaagaaagaatgagaaaatatgggcacataaatattgaaatgatacacacggataaattcatatgcaattgactcttaactattaaagagttgtgaattatagagtattttttcattttccccatgttacttcttgctttttggtcgttgctaggctcattcttcttgcagttacagcagaataaaaggaaaccaaagacggtaaaactcaagagtcaattccataattttcaacaactcagttataaagagatgtagtcagggaaaacactaaaactaatggtttaaatgagacttttaaattatatgtagctttcattcatgcatgagtatcccagttttcaattagccaaaactctgtagttagcttttatttcagacgttaatctacagattgagaaagtgcgctgctctctagcactgatgcctgcttggatatcaaacactggctttcagggttacattcagaaatggaggaaaagaacttaattattcagaaagtgaaagaaagcttatttggggagaaaacaaaaagaaataaggactgcagccaagcaacaagcaagtctaatgtgtttgagtaggtttgagaaaatataggaaagaaatgcaaaagatatataagttctttctttcaactatattataggttaaagaaattgaagaataataatgataataggacatatataacttactatttggtaaataattctatatctaattattttaccatgaagaatgtttacctatagatatcttaatcctcgtgttacggatttaatacaggtcaattatatattgtaaacattttttttccaaaaagtattgatttaaattatttatgttcaattcatttacaaaaaaaatacattgtaagttaataaagtaacagaaacgaatacataacaagctgaatttccaaatgtcaaaatgagtacataaaaagttacaaaaaagcccgtagtttcaaaatataattttagaatatgatccagaatgctgatggttttatttaaaagtttgacatttagaatataaatgttttcaaatatgatatacttcaaataaatatgtttttttcactttttaataatatgatgtatcattaatggtcaagctcctgttttatacttctgctttttgcattagtcacaaacatagtttaaaacagacaatgacatatgcctaaaccaaaatatttttactcataataaaataataaatcatataatcttagtcactgttttagtgtaagattatatttcactccaaggataagaaagaaatgatatatttagatattagtgatttatagacatgtgaatcatattgttactgtacaaaaatgtataattgttttgtaaagtaatgggcttgaataaattaagaaatctaaacatttaaatatatacattgatatacatttatgcacatatatacatatgtcttaaggtttgaggttgttttttctattattttttaaaagggtaaagaaatgtgcagtagtacctgcatgagtatatttaacttatctactcatgaacataatgcatgaattaattttattattacatcttataataatgaaataactccttattaaataattggtcattttaaacaatttactagtctttaaaattttgttcagtgtaactacttaaaaatattttaaatattgaactatatttttaacttttaagttaaggggtacaagtgcaagtttattacatagataaactgtggcatgggagtttgttagagattatttcattgcccaagtattaagcctcatacccattagctatttttcttgatcctctcccttctcccaccctccaaataccacatgttctcacttacctatatggaagttaaatggtgagaacacatagaaacatagaggggaacaacacacactgaactatttataaaggaaaattgttttggttataaaagctatacaatttgaaattcagaaataaagaagatacaaacccattccctcatatcatttggccattgttaaaattatggtatggtattgaagatatggtgagaaacaggaagcctgagaaatggtatgaagaattggaaaacggaagtttgggatgactttgcagagcattcagctgaggtggaacaatagtcagtttaaagtgcctgagatcgttctgcaaggtgaaggagaccgtgagactccaccctcactgtgtagcagaatctttgtgaaacctgcagactcctatcatgatattgggatttccatattctgtggtgagtcttacgcaggtatattatctaaaggcactcgggtacttttaatgtatagtcaggattaagaacaattattcatagttctcaaactttgagcagcatcaaattttcctagagggcttgttaaaggtccctggaccccactccagagtttctgatccagtaagattggagctggaccaagattttttatttctaatgtcatccagctcatgatgatgctgttgacttgggaaccaaactctgagaaccactatttaccaccatctttataataattttgattttacagtatggagatttctcagagaactaaaaatagaactactgttccacctggcaattccactactgtgtatctacctaaaggaaaggaagtcagtttcccaaaaagacatctgtatttgtatatttattacagcctaagtgcatatcagtggtggattggataaagaaaattatatctatatatatataaaatatatatatataggaatatgtatatattccatatatattcctatatatataggaatactatgcagtcataaaaaagaatgacatcgtgtcctttgcaacgtagatgcagcctgaggccattatcctaagtaaaataattcagaaaagtaaataaaacactgcatgttctcacttatacagtgtgagctaaacaatggatataaataaagatggaaataatagacagtggggacttcaaaaagggggaagaagggaggaaagcattgaaaacctaccttttgagtactatattcattcctggggaaatgcgttcactagaagcccaaacctcaacattagacaatataaccatgtaacaaatctgcacatgtaccttacagagagtagaatgatggataccagagctgggaaggctagtggggtttggagggcagtgaggatggttagtgggtacaaaaatagaaagagtgaataagacctactagttgatagcacaatagggtgactatagtcaataaaaacataattttatattttacaataacttaaagaacgtaagaatgtacatgtaaaatgtaatgtacgtgtaagaatgtacatgacaagaatgtaatgttggatttttttgtaactcaaaggttaaatgcttgaggggatgaataccccattcgccacgatgtgcattatttcacattgcatgcctgtatcaaaacatctcatagaccccagaaatgtatatacctgctacgtatgcctaaaaaagtttaaaaataataaaatatattgaaagaacaaagaatgttaattttaaggtacaagagaatgttgttcagcaactatggtattttttttcaaatcctttatggaaaaatttggtatcataaatatgtaaacatacatttgaagacaaaacaaaacttatagaaatattttcatactataaataaaactgtagggttttgtttccttcatgagacatgagaaagaaggaacaatgaattatgccatatgttagaggaatgtagaatacaggtggaaaggagcaaggacatctcccttgcctctcccaggtagggtgaatttgaacattttatttttttaacattccttttccacttttcctttctgagcactgcaaacgtaaagattatcttctgtcagcttcttcctattcataactagggatttttccttttatcataatgatgtggttcaatcttgggcatgcatataatgggaaaacacaggaaacaaacattgaatttgaggtcatgaatctcagaaagagccgtctgtatatttaaattttacccagggtgatgtaaatgtagaagaaaaacatattgtgtaaaaacattgagaagtattgtgaacactgggaggatggtaatgaaaatgaggagaggagaatctaaaccaattacaagggcactccagaaggaagctactaggcaaagtagttagtgtgtctcttagaaacaacaaagaaaaatgaagataattctgaactatccttttaatgaaacatttggaagaatgataaactcttgaaagagtttaaaggaatgtggtgtcattcagatgtgacaattaaactgatttaatgaaaagtaggagatcagtttgtgaggtcatctgaaaggacctcctactgaaagagtttaacttgggtttctactagggatttcagcacttgaaggaataaagtgaagtgataaaaacatagagatgacacagggtcaaataatactatgaaaatatggaatactagtgcaaagattgaagaaaatttctaatattataatagcttatgtcactgaccataatttaaaagctatgtattattgtattctacatatataaatatgtatttttatttttttacttgtaatgagaaaccaaagcttttaaattaggagtcaatgacataagcatgatcaaaaatattgtcgaatgaatgaataattaagttaaattccagaatgaaggttacttaaaatataaaatacaaataatttaatctaagacatacgtgaaaaaatatgtttgcctattttctgaaagtttcatcagtgcttggaatagctaacatatttttaattttctacaatagagaataaagtgatgatacaattgagaggaattaaattgaattagaattatatactgtgtaaatatatatgatagataagaatataggaaatcatttacaaattagaaatagaaaagatatctattaatttattatgcaagtatttggaaagtaccagaaagatgatgttgatttaagaatatagttgtgctcatatattgataaatttaaatttgtcaaattaaactgattaaaatttttggaactttttagcattctaagttttgaggttataatgaaattatgaggaaaatgcttttaaactgaataacccagggattgtctttttaccatgcttgtgtgagatcattattccatggacgcttatggcattagactgaattgattttatagagaaaaagaactcaagattgcataagcccatattagcagcaaattcctaatatctaagtttctttctgtcttaaaatagatgaatttttccatttcgatgaaaggttttggatgaaaagattttgcagtctttatagagcagcaatcactgagtgctacaaaatattttattacatttttttgccttgaattttgcattatgggtaaagaactgtgtgacttaaaatagcttaccaatctttcaggaagttagaaaatatttcattgttgttgatttagagactgagtcttgttctgttgcccagtttggaatgcagtggtatgatcatggctcactgtagcctcaagttcctgggctcaggagatccctcctgcttcagcctctcctgtagctgggactataggcacttgccaacatgactggctaattaaaaaaaaaaaaaaatttatagagatagggtctctctttgttgcccaggctaatctcaaactcctgggctcaagctatccacccggctcagcctctccagtgctagaactagaggcgtgatccgccatgcccagccagaaaataattctttaaaaattttacaacataattaacattgaatatctctattgtaataaaatataataaactgtattaagtggcactctacttatctgcaattgctgatgtcagttgacagcaaggtttgttttcccacagtgtgagtgtctctactaattagacttaattaaatgcagatatattactgttctgtgtaagatttcaatgaggactttgagaaaaagatctctggatggataacagagagagactgaagctggaaagccttgaaaagtccccaaaacaagactaagaagcttttagaggacttgtgcacttagagatgaccaaaagagaatgaagattaaattttgcaaaaataaaatgctaaatattgaataaataattttagttgcttagttaatatagtatcttacaatttttctatgttcctaagggaagcaggaacatatttaaaattattatttttacattttttaatacagaaaagtttatcccagtacctagaagctgggtcactaataatgacaactattagtcactactaatagttgctttattttctgtcagtttttctctcttttttaacaacttgaattagtcatgtttagtattttaatatgttacaccttttgataaggatattttccctcaataagttgtaataaacattttcccatatagtagcaaatattacttacggctatgttttaatctgtgagaaaagtataatttgcttaaattttatttgtggtcatttttagtaatgttccagtattataaaaatgttaagaataaatgttttcatgcttaaatttgtatatgcatcttagattattattgctcatcagtggagttactgtattaagagttatgaatcaagtataagaattgtatcaaataattgtccctctgccaggagccagctctccacatccttcatagcactgagtattttgtggtttgttatttagtagggaaaaaagacattctttttttgcatttatttaattactagtgatgttgcacattttttcacatgtttaagggatgtgtataatttttcaatggtatttttgtcattacttgatgtaaacctccattttgaatataagaacattgtttctcaataataagtgttttgattcctttgagctggaatcagaattgaagttcaggtcttcagactccaaaattgcaagttcttgccacttgttcccccatacaataagaatattattatcaagcactaaatagacaacaagaagtggagtgactgtagagacccaagattggaaagtgggttcaggagaactgtgggccctggaataagacagtccaaacataaattgtccatgttcctttatgagcttgtaatctcgtcgttctcaatgattacaaatcagctcagcttcctataaatgactcttccaaaggaaagccaaaaaaaaggttagactgaaagtcttcaacaataaatatttactgaattcttcctaccgggcaggtactacttcagggcctaagagcacaacaaagtagccaagaaatacctgctttatgagagttcagggtttagtgggtgaggccaaaaataaatatgttaatcaattaaatctatgcgtataatcacagttggtgaagtgttatgaagaaaaataaaggagaaagggaaaggtgttgctagggagaatggacaagtttgactaaagtgatcaagaaagaccttactaagaagaaattgagagcaaagatctgaaagggaataaggatgagccatgctaatgttttgggataagggttctcatcagaagaaatggcaaatgcaaatacataaaacaaaagcattgctgggaatttggaggaaatgcaggaaagccattgtggcaaactcaggaagccattgaggcttgtgcaaactgatagcagatgagatctcagtggtgaggagagagagagcacttgtattaccttgcaggccagtatgaggactttggctgtctctctgagcaaaatggggactgactggaggattttctgtcaaagagtgacattatctgacatacattttaaatggcccatagactgagaacagctgggggacaaagctagaagcagggagatgaattaggggggaaataagttgggaggctatttctataacctaggggtgaaaatgacagtggactgaacaaaggtgataattttggctagagggagaaggtcgtgaagataatgagaaattatttgagtctggctatgttttgagggaagaaccaacaagatttcctaaagtataaaatatgaaaataagagttatcaacaaaactgacgttaaggtttttggcatgagcaattttaagaatggagttattttctgagatgaggaaaaaacaaattttgcaggaagattactagtttgatttgggtcaaagtaagtctgtgatgtatatttcacattcaaataaaaagtttcagagggatgtccaaataaagattaaaatatgggagctgtcagtggatatttacagttacaaaattgtataatcttaccaagaaagtgattgtaaatagagaaggggtctgaggattatgatctgggtcactccaacagattggggacatgaagaggatacaggaaaggagactaacatgaactggtcagtaaggtaaaacactaagaatgtgataccttatatgtcaagtaaaaggaacaggtgcaagcaaatgtttcaaattctgctattggtcaactaaaatgaggaccaatcattgactactgacttagaaacgtagcgatcattgatgatgaccttaccaacaatactttacctctggtgcaattttaaaaggtagaaggctgaatgacctgaatggattggatttaagggtaaatacgaagaaagggatcggaagcaatgagtaaggaaagatctttgtaggaattttgttggaaaaaagaactggcaaattaattgtatattggcaaggtatgtgtggtcaagtgagggttttgtttagttttagttgggagaaagtttttcatgtttttatatgcttactagaatttctgcagaaattgaaaaatgattacataggaaacaaagagaataagagcttgtctttaggtaggtaagaggggatggggcctgatgcacaattggagggattttcttcagatagcagaatgaagggagatgagagaagtcagagtgcacaggtctagatgcaggtaggtgatagacatgatggtgagagcctttggcaactctgttctatttgtttacattttttgagaataaacagctgagagtgaggatagcaggtgtttaagatatggaaagagaggagaagtgaaatagttgaccagaaaagagagttaatctgatttattttctaaaaagaaaattactgtggtactaaatgaaatctacagaatgtttacatattcaaattgtaggttaattatgaacacacatcaagccatcacatagttagctgtagagtttaagccatcaatagtcatttagtttcattatctcacttgtttggttttaattaactttctatgtttttgtttaactttgtgtactattagtatcgaaaggttgtagcttgttaatagagatgcttatttagcattttcaagtgaaaaacaacattaataacaggtacaacattattattaataataataatgccaattattcagaagtggcaggtctatacaaaactctctgacactctattttatcagttattttatacttgattaggcttatataacattttctacttctgcaattttctgataattaataaagaatttcctttacacaaatctcaggctttattttagggaatggaagtctgtgctactaaaaattgcatagtgttgtgtgtctgggcaggcttttcaaagacctctgttatcacttatatccaaagtgataagtctgggcgtggtggcataggccataactccagaactttgggaggctaaggcagcaagatcgcttgagcccaggagttggagaccagcctgggcaatatagtgagacctggtctctataaagaaaagaaaatgtgataaataggaaacaaatatcaataagaagcaagtaaatattcttatgggtaattagagcatctttaagaaaaaaacatcaatttgtatcaataaccttggatgagaatatggtagaagggtagattttggactagatacaactgtttattaaaaaaattccaatttggctactaagaatgaagcatatatttcataggaatcatgtccttgtatgggccacaatgtcagtgttaatttttacatgttattataatatatgcatgcaatggttttaaaattgtcccttaacaatattatgtgttagtaaaacataatatttatttatccattatgttgtgcaaaactacctttggtgtatctatagaaggatgtcagaaatactttataggatttaaattggggcaaaaccgtttgtttcatttcttctattcccttaacaaagataaagtgagtttgtttgaactggaacatagttaagtgttgataggccatgtcagtcttctgtatgaactcctcacccccaccaacttcctgtttctctgaagtgcatgcatacagtgatatatgttttggttttctaagaagggaaaggaagcagaagaatacagaatgagcttgtgagttttgaaactttgggacaaacatggaagttggtgaaaaaccatttgtcagtttgcttgacaggaaaaaaaaatgaaacaaatgcatgcatggacacaaaatggtgtatctagtgtctgcatagggcttcctatgtgctaggcactattacaagtgtttacatttgttaacacatttaattctcatgaaactaccacaacaaaaactatttttatccacatcttacagattatgaaactaaggcacccggagataaagtaacctcctaaaggtcaaaggtcacatagctatcaaatgtgagagctggtatttgaatacaagcagtctggctttttttaaattttttttaatattttatttttgagacagggcctggctctgttgcccaggctggagtgcagtgctgtgatcatgccatcatggctcaactgcaacctccacctcgccagctcaagccatcctccaacctgagcctcccgagtagctgggactacagacatgtgccactatgcccagataaacttttgtagtttttgcagaggcagggtttcactgtattgcccacgctggtcttaaactcctgagctcaagtgatcctcccacctcaccctcgcaaagttctgagactacaggcttgagcactgtgcctgccctggccttcttaaccactgtttgttaccttttctatcataagtatagaagagtaatctaatatcaaactggctgattaaggtgacaggttgaattattgtcatcagttttttacaacctaaacatttttgcttctgatgaaatgttctttaaaaattcttttcagcattcctttttgcattcttcttcttataacgttttagctaaatatgcaaattcattatcattcacgagttcacatgttgtttaagtaggaaggaccacatgggaaaattcataaaaactttgaacacaagtttctgtgttaaaaatgcaaagaactgaatgttcatatatcttttgtttgaagaatttagcttaaaatatgaagaaaactacatggaaacactttccctgaaataagttaaaattgtgatgtcattcactgactattattgctttgccactgacttctgaagaaatcctaggagataaattgcttgtggtgttttctccccagtcttatcacaagtcattgctaatgagtggcttcttcatgatgtaaactagtttcaaattcagcatatattgtaattcttccagttctcattaagcacactgtttatatattatgtctcaacataaatatatgaatggaaatttaatcctttctatgacaggtcatacacattttaaaggaactcttatagttttttttttctttctctgggtcttgactctgacagaggggaaaaagaaaaataaaagcactatctatattaatcattctcaggaataaggctgattctttgaaaagtgagttgttatagttgaaaggacaggtttaaaatttggattagaaattgaaacctgactcctctgcttcccacatctgcaccacccaaagaagtcacttactctcaataaacagagaataataaatgcctaccacatagattttctgtgaaggttaagttagaataaaggagaggtgaatatttcaccacagtatttggcactaagcagggaatcactaaatgttaaatcatcctaaaatattaattgaagtcttaagaaataatgtgataataaagtagccacgtaaacttctagatattgtttttcctcaaaaaggaaaataaactaaatggtgtgaacattaaaacatctattaatattttatatagtgggatacatgtaattttaatatattttttataattttctattttttcctaaattttatgtaataaagatgtatttcttgtatctttttaagcaactattttttcacccctgtttggagttctatagtacttgtgtttattcttacagctcagtttaccagatatgactaggcatgcgtatacgttttctgatatatctaggctggatttcgtgagctctttcagtctatagaatcacatttctttagctcagaaatttgcttcaattaaatatttaattatagattctttctctgttccttcttttattgttattcctattacttgggtatgaggtcacctgaatatatctgccaagtctcatcttttctctcatgttttccttctcttctggatcattcaggctactgattaagatctcagcaatgactgtgctcaccttcaatatatcttctgatttcctaagttgagacatctgaatcttctacttgtttttttttttgtgtgtgtgtgtatatccagaaattcttgttagtggtagatttgaaaatgtttaagtgctccattttttttttctgttcgggaagtttcctgactttccaaatagtttgataacccatgttttcttagacatgtgttctattttttgaggctgaactttccttcactattaattgtgtgagtgtatatatgcatgtttgtatcttcttaagtcagctctggtaaagttgttgggttacactagacatagacattctgaaaagagataaggaaattcactaaaaaggaaatagaaattccccaaaatatgagaaataaaactgacactcagaacttgccagaaaaatgcaaattaaaatgaaacttaattttacaccaacaagtaaatttctgttgagaaattaagagaactaaataacagaattgtagcagttttgcagaaactgttaattctgttatattgttaattttgtaatttatgttaattaaataacagaaattaagaatcatagcgctaatgtgtagggaacagaggactgcttagaaactgctggtggaagtgagaatggttagagccctcctcctttttttgtgaaacaatctggagtctattaaaatttaaaacacaatatatgtatatatgtatatatattttatttgtagagtatcatacactcatggaaaaatgacaggttgttttcatgggtaaaaggtttgtacatgagtgaaatttgacaagtagtgttggaaagagatggggaagaatagagctaagaatgaaggaaaagaagaaaacacacattttattttatcttgaaggcttctattttactaattgcatttataatacaaaaacagaactttttttaatgaataaatatatcaaataaaaaacagagaggatgtgaagaaataggaatgctttacactgttgatgggagtgtaaattagttcaaccattgtggaagacagtgtggcaattcctcaaggatctagaactagaaatcccatttgacccagcaatcccattactggatatataaccaaaggattataaatcattctactatgaagacacatgtatacatatgtttattgcagcactatttacaatagcaaagacttggaaccagaccaaaagcccatcattgatagactgggtaaagaaaatgtggcacacatacaccgtggaatactatgcagccataaaaaatgatgagttcatgtcctttgcagagacatggatgaagctggaaaccatcattctcagcaaactatcacaaaaacagaaaaccaaacaccacatgttctcactcataagtgggagttgaacaatgagaacacatggacacaggaaggtgaacatcacacaccagggcctgttgggggatatggggttagggaagggataacattaggagaaatgcctaatgtaggttgtgggttgatgagtgcagcaaaccaccatggcacgtgtatacctatgtaacaaaactacacgttctgcacatgtaccccagaacttgaagtataattttaaaaaataggaataaacaaagagaaatataaaaagaacccaatctgaaaatctaagtaaagcaattttgtaacaaagcaggaataggcctcaaatacaataaaaaagatggaaagtgccccaggtctcctattacctatagcctgtgggtgagtggttacactatctaaaaatcactatgctccagcaatcccacttttggatacactaccagaataattgaaagcagagttctgaggagatatttgcacatccatgttcacagcagcactattcactgtagccaagaggtagaagcaacctaaatgcccattgaccattgacagaagaataaacaaattgtggtgtatacatacaatggaatatttttcagccttaaaaatgaagtaaattctgtcataagcaacaacatggatgaagcctgaggacattatgctaagtgaaataagccagtcacaaaaatatattgtatgattccacttatatgaggtatccaaagtagtcaaatttatagcaacagaaacaatggtggttaccagggaatggggaaatagggaagagaggagttgtttaatgagtatagagtttcagatttgcaagatgaaaaagttatgaacatctgtttcccaacaatgtgaatgtaacatttaaaaataattagtaaagtttgttatgtgttttttacctgaattaaaaaatattctcagtagatattctgttctcccttctgatcttcatgaattatatatatatgtcatatatgtaatcttatttattttgaaataaatgtattttcttatttatattgtatattaatatgtatatttgtatatttagaaatgaatttagaatgtacatatatgtgtatatatccccccacacacatatttagttatggctttccctttgatgtgagcttatcatttattttgttctgtagctgaccttttccacttcacaatataacacagctttccttccatgtctccttattgcgatttgtaataatgatactgttgatgatgataactttacaattattgaaaccatagtatttgccagacactgtttcctattattttattgatgggcatatttattgcaaaattgctacagtaaacaactgtaaaaattttctcatggatgtatttctatgagtagaattctgcatcacagatatgaacatttacattttttcccatttttaaatgttagtgctgccaaattagcctccatagagcttgaaaatatcctttctggtatactcttgccaacgttgcctaatataaatttaaataatttatctaaaaattttaaaatgtttactaatgtaatttttaatatatcacattactattttaatttttctttcttcaattcctagtgaggtgagaagcttttcttatgttcataggtgatttgtatgttttctgactacctcttgtttgtatccttaatttacttatccctttttaagttattattttcttcttattgattcacaagagccctttctataactatgtttaggaagtatctcactataaaaatgtttataatttttatataatcaaataaactggaatttgtttgaaatacatgatactacatcataattagaatcctgtttctcatatcttaatagaattcatcccattgtgacttgtgacatggctgttctctcaatgaccctttgtttttctctttgctctttctcttttaatttgttctcctttttcactctccatttctaatagggccttttcttatttatccttgagctttccctcttccccttgtccctggtctgtagtttttctcggtctctccaaaaacattcacttgatttctttagtaattttttggagtctctaatccttttaaactaacatttttttattttatttaatattgtttggagataatttgatttctacatcctctaaatatttcatttcatgttcttagtcccatagtccatttgctttcccttgtggttttttgtatttgcttagttattgggttattgtgtcttttggacagaatacatccatcataaaagcagcaggctcacagtcatcttacagcttccataagtcactaccttgttaaggcagcctgcagtagtgaaggcttacacagaattaaggtgaggatgataagagtcagtgagccccttggaaactaggaaataaaattaccttcattgaattaaattatataatcacatgtaatgcatgaaattatatattcattacaggaaaaatatgccttagatataaaaatatttcccctgaataaaaaacagtttggctaagaccattttctttcaggctattagcctatctgaattaagactcaagctatatggacaaaagaataggcttgtgtgtaagcggccctatgtgttgcttctcagagagcaatgaatcatccattaatgcattgtcagcagcaaaggtagtgaaatcactcaataccaaacagttatatagcattcatatttgtggcagagtttgtgctaatggatcaattgataaagaactttttattacagtctgcaatcagatagcatgcttaattattttttccatccatttgaacctatagaatacattctcaagtcctgaagcaatctcctagacttgactcagaatctgaacatactatttccatatacttagcataattcatctaagtactttaagtggaatcatttcagccaattgcatttgcaaatttggcactaaacatagagtaaggaagaagattgatatgaaagtgtgaaatggaagaatctttgaatagtttataggagattatgacatctagaaaaagtcagaattacctagttgagagttttcttgggaacaaaatgcccacagcccttaagttatcatttggcaaaaattctcattagcagttgtattagtcggttttcatgctgctgatagagacatacccgtgacttggaagaaaaagaggtttaattggacttacagttccatatggcttgggggggcctcagaatcatggcgggaggtgaaaggcacttcttacatggtggcagcaagagaaaatgaggaagaagcaaaagtggaaacccagataaacacatcagatctcatgagacttattcactatcacgagaatagcatggaaaagactggcctccatgattcagttgcctcccattgggtccctcccacacacatgagaattctgggagatacaattcaagttgagatttgggtggggacacagccaagcagtatcattccacccctagcccctctaaatctcatgtcctcacttttcaaaatcaattatgccttcccaacagtcccataaagtcttaactcatttcagcattaacccaaaagtccacagtccaaagtctcatctgagacaaggcaagtcccttctgcctatgagcctgtaaaatcaaaaggaagctagttacttcctagatataatggcggtacaggtatttgtcaaatatagccattccaaatgggagaaattggtcaaaacaaaggggttacagagttcatgcaagtctgaaatccagcagggcagtcaaattttaaagctccaaaacaatctccattgagtccaggtctcacatccaggtcacactggtgcaagaggtgggttcccatggtcttgggcagctctgaccctgtggctttgcgtggtacagcctccctcttggctcctttcatgggctggcattgagtgtctgtggcttttccaggtgcatggtgcaaggagtcagtggatctaccattctggaccctggaggatggtggccctcttctcacagcttcactaggcagtgccccagtagggcctctgtgtgggggctctcaccccacatttcccttccacaatgccctagcagaggttctccatgaggaccccgcccctgcaacaaacttttccctgggcatccaggcgtttccacacatcttctgaaatctaggtggaggttcccaaacttcaattcttaacatctgtgcatccacaggcccaatgccacatgtaagccaccaaggcttagggcctccaccctctgaagccacagcccaagctgtacattggcccctttcagccatggctggagaggctgggacacagggcaacatgtccccaggctacacacagcacagggaccctgggcccagctcatgaaaccactttttcctcctgggcctcttggtctatgatgggaggggctgccatgaaggtctctgacatggcctggagacattttccctgtggtcctgggaattaacattaggctctttgctacttatgcaaatttctgcagccagcttgaatttatcccagaaaatgggtttttcttttctgtcgcatagtcaggctgtaaattttccaaacttttatgctctgcttcccttagctctccttgctcctcagcttgcaggcagcctattgtgggaccttgtgatcatataagttaatacttaataaactcccctttatatatatatatatgtgtgtgtgtgtgtgtgtgtgtgtgtgtgtgtgtgtgtataattaattctgtccctctaagagaaccctaatatatcagtatttgtattttattgacagtattgcatgtaaatttgtcccatattctaatgttgaataaaaatggtttcaaataactgtatcatgattaagttttatgtgtgtgcatctgtccaattactctggctgtcaagaaaatagttattaaatttcataaatcaccatagtttaatcactatgattgcctattctaacattttctcagcaataatcataatactgttgcaggatacacttaaaaaaagaacaccattgcattctaaagcaaggattgtgactactgaagaggaagtcaaaatagtctgtatctggcatgttaggcagaattcttatacgtcaataagtatattgatggtcatattgatgacactacaataatgtaggatcttgaattgtaatctgaatctataaaatattacattgtttataacaaatgagttaacaatttaatgtggtcttattcatggataataggtaacccacgtgtaacctctctatgttaatcagaatatttagttagtgaacatccattttgtgaccgtccttgataattgaaaaaaatacattagaatatcaacagctatattatgaaactgggtgtattgcaattcagcaattaacattgctgccataaatatcagtatccacatattttgtagtaggaataaaaagtattgctcaagaaaagtagtaagttttagaacatgatatatttaagttagtattaaatcacaagcttttcattaaacacttagttttcttgggatcactgaatttttataaaagcttcatatgttctaaaataactgggaatgtttcagcatacaattacaatctatgtgactcggggatagggtgaattttcagaaaagggctaatcaaaataggacatatgtattactgactgcaacaagaatgattttgtattgctgggggtttagactccatgaaaaaaatgaacctattaatttgaataggttagctctttttgcatgttatcaaatgtagttcatctatatatttgcactgaagcaaaatattaagaagtaatggctgattaaattttaattttatttttgcctacaactttgttagtaaatattttttctttttctgccatttgctaactgtttattctgcaaagacttctatccatgtctgctttatttttaatgagctctttcgctgtgtgttttgaaacctaccattggccagtgagggtgaggtggggacagtgagggtgctggctgaggatgggtggtatgggttagtgaaagatgggcataatgtcatccagaaaagttttaaagcacataaccaaatattacagacttcagttattagcctttaattcctaaacaaccattgtctaagttacaacatgcccaacttcaggaagctagtcctcttttaggtttatttgttcctatgtatatctgggagtcccaaggagatcttaccttttttgcccatctgtcctaagcttagcctattgttccactcttctgggcttcgtcttctatcccttgagtgcaggtttcctcttccaggacacttctcctccacttgtactgctgcttctgcaaatgtggatgcaggttacctggtatctctctgagaatagctaagtccaggctctactacctaacagtacttactgaaaatgtcaggcacagacaagaatgattaaactcatttctagatataactgctctcatgcttcataacacaaaactcctcactgggttcctcactgagttcttatagtttagacttctaccgtgtttcatgggccaatttatccctctcggtaagaatattcttaaccaggtcactcgcaaacagaatttatgcccacctacccttttcccccaacccactgtccttaatatgctgagtccacacagaggaaaacaagtttccatcttatctccttctttcccagtcacagttcagtcttcaagttaaataaaatgaaatgaaataaaacatcagagatgaaagttcatggaggaagagagaactctatttaaaaattattattatgcaaatggttgtctcttagctattataatacatttacataatcaaaatcttattaaaattttccccataccaagggagcattttgccctcaaataattcaaaggcaacctgtagagaaataagaaaagctgatgtatttttaaaaatccgtatactatcctcacaccctcatctatttgtagccatcataattgtcaaaattggaatccattcagtgctaaaaaaatcctgtttcatgtctattgagaacacaaacgcaagggggcatactgtaattattttaattaataagcatatgtggttatttattgagcataaaatttgggtgtgatacaactataagccctccatctgtgtaatgtaatgtgccctgaggatgtgatatagtgatattaataactgggaactcatttttatttcctttaattttgtatcaattcatttcagttatcattagcttactattcatcccacatcaacttatgtatgatactgtgggggaaaaaaggcatttataagaaaagctttttagctttttggaaacctatgatttaattggtaaaatttaggcataaaaatttgaggtgatttgtaagcaatatataaacaaatgcaagaaaatgcactttaggtattacaagaaatcaaaattgaaatatggaacttagttacttggttaagatagtataggaattgatttggcccaataatggtgatggatttcagttgtggcagaatattcttttttttttttttttttgagacagaattttgctcttgtcacccacattggagtgcaatggtgcaatctcagctcactgcaacctccacctcccgggttccagcgattcttctgcctcggcctcctgagtatctgagattacaggcgtgcaccaccatgcctggccaattttatatttttagtagagatgtttcaccatgttgcccagactggtctcgatctcctgaactcaggtgatccacctgcctcggcctcccaaagtgctgggattacaggcgcgagccactgtacctggctagttgtggtaggatattcttgaaatatgaaggcatacattagcaagactaagaagtacatagactgaatcaagacaaatgtttgaaatgagaaggtgggtccagttgatgtacactcttgagtgtcaagctgagctgttggggttaagttcaagaggcaatgttgtaaattcttgctccagagagtgttggcatgtacattacatatttggttaaatgtttgattgatagaaagttttttatgggtaaatgttggtatacacttgtgagatatttcagtgatgggaaaaattgtaagcaaactaacttcaaaaattcaagcagaccttgggtcatagaagaatagggtcagctttgaaaatcattaagagatggctgagggaaagtgaaggagtttgttctgttttaacttaacaagcatttgaggtagggtacatgaagcagaggtacctgtggaagatgttaatgacatgagcctgaatataggacaccacatcatcagcatttccatcaaaaacaagaagagctgctatggaaaaggtaccaccctaggcgatagggatagtgtggtataatacactatccatgattttcagggagaacagaattcatacacaagaatatcaatgaatctgtaatacttaacttgccaagtaagtgtcaaatttgggcatctattctccataggagattgattagaaagtccttcagacaaaattggacttcagatgagcctttaaggaaagtggaaaaagggaaaagaggaaattatctaagtctcttgggtgtctgcaaatagctaacgccacaagaattaagccgcgaagtagtaggtcatcagattgacaagggaggcaaagcaatttggaattagtctctctggcaaaggatgcctatggaatatttctgaacataaggctgatgtgaaaacagttattttggggagtcatggtcaagttcgcactatgtaacaggaaggtagaaactaggggcggtcaggggagttactgcatcattataatattctaggtgtgttctttaatagagaggggcaagtaacgggaatatgaagaacgtgacagactgaaaggtgtcagaaaaataatgtcagtaactgactggaagtgagagaggcaaaagtaaagaaaaattattttttcctaacctgtttgtttttgtgacattgacaaaaataaagcagcctggtgctggttggggacgctgggtgtattcgcaggacaccatgaccaatttggtttgaggtcctggaagaatacccagttgaaattttttttctagactattgatatgcaatttttgaaggcacaaagtcattttaaaatggacttttagaaattaaatcatttgaaatagtaggacatggggatctggaaaggctgtactatccgtctgaggtaacacctagaaatatgaagtgaatataaatccagagggtgagttctgtaaaagagcgggtccctgtggggagagcttagtgctacattgtgatttgggtccctcatttagttagcaagcaagattaacttttctccaaagttgaagactaaatctaaggataaaaaatgtagaaactgctttcaagtacaatgcatatttgatcttcatgtttatcatgagttaggcaggatagtgttattcccctgttagattaggaaaattagacttttgttagtctctgaacactttcctttcatgccaggcctctggtcatagcaggggaattttagaaaccaagaaatcagaggggcagggagtttcaataaaggggatcaccaagtgtaactgaaaatcaaaaagaagataaacttccctctctcttgtttactatcataacatgctgtgcttgtattactacaccattaatagctctgccttttgattgtttcctctatgctggtggattctgaaaacacacattgtatattatttgtattattttcttgttttaacatagcacctgataggtggtcagtatatttgtattgaatgttcattaccaggtgttctccagcagaattggaaataagtgtgtaaaatacaaaatgtagattctgagctcagaaactcataaactaagtctagatgggactccctccatttaatatgtgcttacatgtggaagtcatgggtggagaataaggaaatttaaaaaaaaaaacagcattagaaaggttgaagatatcaacatgtatgctctcactgagaatttagagaagactgaagtctaacccttgcacaatattctggagtgacagggctgtgggatgaaaaaggaagccatgggggaatttcttgagcaaggacactcagccagatggacaagcaatactgttgttagaggaatactagacaagccaagtataacagtgtcaaatggaaggaatatactgagaacttgggatgggtgcatgtctgcataaatttgtgtttgcatgtgcaaccacatgtgcttgtggttgagcaaatctataaacacaacttaatttaggcacaaactaatggaagcagaagccagttcaaaggcattaatgaaagtaaagctgagagtcctggaatggcttcagggatgagcagcaggatcaaatacattttgagaagagatgattatcttccctccagaatatttatagatatgattgtttaaagacatgaaggaaggagctaggcaagtaaaacagcaaatatgctgacatcaatgaggatgataagtgaaaggacccctgtctccagaggaggttggaggggaggtccagtgtccggacagttttgacctgactgggcaggaagaagtgcctctatttttggacattagagagaaggataagagctagtatggattctgaagtgaagtgcagtgctatgagcgtgctcacaatcaatttgatggttcttctggatttgtcttggggaattaggaggtaaggccacctgtcgagaatgaagttgacatagacctgaaaaaaagaaaggtcagttgagaatagtcactctatggaaggtgaacaataaaaatgaatcaagatgatgagagtttgaagggagtcagagatcaacccaggggactgtaacattctgtatttgaaggaagcagggaagaaaccacaaagtggggaagattcaaagtatttatgacagaagatagaggagcaagaactgaatgctttgggtgccaggaagtggagagtctcaaacacacgggaaatattttcttaggaatatacttgggacatttgccttgtaaaattgcacctaagacttcatgttttctgattaacagtgttttgttattttatctcaaccttctttgaagacatggtacatttgtctagctttaaacaaaatacttttttttccaaaataagcatatttaaggaagataattcttaggtagaggaaaaaatgcttctgcctttttccaggccctattaggaagagcttttagaaaacattgatatatgtgttctctaagtctagagttctgattaatgggcacattggcatgtttctgcttccttcacctgctagctaactcggctgtgggaaatttcttcaggtcaaattaagggtagaagacaagagtataatgccccaggagacggctgtatataacttccacttaaatgccaccaatgaaaaaattgccttggtataatttaaagcatttgtttaagaagagagtaactttataattgaataacgctgcttccttcctatcaaccccatgggtatgagagttaagaactaaaacaatttaataagataatatttcaagtgcataccgttcttcctttttcatacacagagcactttgaatccaagggggaactgtgtgtgcacaggcaatataaaaagctaggcttgtggaagaaagtggttgcctaaatccaaatgcatagtatgaaatagaagcatgggcttcttatttttgaaaatctgtttgataaaatgacgatggattattttcctgtagtgcaggtgctcactttactgcaggctatattcaataccaaaaaaaatgacgcggggcatgcctgggcttcctgtgctacacagagaccagatgggagctcagggttattttgtttatcatacagcctccaatgttggaggaagttgctgtgaggaacagagactatttaattccaaaactcttggtattctaatagttgcagatactctgactgcttctgcacagaacacatttttacatttatggagtgattaaaattgtttacgtatagtgtttcccccagtgtgataatggacatttaatcacataacatgtgccttccatttgtgaaatatcatgtaacattcagcagagttggcagtgctgttaccagattcatttctcatgtctgtggcactccttcacttcctctaaatagtggttacatgtctttcagatcttcccaaatcctcatactctctattccacacttctgctttccctttctctgaaaaattagaaaccatttgttgataattacttcaacttccctccaatttggttataaatttcctttattcatccctcctgttcttttctgttcttttctctatcaggagcactcaactcctttctgagcataagcttttttgaccaggtctctgtcctgcacttaatatccctgttttccacctgtccagatatgtgaaaatcatgtctcctaaattccctcttgctgtgttttgctcaccagctaacaccaccctcaattttatatagattagccatctggtggtactttgaaacgagattgatttaatttttggacactgtgctttttttgctaaacataacctgtgaagtcagtgtctaaatcctggcagttcccttttcacaaccttatttgtctgactgacttttagtttaagatttattttctaccagactattgatttgataataaaatacctttaccttccgtttttatttttttgtccaacttatctaccagtgcttttaatgacacagtttcatttcttcagtgctgtgtcccttcatttcctatgtctcctgaaattttctcttcactttcttataattctttttctgcaagtcccaaagatgcttgagacttttatagcataataagcaaaacagaaaaaaaatttaaaaccttactttagttttgcttttctctttcaaaataatacccatatcttattgtgtccctagaaaactcctgagggcttaccaccaatgtttcagccccttgcagcctggcttctatagtcaccactatggaaactattctctagcattaccattgacctttaaaattactgatttcagtatctattcacagtatttatattacttattgcttgattctacttaaagctttgatcagaaactccttattacatcctcttgccttttagagtgtgtcccttccctgtcgctaatgggaagcaccacagtgaaagtctaaatatatcagctaggaagccttacagacctaccttcctgttctggcctctgataggatataaccttaggggagctgtttaattcttttaagcctcatttattcatctgtgggagacaaattctcctcacaaatttgctgttaagattagaggtaatgaatattaatgtttaacacatttttggtacatatgaagagctcaataaacagctatttccacaaaagtttctaatatcaccgactccactatcaccactatcatcccatcgtcatggccattaccatcactcaccaccagaatcattatcatcatcatctccttcattttggatcatcaaggttgtctctagtcctgtttttactatttcttgttctacctcatctgtttccattaacagtaagaaaacaattctaacaaacacagtatcgacaaagtttcattgtgtccctttctttgtaaaaatttccagttgtactgcatttcctcctaatatgtcatttgtgtcgtctatgattttgtcttatcttctagtgtattcccccatgtgtcctatggttaagtcccaggatatcacatacattcacatttcttgatcacagttatttgccagtgcagaaaaatgttctatacacatgcagtccagctgaattattatctccttcttgaagtcatttttatagcccctagttgaaatgaatgattaaatattcctcccatagtgcccattaagcactttttatagcatatggcatttatgttgttcagctttgtagtataacaaattgcttctatgtctgtctgaccacccttctcccaatcctaaaaactgctttaggataactacattgtttcattcctttttgaattacaaccagctttgttcctcaaaagggtgattcctgagattggcagttttatacatccatgcatacaaacacacacaatttcaagagcacttacatttagcaggtgtccagaatacgaaatggtaggccatgaactctagagggcttgaaaagccttcaaagatcacctcatcggaagaggctacccatgataaagtattttaaagcaagcaacctcccttgataatctcattgcttatgagaaaatagtagatattaaattatagaagacatgggatatttaaatatgctttaatggtttgtggcctatttattattatatagagtgtatacatagccattcactaccaataaaaagcatttatttttccatatatttgaggcaaatgaaaagaaaatataatcaacatattccaaattatttaaactaatttgctattcatttatcagttcaaaagcatttacatagttttgagaacttttttcttttaaatattttattcagttcttgaaagattattttacatatattgcctaacaaaatatgtgcttctcactaattatatctgttaattcttttgttttagttcactattaattcctatcttggtctctttatttttaatacagatgctatgtgtgtaactttaagccattgcattccttattctagaaattgcccttacattctcacatggcctgattttatataaaattgaggtcatgtattcttcatatcaaattggttcttttttaatgcaagatatttcaaataaaagtttccttaatgtgaatgtttcttaaactcaaataaaacttaaatatagaatatttcttgtgttaatgaaaatctttccaatatgtaaaaatgaaatttctttcaaaaacaagaaagaaactaagccaattgagaggtaaaaaaatgaaaactatagatgaagaaaatggatgttaatagcataaattatttcattggcattaccatatattgtaaaatttgacctaacaaaatctcatagatttttattcattaaataaaataatatcttaattgtttgaagttattttagttcagtttgggtatgatactatatttttggttttattctggccaatgtacccttaacttggaaaattacatttaattacataatttgctagtttgacctatttcttttatatcttaaaagcataagcagatacaagcaattcagtacttctgatcattgtataatttacattatggtcagcattgcataatgaaaatcacttattcgttgcaaatgatggtagttccttatgcaatcaaagatggaggtaaacatttagaatgtgaattatttctgaaaatgacaaacacatacacatacacacatacacacaactcaaggacatttctcccctaggggtggttgtcatatacttcagtaatgcagattaaatttctagtagctagttggatagagcttttcctatcagggaagctaaaattcattaaaaactaattagaaatgtatgggaggttaattttccacgttaagccttatgaaagtgagataagtaattcataaagtatcaaaggattgctctgaccagaaccaaagaaaatgacattaccaagtattgtttcctgataaatcacagaagctatgaaaacaagacaaggcaaaaactcaggttcaactcatcttgctttttgtcagaggaaaacaacaaacgtaatgtctacacaattctattaaatggtggttcctggcaaagaatctgtgaagtagcagctgtccacacaggtggactgcctccattttagtattctagctagagaaaatcatgccatttgccagaatacatttaccctcagcaaaacgtcactgggtatgaattctagctagattcaatgtccaattactgagcccaccacaggacactataatagcagcatgtccagttctctgaataaatttgtcagctgcattcaacatgcaatttagatatgtggcatatagtggaaaccaaaaggaaatattcaaatactataatttttccttttgctaaacttataatttctaaaatacattggtatcatttttaatgttgtcttccagttaaatggcttgggttatttccatgctggaaaaattaagttgattctgttgatatcctttcctgctgcctcctccagcggatgttctcactcctccctggtgatcctaagaaacaggacagctgctgacggtagtaaacagcagtacaattcctgcagtcccaattcggatcacataccctgttaaggcaggaactccccacctccaagtctccaggtgaaaggcaacaaggagagagggagaaataatagatagtatgtagacagtgccctaaatattttcaaacaagcacacttggatttacatatttatataaatgacctaaacttctttatttgtccctttcttttgactcacctaggttttcagttggtaactccttgcaggcagtctcaggcgtgactagttaattccatggtgctactttgaacctaaattaggcttctacagttactacatatttctttgtatgtgtcagtgtagcacaggttgtgctttggtgtcctctgcaggcttgttcagtgtcgatgtggtgcttgcttggttgacttcagtgagtgcacagagtattatgctgctacgttccaaaatatgcaggcgccagacatgtattttctcttttattatataggctgtaggtgatgttacataaacctgttttctcatgccccgtttctttagattctgcttttttgttgttgttgtttcaaacttgtttgtcctctgatcaagtctaaggtttttaaacaggacaatgcaaatatgttttactattaggttttctactcatcattacactgtgttcaaaaatggtaattgaaaatggaaaatggaaaattgttatgagaccaattagataatgtgcatgtcaagttcaagtttaactgagaagtgttgtatgtgaccattatattgtctagtattttctataagaatggcagatttttattcatatcaatcatataatgatttaaaccatattattacatttaaaatctaccttaaggtaaaatgaaagtttcgtgtagtgaatatatacaaatattcagatatcaaagagatttacaatgtccctgaatggtaaaactgaataattgtacaaatattgtttctttccaaggtattttatagttttaatgcagtattttaaaggtcatctttttccactcttttctccaccatctcatcttctgtcttgttcaatcccttctcttttcccccttctttttctccctaactttctcttcttttctcctcattctctctctcagttttctgatcccctttttaagagctttgtaatctggagttaaatgaaaatgttaacaggtgaaaataacttatatattttgttaaaataagtgagtaacgatgagcaatttgattgactaagagctaaatcttactgtgaactcacagtaattaaattagcaatttacagataaagcatcaaaataagacaaaatagacataagtccaaccatgaatatatatatatagagagagagagagtgatagaggtgaccaaataaattagtgaaacaaagaattgttgaataaataggactagtaaattaattatttgaaaaggtaaaagaaagtaaattaaaacaataaaataagtcataaacatatttgcttaaattataaatgtcatacgatacttaaggtcaagtagcaaggtcctcataaaaataactgataagtggaacctaaataaaattgtcaaaaaattagactcataatcataaaaagtaaaataagaattatagtaataacaatagcacctatcatttgctgaaattctacattctctcaaaaaacctgctaagtgaattatttataatagcacacgtaaccatctattaatcacattactctgtaaacttcaagggagggacatagggtttaaagatttaaagtaatttattaaactcagagtcagaatttaaaacttagcctgactccatacattcatttaaaacattccttgtttgtggtcatttaggttgttttaattaattaatactataacaactagttgatatttctgatactcacaaacatacacatacatgtgttcatttaggagataaatttttcttttttgagatggagtctggctctgtcacccaggctggagtgcaatggcacgatcttggctcattgcaacctctgcctcacagggtcaagcgattctcctgcctcagcttctcgagtacatgggattacaggcgcccaccataatgcctagctaatttttatatttttgtagagatgaggtttcaccatgttggccaagctggtcttgaactcctgacctcaggtgatccgcccgccttggcctcccaaagtgctggggttacaggcatcagccactgtgcctggccacttcttttaactgttatactttaatcattgaaaaagacatgctactcctattttattcatttaatgtcaccttggtaggcattcatattgcttattgatttttcccctattacaaataagttaacatgaaattttaatatacctatgttttgctcatattaaaggctggtagaattactgaatgataagggatgcacattttaaatgttaactagatgttatcagaagtgatggcgggtatttctatcttgtttctgaatttaaaggtaatgcatctgaagattgaccattaaggataatcacactttatatttttttgttttagaagagttgctatttttctttacttgaagaaattttctttttttatgtaatatttttagacatgaggccggtgcggtggcggtggtggtggctcacacctgtaatcccaggactttgggaggccgaggcaggctgattgcttgagcccaggagctcaaggccagcctgggcaacatggtgaaacactgcctctaccaaaactacaaaaattaacctggtgtgttggagtgtgtctgtagtcccagctactcaggaggctgagacaggaggatcacttgagcctgagagccagaggttgcagtgagctgaaatgcaccactgcactccagcctgggtgacaagttgggaccctgcctcaaatacatacataaataaataaaatttttagacatgaaataggcattggactttatcaaatttttgtccacaattactctctcatgcgatctcgaccatcagtatttaatgttcttgccaagatctggttctattaaatgagattccaggacaagtacagacaggaaatgccagagttttggagaatatgaagatactgttagaaaaaagaaataaagaatatgatgattgataccattgatacacaggataccaaactgaccatgactactataaaaaatgaagatgaaaagaataaagaagtatgtatgatcttctcaaggaaatcaaaggaacttagaactgaagcatcaaaatccactcagcaaaagactgaaagtgaccactttggctcaggtgaacaggagatatcagactgctcgagcagactctgaaagtgagcatgaagtttgaaaaccagaatcataaataaagaccggattatcaagaggaaccacaaaagcagcaccagtaaaagaaaatataataatgcaccatgtctcaatgaagatgagagtttcacaggaagtgtgaagatagagatggaagccttttaaaattgtcctttaaaattatattcttttttatttaatagttatcctcatgtcaaaaatttctcaaataatttaattttcatcaggattgtgattagatttgaattcattgattaacttaaatcaattaatatcttgaaatgtttcaacatggtgcgtggcctcgtttatttatgtcttcttttatgtccttcaatggaaatgatagaaatgtgtaacttcattaacaaagtgtttcatattttggtaaagtttattttggaatatcttaggaaatgttactctttaatttgcctgctaaaattttgatttggtaactgctgatataatgtaatgttactgaatttagcatgttggccttcaatccagcaacttcttgcctcttaataattctcagagtttgtctatagattctcagggttcatgtgaagaccataaatgtctgtttcctgaataatgttttaattttgagtgtgctttatgacttttatgttctttctttatttttactatctttttgccctcattggacctctttataatgttgaatagcaaaatcaatagcaaatattaatgtattcaattatgaaatgtttataaaattataccaattatggatgatgtttatttcaggtctgtctgttttgtgaagcagaaaacaatgtttaattttaaggaagttactttctacccctaatttttaaaatattttgtagtcatgcataggcattaaagatcatcaaagacattttatccgcctattaacaccgatcgcattttctgttctttatgtgatgaaattacattggtagatttttctaaatttagatcatcattgcaaaaacctttcttgtcctgtatatattcttatagacacacacacacacacacacacacacacacacacacacacctggagcagagggttaattatgcttcttagttcatagtgtgctataattattgatccctgcaagggtcttgtcttattatattcatctttatttataagtttgaaaagcttataattttattcccatgtgatactatgcctagtcctaagatcaaagttatactaatatcataaaattggacagttttgcctcttttcctatagtatgaaatagtgtgtataagatgaagaatatctatttcatgaaattatgaaaaatccctacaaaagctcccggactaggtaactgtttttattcttggtcaattttggtaagttatgtatttctatatatttacatgtgtctgaaaaaaatgttttatttattcagttttttgaaattttttggtataccttaataatagcttgtctattctaaaatcacaaatttatatgccattatattcatttcacatttttcgtatcatgcgtggatgtatttaatttttatatggtcttgccagatttcttttaggtcttttccaaaaagcagtaaattattttggttggccacctcaattgtggtttttgttgataatttctgtttcatttatttatgtatttctcttaattgttactttttcttaaacttcttgtgttaattctgtttttcttttttagcttatttcattgaatgctcagattatttattttcaatgttgcatgttttctactaaatgatttttattttttggttaaacatttcactgtaggtactatactagttccttcatacgtagtatgaactttttcaaggaccatacgtatattgaccactgttttacagaggttatgtcggtttatacactcaatagttctatttatgaaagtgaatgacttttactaccactttatttttagatcttgaattgcagatcttatgaacaattttaatttagtggataaaaatggcatattatttttgctttaatgtgattgctaagacttcctagatgaggctattttgaatataattttatatttacttgatttatgttttcttgattgttttaataaaacatttccttaaaaactattgtaaacatgtatactaaatgattccaattagttgtaatcttacaacttttttacttcttgtcccactcttcatgagaatttactagtcaaacttgaataaacttcaaaagctatagccatgaaaaatcatctttataaaaaagttgcagcttatttatgctgcaaatatatagtatctgtatatgattaaaaacacaactagttatgtagagattaaatcacaatgaaatttgtttatgagacaataattcatttgtaacatactggtttttcatccatggttctcaaaaaaaattgttattacactcttttttggaattgcatatacattttgactagtcatggtcgtattttctcatgtcagattaagtaaattttctctatattttttatatactttataactccagacttccattaaaataagcgttcttttaaagtgctttcattttaactccttaattgtatatttctagaggtataaatcatttgtataagtatctttatattattgatatagaaatagagtaggccaaatcaattttttaagttttgtgaattagaatgttcttccaaagcaggaatctgcaagttaagaaattccagggattaagagctacacaattttttcttttaaaataatactggcaagccgaatccagcagcacatcaaaaagcttatccaccatgatcaagtcagctttatctctgggatgcaaggctggttcaacatatgcaaatcattaaacataatccgtaacataaacagaaccaatgacaaaaactacatgattatcttattagatggagaaaatgtctttgatataattcaacaccccttcatgctaaaaactcttaataaactaggtattgatggatcgtatctcaaaataataagagctatttatgacacacccgtagccaatatcatattgaatgggcaaaagctggaagcattccctttgaaaactggcacaagacaaagatgccatctctcaccactcctgttcaacatagtattggaagttccgaccagggcaatcaggcaagagaaagaaataaagggtcttcaaataggaagagaggaagtcaaattgtctctgtttgcaatgacatgattctatgtttgtaaaaccccatcgtctcagccccaagtctccttaagctgataagcaacttcagcaaagtctcaggatacgaaatcagtgtgcaaaaatcacaagcatccctatacaccaatgttagataaacagagagccaaatcataagtgaactcccattcaaattgctaaaaagagaataaaatgcctaggaataaaacttacaagggatgtgaaggacctcttcaataagaactacaaaccactgctcaaggaaataagagaagacacaaacaaatggaaaaaacattctattctcatgcataggaagaatcaatgttgtgaaagtggccatactgcccaaagtaatttatagattcaatgatatccccatcaagctaccactgactttcttcacaggattagaaaagtctactttaaatttcatatggaaccagaaaagagcccatatagccaagacaatcctagacaaaaagaacaaatctggaggcatcacgcaacctgacttcaaactatactataagacaacagtaaccaaaacagcatggtactgttaccaaaacagatatctagaccaagggaacagaagagaggcctcagaaaaacaccacacacctacaaccatctgatctttgacaaacctgacaaaaacaaacaatgggggaaaggaatccctacttaataattggtgttgggataacaggctagccatatgcagaaaactgaaactggaccccttccttacaccttacacaaaaattaactcaagatggattaaagatgtaaatgcaagacctaaaatcataaaaaccctagaagaaaacctaggcaatatcattcaggacataggcatgggcaaaggcttcacgactaaaacaccaaaagcaatggcaacaaaagccaaaattgacaaatgggatctaattaaactaaagagcttctggacagcaaaacaaactatcatcagggtgaacaggaaacctacagaatgggagaaagtttttgcaatctatccatctgacaaagggctaatgtccagaatctacaaggaacttaaacaaatttacaagaaaaaaaaaaactcatcaaaaagtgggcaaaggatatgaacagacacttctcaaaagaagacatttatgcagccaacaaacatacgaaaaaaaagctcatcaacactggtcattagagaaatgcaaatcaaagccacaatgagataccatcccatgccagttagaatggtgatcattaaaaagtcaggaaacaagagatgctggagaggatgtggagaaataggaatgcttttacactgttggtgggaatgtaaattagtttaaccattgtggaagacagtgtggtgattcctcaaggatctagaaccagaaataccatttgaaccagcagtcccatcactgggtatgcacccaaaggatgataaatcattctactataaagacatatgcacatgtgtgtttattgcagcactattcacaatagcaaagagttggaaccaacccaaatgcccatcaatgatagactggataaataaaatatggcacatatacaccatagaatactatgcagccataaaaaagatgagttcatgtcctttgtggggacatggatgaagctggaaaccatcattctcagtagactaacacaggaacagaaaaccaaacaccgcttgttctcactcataagtcggagttgaacaatgagaacacatggacacagggaggggaacattacacactggagcctgttggaggttggggggttaggggagggataacattaggagaaatacctaatgtaggtgatgggttgatgggtgcagcaaagcaccatgccacgtgtatacctatgtaagaagtctgcaccttctgcacacatatcccaaaacttaaagtacacacacacaaaataaataagtctttattctgattaaaaatttgagattctttaagttaaaagttttaatcttttttatttcttcctaaacgaagttctgagagaaaaattgaaattatttttattaacttttttcaaaaaataatagatatcaatcaggtaagaactcatatctaaactctgtctcctcttagtcaaaatgggataagttgaggatttaacactgatgaattttccaaattgttcatgacttcctgttgaaattaactgaagctcaattatttaaaacatggcatggcatattgttatgcttccaatattttgaattactctggctatcttcattttcaactgacaaccactgtcttttattatcttaatagaaagagaaaaagaaatctgtgtactttgttttctggtgttttatacacaaacctcagtaattggattctgatactccattctcagttttatcccagggctcttattgattatttggccagtgagataggcactctggaaggaatacattaagggaacaacaacacagtctgataagtggttgccaaaatcactggtgttgcaattttggtaatgtacatctctgtcttgagatataaggttgggaatatgcagaccctcttctcgtcactttgcacattatttgttgcctttctgcatctcattagcatctgaaacctaatgtgtgccaaaaacacaaaggcaactaaaacttttgatagaacaattgggagacatgtctgttttttgtttgatccacactactgacaccatatccaccagcaatctagatgaaataattaattttctcctcattcagagattctgttactcaaatgggttggtgattattttcaaggaatacttatactctgttctttctatcattcagacctcttcattgtgtcctaaaagtaagaggtaagggtttgtcctcagttttaagaatatagcatagtattatttttagatcttattttattctaactagaagagtaattataaataagaggaaactgaaattctagaaatttgaggtttgaggtggggctaatgctggatcccatagattgtgatccctgagaattggcacagatagtggcttcatgaggagaattgagtcccacagtcagacacacctgactgcacatccttaatcttttgttttgtgacattagggaattcctcatttattcagaaaatatttatgagttccttattaggcactaaaagttagtatctctgagctgcctcttagcattattatcaatttggaaaagtggtattgtgtaatgtgactggcacatggctggctgttggtaaatgcaatttctttctcttagttcatgaatcctatgtgaaggttctctcaccgaaatcaaatgatgagtgcatccattagtggctcatattgcattatgttaatatttaattttaaatttttgctatgtaaacttttattttcattatggaatgtttcaaattccatgacaaatttggggactacaaaaacaaaattattgaatgcacagtgttttcttcttttttttcataagaagttgaaaagggaacaataataaaaattgaagacccaatgtgtgcacataattaaagttgactcaccatttatcaaacatctataaagtgttacagaccatgctatgtgtgctagggaatatatacacacacacacacacacacacacacatatatgtatacacacacatacatatgtttgctcatatatagaattaccttctaattgaagagatttaaatgacatgttagctgatccccttttaaagacaatagtcatattcattcatttaatgaatatttattacctactgtgagtcatacacacattgttctaaatactgacaatacagcagtaatgaaacaaagtcccagtgctcagtgagattacattctaaaaaggagagagaaataggaagcaagcaaacaagcaagttagcaatatcatgtaatttcaaatgtcatgaagaaaaatatagcagcattaaggagaaacagaatgacatgtcctgggggtgttaggttagatagtgtgggtagggaaggggttttctgatcatcttctgtctgacctgcaaggggaaggaaaggttgcagaacagagaaaatatatagaacttgaggggaaatcggtggttttccaggttcaattgcaatcagcccgcacagcattttgagtgtttgataagcaatgtgaccttctctggaagtgggaaggcattaacacctctacagctctgcttgtcacttgcttctatttattagaagaggactactttgaggagaagttgtactttaacaatggaatattgctttaccagcacttagtaggaggaattggaatgcaaagaacctaaaccaggtaatcagttaggaagctatggcaatatcctagggaaagagtagtgagattgaaatggagaagactgctgtgaagtattgcagatgcaaaactgaaaaggcctagcaattgattgggtgcacaaggaaaggtaggtgatagggataaagaatgggagggctagaggtgaaacttagaacctgggtaagtgaagggatggtgaagccatttagggaaatacagaagatggatggataagtagatttcagaaatggagtcaggtaatttcagatttgaatttttgaggtattcataggactctgcttgagatgttgtatgagtctcctgaaactgcggattgggttttggaaggctctgtgaaattccagttgcagatttggaagcaaatatgttcagctttaaaaaagcatctgagacttatgccttaaaaaagaacaaacttgccagtaatgaaataccataccagtaatcaattctgagaaaagtcttattttgccagtactctaatgagaaaagtcaagacatttgaaacagattcaagctaaagtatcataaacatctcgacacaaattactaatattaattacaaacactacagaaatagcctttataccttgtaaaaacaaacaaacaggccaggtgtggtagttcatgcctgtaattccagcactttggaaggccgaggtgggcacatcacttgagcccaggagtttaagaccaccctgggcaacatggtgaaaacctatttctaaaaacaaacaaacaaacaaacaaacaaacaaaaaaaaaaaaatatatatatatatatatatatatatatatatatatatacatacacacacaaaaataaaaaataaaaataaaatagacaggcatggtagtacacgcctttagtcctagctacttgggagtctgaggtgggaggatcacctgagcccaggaggtcgaggctgcagtgagctatgattgctccattgcactccagcctggaaacagagtgaggatctgtcttaaacaaacaaacaaacatattctacaaacattgcctgtcttattttttctcagccacaacttataggttcaatattactttttcatttaacaaagaagttggggtttaaagaaactaggcaattttctaatgttgcccaatttgtaagtggcagagccaggacacaaatccagctcttctcactgctgtttaacagaatgaatgcagattctttcttctaccctgtactatgtgcgcaaaatttatacagtcctaaagagccccaactatctgaatgaagagacatcagtaaaactagtaagaacttgtaatgatactcagttcataaaccttgagagaacccattattagtgcgtagtgagataatttgtgttcattcatgcattcattaattcaacatttattaaacatctactaagtgttggccactgtactaacactagagatttaaaaatgtgattaagatagaaatttatgctctctccatttgtctgatgttcaatgaaagacacaaacaactaaacaggtagttacaaatactgtgtaataagttgttgtggaaagtacattgtgctatgagaactcaggaataagacatagtccagatttggaggatcaggaaagacctccatgggaagagatgtataagctaagactagaaatgggacctggaaataaaacttgggctcattacggtagcagcaagacctggagacttagatgtaagatagaagaagaaaggctccttgagaagcttaaggagacttagatgtaagatagagggaaaaagaaagcctcctggagaagcttaaggaggggcatgggatgcataatgggcaaggtggggctgtccatgtattaactaagaggagagctggaaaagacgatgaagggccttgacatctaaattacacacaaacatgtaaaattacatgcaatgtattttctttgcaaagaagacagagtgatgtctaatatatttcagatttctgtcataaaagcattttaaaagttcataaaacttagtatttaaaatgttatttttttttttagaaaattaccttgtgtgaacttaggtattcctgaataaatgaggctttcctgtgattcctcatattatcaagtctttggttctaagaaaggaacaaaggtagtgtaggaagcaggaaaaaatttgattaaataattttaataatctattttatgcaacctaatgtctttttaggcagataatactgaatcttccactatgcctatttttttttttttttttggtggggggaatatgaaattcctaaagttttcacggtattttctaataatggtcttcttggagttgttccaggaatatatgtgtttagctttaataacccccaaatgaaactaggttaaattcccctcagttttgcttttgtaattacacatattttcaggtactttttattacaggaaacctattatggatagtaggtattagcatgctgcctttttatatttattgcttttttctttcttttttctttatttagtgatctttctgttcagaagaaggtaatgcttcagttacttatttgtttctaaaaaacatccaaaagatttgaaatagaataggaggcctgggaatccattccatttggcttccaaaatatgttattataaaacactaattttcatgtgaatggagtttaaaacagtaagattctatcaataagtctatcacagaaataaacacatttctagcaaaaaaaaatactcaggattcaacagatgtatttcagccactatgcagaatactgctctataaatatgctttcgtcctgcaaggttttggaaggaggagttctggaagacaacattttattgaggcaaaaggcattctagttgtttaaaagactaacctaggcagggcataaagaaaggtgaatggctcctgcctgtggccttagagtgaagataagaagaacctttcttgtgaggattaaataagttccatcaaacccttacttccatagctctgacaagctgcttgttaaaaaaaaaaaaaaaagtcttttaatgttagttttcttgtgactacccacttcaactccagtctgcatttcccagtggctcctggcatgggaggagtcaatgggagtcaagatgaaaaaggacccaggcaggaaaagttaacatgagtgaacactaccggctagctaaggaacagcaaatgtggctgccccgtgcaccaagggccatgtgtgatccccaggctgctgtgggtcactagacgtggttatagagagtgagaactggacagtgtcttttttcagggagaagacaagattaaggcaggaatgtcaatttctctgtgcaagacttccagatagcagctggccagaaaatgttttcatgccatacttccaaagaggggcccaaatctcatgcttgtcctttatatccaaggttaaatgagttaatacttataaagcactcagaatggtgactggcctagggtaggaaccctgcaactgattcaaaagtttcttctctgagatttcaaaacaacaggtaagaatagcaagactccattttgtgttttacgtctccttttatctgacccagtcacaggcttctttgcttcagtcaacacaaattatgacctagccatgagaaatttcccctcttctcctccttaattcattttgaatccaggcagcctggctgccaaaagtatttttctttttctttgtcttttttggttctttcttttttagaaaaacatccaactgatttactataaagccattgtattcatatagcattaattaaatactacattgtgtttttgttgcttttagaggtatcacaaataagaatttggggagtcgatgtagaattgtgctgtgtcatttcagcatccattaaggtgactgagaattttccttacatgcttttagtgcgtagaatgaatattctgtcatgatccagagactgtgacaaacataggctctgtttctgcaacagcttctgcttatcctacttccctaatatattggccatttcactgcttaatagcactcaatttttagctaggtatgaaaattaatgaggtaagggactgagaattgccactttatttctggtcagagactctaataagagccttagttcaaaaagtcatgatattaaaagaaatccttgcaaatttaattcagacatagacgtagacaactgtggtggggttacatatgatgattctcagaaatagaataaagtttcatatgccttgtggctgaggaataaactaggaacctgaagtctgtggcatgaatggggtatgacccctctggttttccttcagtccttttattccataatttgaatgcataatttcacatgtatttattcagaaatatgtgcacccagactactttctgctaaatgcagactcccactcttaaacattggtgagagaagcctgctaactgacatttgcaatttcaggatggcaccgtgtgggagagagaactgccaatcatttctgccaacatcactctcagagggagtctaaacggagctagcatggtccaattaaaagaagcaattatgaataatggaaagtaaacaaatctaagaaaaatgatattgcagattatagtgggtattcacaatgaaaagctgtagtctgtgtcacctttgtttctaaagctattaatcttctttaattttcttgaagatttttacatgaaataatcaaaaaggaatccttaaacctcatttcataactaagcaaaattcaccttagtagaataatttaaaagctctttacagatctttaattaggtcaaatttttacgtggtctttgggttaggaaaaatgtataaactattatactatgacccatttagctgcttgattatagaaaatattgtaaaacagcccttttaaaaaactgatttaatatacaatgtgcaagatttgcttctgtggtataatacaatccaactttcataatttgaagtttgataagctgcatcttgatgccttcccctgtgtgcaaggaatatagaaccccgcactgtaatagcatgtaagtgtgtgttcttgtctctgaaagcacagtgatataaccttttgccattgccaacaagcatcatgttaaattaattgaccttggttcacttgcactatgatgcaattagcaattatcttcaaacgtcaacattttggttacatatcctaaatagaaaaagatgcctgacccaaaattctgctaggaatgtagaaatatattttttttggcaaattatttttcctgctgtgaatatctctatactttggttatgcaagataaatttgtattagagagccaaagtaaaaacccatattaacgaccagtaataaccagaatgatcagggataaaaggcacaggtgtaagggaaaaatatctttggacacatagaaagttatagtgaatggctaaaataaatatgcccttctttagtactaaaaaaaattgctaatgggaccaaagggattaggaagcaatcaattgatctctctgggatctaaaaaaaaaaaaaaaaaaaacgactactaaacatgagcagatatgctaatatatatctgtggaaaatattttaaatgatctctcaaaggtgttttaagctgactcccaactgagaagagatgaaggtccagagaattcatgcatagacatgtacacagggtctgccacaaaaataccgatttgatagctgatggcaagttttgtttcagctgatgtttgaaacatgctggaaaatgcaatcttgctaagcaaggaaagcaaaaccatcccgatctagtaagctagaacatcctttaagcaatgaaccaacaaagcctgttgatgccaatgtagcattaagtttcagtatgtaaaagactacaaatgttgactctacttattcttgtctatggaactggccttttagccagtcacagacatcacatcaggcatcctgaagtagatgctatttcattagcatcactttctgccagcaaatgacattgtcttggagcagagccagactacaggcatgagcaatgtgttagagattctggactggatttctccagggaatgggtaaggttatctagtctagtacatggtgaaggctgctataagtgacaagtggaaaagcttcatataccttatgttgttggaaaaactagatctttaaaatctctttatatcaattctttatagcttgttcatgtacatgtacacattatctcttaattctaccagcaatgtattgtcatgcccactttccaaatgcaaaagttaagacaattcctcgctatgaaacacaggtatatttagaatactaaacaaatgcagatagtgactataaccacaaacttgaacacactgtatgttttgtagatgtgttttcaactcttccagtgtcatgtagcacagacttgttagtcatcggcataattttaattcaggcagttccaattgtttgcttttttctgaactttgcagagcacttgtgatgagtttttacaaaacacctacactacatttctcactgagccaacctgcgtgtttgtcagtttttcccattgcagaaaataccagaactatatacttatatatccaaaatactacctctctccagtccccattttcccccattctgatgcaggattgccatctggtggagcacagaaggcacttctggtttggacttaacccaaacagtatgatcattgtttctcagttaggcttccaaggatcagtgtagcaaatgggaaccctgtttctggtcacaaatgaagatgagccaaccgtgaaaaaataagccaatggtaatgcagcaaacagtcactgggagctgcagcgattttagtgggtgatgacttggcaagaagaaatcacctactctcagctaaagaagagatcacccactttattaacaatgattttttaaaattatatacacgtacatattacgtgtgtgtgtatacacacacacactcacacatatatacataacagaggcatgatactgcccatatatggctgcctgggcaacattaagtctccagacattttgtattgtatatatgtatatattatgtgtgtgtgtgtgtgtgtgtgtgtgtgtgtaacagagaaggtaaataaaatcacaattaaaacaaagtggccttagaaagctatagcagatgtagcagagttatctttcccccctcattctccccacaaacatgccccttccctagagtcctgaagagaagcacacagtttccatatgatgctgcctgggcaacatggggtcactgaagatctggaagccctgttacagacagagattatgtaaccattgcagaagacttacactgacataccataaaccactactgcagggaggatttaacaacgtttggcatatcaaatcatcagtggaaagaaggcaggtcttagtagtatgtctgcctccgactttctagctttcagaaagaatggagcttttcatatgccaagcactgtgccaaattaatctaggctaatcacagacattaaacattaggtgttattttttaaatctgaggcttagagagaggctaagaattttctgagagtcacacagcatttattcatgctacagatgatgtgctcctgacaatgttttacatacaatggaggaaatgagagagaaagagagtgtactgacttctttatttccctacttcttattctagctattcctgtgtgatgggaagaatgtttcagcaggaaataaaaccacagaagaaacactttttttatcctacagagaagtttccctaagagtgtatttttctttgaaaataatgactttcagcttgaagaattccatttaatcagagaaaagtatacatatatttgttcccatctaaagaaagtgaaaactggttgttttacattgcatagccccttttcactgttagatcttagaataagaaatcatcctgagtaactgcagggatattcatactccgagtggaatcccctttaatagatttagaagttcattccctaacagctgcatcattgagaatgaaactgctatttgtcccactattttcttctttgtctagtctcagacaagctatacatgtaacccaagaggagatataatgggacggtgaccagtgcctcatggttaattcatagatacgttgtttgttattttgaaaactgatctgtggaggatttggtaactagttgtctttgtatgttcatcagagatgactaaaccttcaagcagaagtgtttaggttatttgaaactcatggccaaatgaggaaaggattagaaaagaagatagagcatctcccaaaggaagtcaggaggaaaatattacaatcaatccaatgcataccgcttgagagtacatgtttgtggagtgattaagaaatggatgagcaccttatttatatagccatgtaagaactccattttcagtttcacgtagacagtccttacgaggctataaactttgtacttcaacttcttaatagattatttctggtgtgctaagcacaagggttttttttaactttttattttgaaataattttagattatccagaagttgtaaaaatagtacagagttcccttgtattcttcacccagtttcccccaatggtaactaaccttacataaccagaatatattatcaaaacaaggaaattgtcagtggtacacatctattaactacagactttatttggatttcacaattatgtagcttcttaaaaaatgttatttaaaatgtcttaatcactgtcttgattaattattttattctgttttagatagctgctttatatctcaagtcagaactaaaaatattacttgaaaattggatgtcttaagcgaagcttttatgtttcattttgttttgttttatcctcaagttgataatataacctgcaactgcatgaattcgtgtacagtttaatgtgattgctcatctgcaaaattaaaacttgaagcaaagtctaggttggctgtcttccaagtagtttcttgtcttcagcgaaatcataattttcaccatttatatcaggatcttctgacttatgaggtcataaaatttctgctatgccaaacgcagttttctcttggactttgtgtttccctttaatctgccatgtaaattacaggcatggtgtcattggaagaccttgttatcttttagcacattgctactttagaccagtgaagctaacttgttccttcacaattaaaaatatgaagaacaaaaaaagtatttgtgtaataatttatagtttcaaaatgcttttatctgcaggatgctccttgatcttacacaaccctttgaaaaagagaaagctaataattttgtccctacttaaactttgtgggctcctaagagtaaaggtctcattcattcatttaaaaaactggattcagctgggaagatatattcataccagataaatcaatagaggaaatttaatatggataatttaatatgatgattacaattagataaaatagctcaaaaaaacaggcaggggagggtgaggcaaacttaaggttaaccaccaacagaagctgcctacctgcttagagctggagggacaaagagaaaagtggggctcctggatcccaagaagctgaggtaccttgttagatgagcgcctcccactcacccaacctagctggaagcctaaaagccagggagccaagaaaacatagcttcagtgtaccaccatagggtattacaagcgaaagaagggaagtgtaggtaataaacctcagttcaaatgtgccaatcatgttgtgccaggtatactcttttttttattttatttttattatactttaagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacagtccctggtgtgtgatgttccccttcctgtgtccatgtgttctctttgttcaattcccacctatgagtgagaacatgtggtgtttggtttttttgtccttgtgatagtttgctgagaatgatggtttccagcgtcatctatgtccctacaaaggacatgaactcatcattttttatggctgcatagtattccatggtgtatatgtgccacattttcttaatccagtctatcattgttggacatttgagttggttccaagtctttgctattgtgaatagtgccgcaataaacatacatgtgcatgtgtctttatagctgcatgatttataatcctttgtgtatatacccagaaatgggatggctgggtcaaatgatatttctagttctagatccctgaggaatcgccacactgacttccacaatggttgaactagtttacagtcccaccaacagtgcagaagtgttcctatttctccacatcctctccagcacctgttgtttcctgtctttttaatgatctccactctaactggtgtgagatggtatttcattgtggttttgatttgcatttctctgatggccagtgatgatgagcattttttcatgtgttttttggctgcataaatgtcttcttttgagaagtgtctgttcatatccttcgcccactttttgatggggttgtttgttttttttcttgtaaatttgtttgagttcattgtagattctggatattagccctttgtcagatgagtaagtatactcatttttatagacataccaagtgataacatatgaaatgagatgaaatgaacgttaactccgctgtggaaaaattgtcatttttaaagaggtgaccatcatgtaaacaacaaccactgccattattgccgctgctaatgcttagatttactaccagctaatatttatggagtaataattatatggcaggaactgtaatacattgtttaaatatagtttattatttaaccctctgagtccggtttgttactcctattttacagatgataaaattgagacttttaaaacttaagtatagtgcccacggtgacaaggttgaacagccaagattctgatatagaccatctgtctctaaaaccatgctcctaacactgccctatattgcctccctaaatatatatatatatataacatacatatatataatatatatataatatacatataattaattctaaaacttacatgtatatatgtaagttttagaattaattatatgtctaggctatactgcagtagccaattccttccagggaaaggggaaactatagaagagacaacactaccctcaagttgaacttgaaatatgagactctctctaggtaaacaaaaagacaagggcataagggcagaatatcagtatcaacactgtatgttattttctaagagcttgggaagcgtggctatctagctgaaggtaattcagatctgttggagggatagtatgggagggggaattttcataagagaaaagcctaggaagacaatcagaaggcacatcatagtcaagagatataaataattcacactcaagaaaatgggaagctgttgatgatggtgtgctatggagagtcctaatcagttttgtttttgaaataatacccaacctgcagaattaggtcactattatgacatgtttgtagagtgcatgatcattgtttaggaaactggatgaatgccagaaggatgccctgaaaaaatggatgggagtttaaatgttaccttcgtgtagtagatgtaccatcagctgcatctgacctcttactattctttaacttctcagttactgcaaatcagtgttcttaataagagactggagatatttgagaggaagatttttctataaatgcttgattggagccctttattcatttggctcaaaattaagacaatgatatctgaataaatgtagttctataattatatactttattataaaactttcacatatattttcacatatgatactcaaataaccttatgaatttagtagcatagctgttttttgctacaatttgaatatgagaaaagagagcagtagaaaggtgaaactgttgccgtaagtctactaaatggcagagccaagacctcaagtgggcctcttgtgcaaaccactgttacttttacacttgatttagccaaaaggctgagaagcgataccagtgttacttttttctatgctcacatatcaccttgatctgagacaaattatctctcattgttttgtcacaattatgtgatatacttttatttaaagaattaaactgctatataattcctattcaaattttctatatgctattatattttccttgtatatctacatactcttttattacttcacagtataaactttctcatgtatatactttttttcactagcaattgtctacatctcaaaaatttcacctgtcaagtgtataaatttcctcagtaaataaaaagctgctgaatatttttatatgagctttaaacttagcttcaccttgtttccattatgctgcaaggtgctttaaaggtagaaatgcatttctggtctgctcacaaacagatgaaaaattattttcctgccttctttgattttactttctcgtatgcactcatttgagttatatctcatctgtgttaaaatggaggtagctgtatatcagcaaagtagaaagaattcttgatactaaagtagtacatttccttgccttgttttcttttccttcatagagtttagtagtgttcattttatttatttgaatgtcaaaattctcagattactgccaaatattgtgattatagcagtttaggtgaataaaaacaagtaatggctgaatttaattatggataataaccatatgagaaagggatgaaagaacccctgaatctcctagagcttcatcatcactatttattttgcaaaataattatttagaattaatgagcttatatcagaattgatgtatgactgattttactttattttttaaaattttattattattgtactttaagttttagggtacatgtgcacaacgtgcaggtttgttacatatgtatgcatgggccatgtcggtgtgctgcacccattaactcgtcatttagcattagatatatctcctaatgctatccctcccccctccccccaccccacaacagtccctggtgtgtgatgttccccttcctatgtccatgtgttctctttgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacattttgttaatccagtctatcgttgttggacatttgagttggttccaagtctttgctattgtgaatagtgccgctataaacatacatatgcatgtgtctttataggcacataatttataatcctttgtgtatatacacagtaatgggatggctgggtcaaatgctatttctagttctagatccctgagaaatcgccacaccaacttccacaatggttgaaatggtttacagtcccaccaacagcataaaagtgttcctatatctctacatcctctccagcacctgttgtttcctgactttttaatgatcgccattctaactggtgtgagatggtatctcattgtgattttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagcccgttgtcagatgagtaggttgcaaaaattttctccgattctgtaggttgcctgttcactctaatggtagtttcttttgctgtgcagaagctctttagtttaattagatcccatttgtcaattttcgcttttgttgccattgcttttggtgttttagacatgaagtccttgcccatgcctatgtcctgaatggtattgcctaggtttttttctagggtttttatggtttgaggtctaacatttaagtctttaatccatcttgaattaatttttgtataaggtgtaaagaagggatccagtttcagctttctacatatggctagccagttttcccagcaccatttattaaatagggaatcctttccccatttcttgtttttgtcaggtttgtcaaagatcagatagttgtagatatgcagcgttatttctgagggctctgttctgttccattggtctatatctctgttttggtaccagtaccatgctgttttggttactgtagccttgtagtatagtttgaattcaggtagcatgatgcctccagctttgttcttttggcttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaattttcttccatttgtttgtatcctcttttatttcattgagcagtggtttgtagttctccttgaagaggttcttcacatcccttgtaagttggattcctaggtattttattctctttgaggcaattgtgaatgggcgttcactcatgatttggctctctgtttgtctgttattgatgtataagaatgcttgtgatttttgcacattgattttgtatcctgagactttgctgaagttcttatcagcttgaggagattttgggctgagatgatggcgttttctagatatacaatcatgtaatctgcaaacagggacaatttgacttcctcttttcctaattgaataccctttatttccttctcctgcatgattgccctggccagaacttccaacactatgttgaataggagtggtgagagagggcatccctgtcttgtgccagttttcaaagggaatgcttccagtttttgcccattcagtatgatattggctgtgggtttgtcatagatcgctcttattattttgagatacatctcatcaatacctaattgattgagggtttttagcatgaagcgttgttgaattttgtcacaggccttttctgcatctattgagataatcatgtgttttttgtctttagttctgtttatgtgttggattacatttattgatttgcgtattttgaaccagccttgcatcccagggatgaagcccacttaatcatggtggataagctttttgatgtgctgccggattcggtttgccagtattttactgaggatttttgcatcgatgttcatcaagaatattggtctaaaattctgttttttggttgtgtctctgccagtctttggtatcaggatgatgctggcctcataaaatgagttagggaggattccctctttttctattgattggaatagtttcagaaagaatgctaccagctcctatttgtacctctggtagaaatcggctgtgaatccatctggtcctggactttttttggttggtaagctattgattattgcctcaatttcagagcctgttattggtctattcagagattcaacttcttcctggtttagtcttgggaggatatatgtgtggaggaatttatccatttcctctagattttctagtttatttgcatagaggtgtttatagtattctctgatggtagtttgtatttctgtgggattggtggtgatatcccctttatcattttttattgcgtctatttgatttttctctcttttcttctttattagtcttgccagcagtctatcaattttgttgatcttttcaaaaaaccagctcctggattcattaattttttgaagggttttttgtgtctctatttccttcggttctgctctgatcttaattatttcttgccttctgctagcttttgaatgtgtttgctcttgcttttctagttcttttaattgtgatgttagggtgtcaattttagatctttcctgctttctcttgtgggcatttagtgctataaatttccttcttcacacagctttgaatgtgtcccagagattctggtatgttgtgtctttgttctcgttggtttcaaagaacatctttatttctgccttcatttcattatttactcagtagtcattcaggaacaggttgttgagtttccatgtagttgagcagttttgagtgagtttcttaatcctgagttctagtttgattgcactgtggtctgagagacagtttgttataatttctgttcttttacatttcctgaggagtgctttactccaactatgtggtccgttttggagtaggtgtggtgtggtgccgaaaagaatgtatattctgttgatttggggtggagagttctagagatgtctattaggtccgcttggcgcagagctgagttcaattcctgggtatccttgttaactttctgtctctttgatctgtctaacgttgacaatggggtgttaaagtctcccattattaatgtgtgggagtctaagtctctttgtaggtcactaaggacttgctttatgaatctgggtgctcctgtattgggtgcatatacatataggatagttagctcttcttgttgaattgatccctttaccattatgtaatggccttctttgtctcttttgaactttgttggtttaaagtctgttttagcagagactgggattgcaaaccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggctggtaccagttgatcctttccatgtttagtgcttccttcaggagctcttttagggcaggcctggtggtgacaaaatctctcagcatttgcttgtctgtaaagtattttatttctccttcacttatgaagcttagtttggctagatatgaaattctgggttgaaaattcttttctttaagaatgttgaatattggtccccacactcttctggcttgtagagtttctgcggagagatcagctgttagtctgatgagcttccctttgtgggtaatccgacctttctctctggctgcccttaacattttttccttcatttcaactggtgaatctgacaattatgtgtctttgagttgctcttctcgatgagtatctttgtggcattctctgtattttctgaatctgaatgttggcctgccttgctagattggggaagttctcctggataatatcctgcagagtgttttccaacttggttccattctccccatcactttcaggtacaccaatcagacatagatttggtcttttcacatagtcccatatttcttggaggctttgttcatttctttttattcttgtttctctaaacttctcttctcgctgcatttcattaatttcgtcttccattgctgataccctttcttccagttgatcgcatcggctattgaggcttctgcatttgtcacgtagctcttatgccttggttttcagctccatcaggtcctttaaggacttctctgcattggttattctagttatctggtcgtctaattttttttcaaagcttttaacttctttgccattcattcgaatttcctcctgtagctcagagtagtttgatcatctgaagccttcttctctcaacttgtcaaagtcattttccttatcaccagggtatccttgtttctgcccaacagagacaaaattgctagcacagcgtccgagatcaaactgcaaggcagcagggaggctgggggaggggtgcccgccattgttgagttagttgtttgtttaggtaaacaaagtggcctaatcaaggaggcctgcctgcctctgtaggctccacctctgggggcagttcacagacaaacaaaaagacagcactaacctctgcagacttaaatgtccctctctgacagctttgaagagagtggtggttctcccagcacgcagcttgagatctgagaacgggcagactgcctcctcaagtgggtccctgacccccgagtagcctaactgggaggcacccccgagtaggggcagactgacacctcacatggccaggtactcctctgagacaaaacttccagaggaacgatcaggcagcagcatctgcggttcaccaatatctgctgttctgcagccaccactgcagatacccaggtaaacagggtctggagtggacctctagcaaactccaacagacctgcagctgaggatcctgtctgttagaaggaaaactaacaaacagaaaggacatccacaccaaaaacccatctgtacgtcaccatcatcaaagaccaatggtagataaaaccacaaagatgggaaaaaaacagagcagaaaaaccggaaactctaaaaatcagagtgcctctcctcctccaaaggaacgcagctcctcaccatttatgactgatttttaaaatatcttatattgccactgtgcccgtaatttcagctacttgggagactgaggagaggatcgcttgaggccgggagtttgagaccatcctgggcagcacagtgagaccacatctcttaaaaaaaaaaaaaaaaagtcttgtatctttaagtgacaaattacatacttaagtgacaagtatccttaaaacaacttatgtctttaccttctgagtttccttagcaatatctttctctaacttatcagtagggttttattcagaaaaaaatgttaaaattatcagtataatcattctaaaggtaatattcatttatgtcctctcacacctgtgcccatatgcacgtaattacagagtgattcatgaccatgcaagtgaatattagaaaatgttgcttttaaaacaagtataaaagtgtgtgttcatacaatataggtatatgctacataagtataataactatatgcattatagaagtgtgaagaaaattagtggaacgtttcttttattgctttttatttttgctctttttcttgttgtttctgtggaacttgactgtttaggaaaattcaatttcctcctgggaaaaaaaaattcggtgctggttattgcagagacactgcagattgtcttaatcggcaaactagaacttcacttctaactgtgtaattttaactttcaatggtttgctgactttgaaggaggaaactatgcctcatttgccatatatgtaaaagtgtgaccacatcttcaccctctaaaaagatcttcttgaagataaattaaaatataatccacaagagatgttgatgagcaaggtaaaggtattattcaaattatgtatttgaaattatattatgtttaaataaagtaaattaaaaatcagttcaatgtgacaatatagaacattttggccaagccaaaaatataataatggttgtaggcaaatctaagttgtggcttggcaagcatgaaaagacaagttctagggatgaaatcagagtccaaaatctatgaaggttaatgcaggattgaacaagtggtcagccagggcagtgtcagtataacctgtagtttatccagagaaaaaatctttgttaagaaaaaaattggtaaaaagatggagattgctttcctctttttaccatctctatgttttagaatcttgactagaacagttaaaatacagtgctcctacaccaggtttctctatagattgttttactcacaaatttcaaaagctaactgtatttgtgagaatgactgatgaattctgcaattcataaagaagtctaggtatagacatctttaatggtcaggaatccacttgtgtcttcctcactgaggaactagcatgacactaacctaaaagtagaaaagtcaaaccgaacagtagagaagtcatctggttaaagattctaacaagcatttagcattgctcctgtcctatgagcattaatgcttggccttgtttcagggccattattgctaaataacagtaggtacttagtttcttgcttaagaggcctttaaattctgagtaaggccttggttttccttctcttacaagtgcttgtggccctatgactctgcaggcttccctgtctctgagctgaattccttcatgttggtatttgtgttgtcctggaacatacttcaggaacatatttcctccttcaatctacaatctatttactctgcactatcagcatttcctttcactgtcaagagatgtggcattttcaatcctatttgtaaaaaccagttgttttaatatacggagtctaaattgtaattttgtctctgttgggcagaaacaaggataccctggtgatacttattttttatcaacagtaaacagccttcccgccgatgtccccaactcttatacttcagatactggagcaaatgtccaggattactccatggacactgtgtaatatttacatgatctacagtctcagcaaagttaacccctggtcatacacagttgtttaacttcaggaagcatatttctggccatttttgatagctacttcattttactgtttgtttgtctgttttttcggcacttcctgtcatcaagcattcagaattatttctggtactttttttttcattttctttatgtcagggaattaaaatgtttagctttttgattcagtttgcgatcctgataaacctagggcaagacattgcaggcacataattgtaactaagtagactgaaatagcacaagttcgtgtacatgtcctgtaaactgttcgtgcatctcagggttacgctggcatattaattccacctttgtaagttcatatctagattttcacctttaaaatattctgcttgttactgtaacttaacaaaccaacagatcacacattttgtccatgtactcaatgctttaccaagtaatgctattctacatcttttgtattcttcctgtgtgtgcatgtgtgtatgtgtattacacatattatttatagctacagatcatatctttatatcctttctagtgtgaattattttgtctttgtggatgaacttgtttttatgacattcataattttcttcaaggttatattctataatgtatctatttattattattattttttaagacgagtctcactttgtcacctaggctagagtgcagtggcacgatctcagctcactgcaacctctgcctcctgggtttaagtgattctcctgcttcagcctctcaagtagctggaaatacaggcgcgtgccaccatgctcggctaatttttttatttttaatagagacagggtttacccctgttggccagattggtctcaaactcctgacctcatatgatctggctgcctgctcctcccaaaatactgggattacaggcataagccaccacgcccagcgtatatttaaaatttttaattggataaaattatcaccccatttacagattatataagttacaaactcagtcatcattgaagcattttttgtattaaatctgcaaactgtatatatttaacatattatttattacccttacatctgtgacaaaaagagactttccactgctgctttctcaagatgcatgtaaagctgtctcattagaactctaaatgttaaaaatttcctgtgcaattttggacttgtatgtgtgaagcagtatttcagctcaaatatgtgctttcatactgtctataatataaccaaatcaacattggagctcgtagtaaataaattgcttatgtatattagcacattttatgtatcccttaaaatttggaaatgatacaaagctatagccagagcaatcatgtaaatccaaatataatcctttatagggagagccatgtgatgttaagctcttcttaatattttgaatatatatatatataaaatacacactttacatatatgcatatatacataattcatactagtctctaaatgcagaaaaataaaatataagaattattaaagctatggaatcaatttgaaatgcaagccaattcattttgctcttctgcgatctgagatgaaactgggggaagaaatttatgctgtggtaataactgtaacatattgagcttatattatataccactttatatgcctacctagttaatattcacaacaaccctttgaagtattattgttattcccactttacatataaaggaattaagtaatttacccaagatatgacaattaccacctttacaatctggtactctattttagttgctttattccctttgtagtttcaaaggaaattagagttacagtataatagacagaatcagggttttgaaattaatcttttctgagagattggtatgcagaaaggattttggaagtatttgacttatgtcacttatatccagtctgatcttgtcctgtatatgactatttactgtggtcagtttaaaagtttcagtaccaggcaaaggtggagtcctaagatggcaaaacactctatttcctcctgcaatctgcatagataaatcagagtatttttgatgaatttactggagaagttctatataaatttttataaatactattatttttaaccataattgtttttgccaattttgagatgatctaaaatacacactaatgccatatatacacaggagagcccaagtaatgaggcttttaattaaaacttacattaaagtgaaagtgagcacatacatagcatttaggaatccatgtccccagcagtccatgtggtcagtgatattagctatgtgctggcatttcatgtatatgtcactggaaacttatcactttaataatcacaaatcttcagtcttgtaattagtgtctggcatttctaaaaaaaaagaagaaaaaatagaaaattaaagttatctttgataaactataggtaaatgaaattattctaaagaaaaactgtatcttgaaataaaagaaaatatgtattatagaaaagcacagaaatctcagacaaaagtgatcttttccttttaaataaagattgattacacattcaggaagctaaaggttactatgaaaaacacaggaacaattgcagatttctccttaacataatcagatgcaagtgtacagtgataaaaatgcaaatcttaaggtgctcttagctgctagaggtcaaatcaatgtttttcctcaaatcaaaacatcagaattttccctcagtcaagttttaatttttaaaagttgaatatttatggggactctaaaagcagaaattgtcagaagtctttgaaaaaaggttaagctaagtaagaagtaaacaccgaatgttcatgaatgggattgaaggtcaccttgaatttaaaatgcaaagcatcctgaggaggaagtttgtacttttgtcagattttgaacaaaggccacaatttcttaataattatttccctagaacagcatttgtttcattttaaaaagttttttaaaatctgtctatgagcttgactggcttgcagacttcatacttactgtgtcttaatgattttatatataaattcatggaatcttagactcgtaaaatttcaggttccagctttgtgaatcttttctgttttgctgcaaaataaatgataaccctgtgcttaagaatcattgatgtgaaagaacaaaaaaagctttagaaccaagtatattttagttcaaatatttctctgcaacttggtttttgaatttcatcctttgcctgtaacaaagaaattagtacatcacagaaatgtattgaattatatgaaaataatatatatctataaaccacctggcatctagatcgagctctatattgatccaaagtattccattctgtgttttaccactttatcaacatatttttttatatactgtactgactggaatctgcctaaatgtcattttttctccagtggttctattttgaagccttgtattaatatattatatgtctaaaccctcttctacctaacaatttctccattctttctgaatattctggggttacaagtatcctcattatctttgtcattcttttgagatattcacattttatgccagagtctctatagtcattctgccaccagtctttcgaagtgatttctgacaatttactattttgtctcaaaacttcagttaaagcactttctgaatacagatcttctaggaatatgtttgcccatctttgaggttcactgcctaggtctctgttatcttggtgacagtgctaaaattatgacccaagttccgaaatctgtgcaatgcaatgtttgcttctaaaacttctggtgcaatcagtccgggaactgtaacaacttaggcacaattctttctggaaatgaaataaaatagaatgagtttggcagaccacaggttgaaacttcttaggcgcctattgataagtagcctttgtggaggaaaatgtcagtataggagaaaaagactaaaagactcaggtatacttgtctctgtgttgtatatcctactttgcaaaatgaaaggaagagaatctcagaggtcctggtaaagctatttgaaaatgcttccagagacatgaagtgtatttgttttcctaatttcctaaggattagtggtggtgggagagggcattctatggttaaaatgtctacatttccttatcacaaggcatagctagcagcaaaagtaagccatgacacggaactgaaggagccatgatgaaaattccttctgtttttcatccctgtattcattcattctgcacccatgctttaagtaccttgcgtgggtcaatcacgctgatagtagcttctggttcagagaagaggagaacacgactcctgccccctagcagttcactgcccagtgagaggagacaaacaaatgatctgtggacaacaaaccacatgcagaaatatttaattctgtctaggacagtaagagaaagcttttttggaatttgttttatttgagtctcagcaggtaaagaatggagacaggataaggcatttgaagccaaaaaaaaaaaaaggatgtacttgaagaaggtagagagagagatgctggcacaccttgaaacctgtccgccatccagcccaggtggagggcagggcacttaatcctagtagcagcatctttggaaagtagggaagtccagagtcatttttccatcttacagaagagagagtggaggttcagagtacttaagggttaggcctggaagctcctatttaaggagctaaatcactgaccttgaactgaaggcttccagcttctggtctagggatttaaccacctcaccaaatgcttcttttttctttggctatgtagagacaaaaagagacaagacgtcatccccttcattaagtcctctcctcagatttttatttttcttttttctcctcagatttttatttttcaaaagtcatgtgtggttttacctttgttggacagtagatcttaagtagggaaactaaaaccatataataattcttttgctttattagtaaatcatgttaaagtatttcagtttgactcgttctaactagttaccaatgaatatagctgtgggcattttctattcttgtcatgctttcattcctccaacttatacttttttattgtgacactcctattgttcaaatttctaatttgaaggaattcattaccagatgagttttaaaatgaaagaatatcttcctgctatcctctcctcagcaataaaattatttttcaaatcagaggataaaggacttaagtaaaatttaaaataaacttatgaaaacagttggtttattgaaaagcaactagcctatatgtaacatagtttatagaagtgtattttaattcagtttggcaaatattcatgtattcataagccttctatgtgccaagtctgttctgtatcttcatttaaagtattaagagatgaataaacactgtgcccttctttaaggagttatcaggttagtaggggagtcaaatatgtgagctaatgcaatggaatactaaatacagaatgcaacagtagaagcacatttaaaacgtaaagctgtttggttttctgttcttgtgatagttgggtgttgaactatgagaacacatggacacagggaggggaacatcacacagtggggcctgtcagggggtggggggctagacgagggatagcattaggagaaatacctaatgtaggtgacaggttgatgggtgcagcaaaccaccatggcacatgtatacctatgtaacaaaactgcacgttctgcacgtgtaccccagaacttaaagtatagtaagaacaaaacatagagatgacactgaagagacagtgactcagtctggagagtaaagaaatgttttctgaagaaggaaatgtcaaagctgtgactgcaaaggagttttccagaagaagcaagttagtgggttcaggctactcacagtaaaaatacattgagggggacatgccgtggatctcccagaaaagctgaagtccttcaaccatattatagaagcttcacgagtgaaaggacaatgggcagaggtaaggttgaggaccctggcaaggttatgggtgaaaagacagcaaactgattgcttagatttcaccctctgggctacagaagacagtgaaaggtttaaaggaggagagatatttgaacagacttatataatagaaaacataaataccttttcgtttaaagaatagattggtgaatagagggaggggagggagtacacatttagataaggaagacaagataggaaataagtacaaaaaaaagataataaaatattaaaatacagatctgcatacactcacaagcataaacaacattacactgtaacagtgccataaggaagggaagaaaaagttatttaggagggagaaacactaaaagttattggctcattggatttgagtagtgagaaacacagaatcttatatttcttcccagtttcataaaaagtggtaccacctaccatagcagggaataaagaagacagaagtttggggagaaagagttattcattcattcatcaaaaatgttattatttactatattccaatttttttaagtactgtgtatacaaaacataaaacaagttctctgttcttagatacaaaaatgttattatttactatattccaatttttttaagtactgtatctacaaaacataaaaaaaagttacctgtccttaggtagtgtacattctataaaggaaatcagatcagatataacaagaacatataatcttaggtggtgtgaggtgctatggagaaaactaaagcacatgaggaaatagataaaggccatggttaaaaaagatccctgtgagaaggtgatacttaattgaagaaataaatgatgcagatgttcatatgatgatccggaagaaaaatgttctaaacagagagaaaaataactatgcacaccatgaaataggaataatcttagcatgcagtagaaagggccaaagtgtgaaaatagggtagaggagtgataggaaatgagtttcagagaggtaggaagtgaccttgaaattcctgttttatgccatttgagatggaaaccctgataagtttcctgactatcagagtgacaaagtctgatttatgtttttaaaagatcatgctgtctgttgagtttatagaaccatgtgtagtaggtaagagtgtacccagagagacttgaaaaaccactgcagcggtttatgagggatatcatggtgtcttggactaggaagatagtgaggaattgaagagtggttaaattcagtatatatctcactatacagatgtatagattgattagtttcagtgtacagaaaaagaagaggcaaggaggattaataaattttgggcctgagcaattgaagtatgggaagagcaaagttctggaggaatatggggaagaacaaatcaaaaagttgtttttggatatcttatgcttgtgatacattttggacattcacataaagatgtctgtcagatgtgtgtttgactgtcttcctctggagttatgagagagttcaggctggagctatgaacctgggaatcatcagcatatatttagatgagatctcctagactagaggaagacataagatggagaaggagcagagaggtgttgagactgaaggtatactacaaaaatattcaggacaaggaggtcactagcaaaggagaaggggaataaactggaagagattgcaggggaaatcctatctgtgaatttcagtgacataaatggtaatagaaagagggtcaactatgttagttgctgcctaaggtcgtgtaggctaagtattgagatttttctgggttttaaaaattaacagcattctgcctctgaatgaactagttcacaaattaggagttaagatgcataccgatgaaattgttatacaaaaataaaagcattaatattatgacttaagacaggtacaaacagctgctgtgggagcacagagaaggagagaagtctatctaaatgggaggaggaaggtaacaaagaaagcaggtagccaacttcagagccagggtgcccttgaacaagtagctttgcttgtaccttataaactgtttaatataaaaactttattctaagacataaaagaaagagattgcatgatcatgagatgatgtccaaatttaatttctccagctccattggcctatgtttgtaggcttaattaatatgtacagcatttatttcactgttcaacctgcttgatgctcatatatataatggaaaaacttagtcctcctcctctgtcctgtgttgtttctagaagtttcaacaacaaactttccttgaatcttctgttcttaatagaaatgtttctctttcctacttagtgtcatcctttactcttagaggctgtaagtatctctttcattcagtttgggattacagcctctttttcaacagacttgaaacccagaaaaaagagagtctctatcctgtcctttccattttttagttccccaacacttcttaaatcccatatccaggctgggcgcagtggctcatgcctgtaatcccagcactatgggaggccgaggtgggcagatcacttgaggtcaggagtttcagaccagcctggtcaacatagcgaaaccccatctctactaaaaatacaaaaaaatggctgggtgtggtggcaggtgcctgtaatcccagcttcttgggaggctgaggcaagagaatcgtttgaacgcgggaggcagaggttacggtgagctgagatcctgccattgcactccagcctgggcaacaagagcgaaactccatctaaaaaaataaaaataaaaacaaaaataaaataaataataaatcctatatccagataccaagagctcagtgctctcctcttccttattaaacaaatggaaactcctatgaaatgcataaatgaaggctactcgtctccagtatgttccactagcttgacaagtatgtacagacatggctgaactgcagaaatggacaaagcctagattaaactgacctctttcccacatagactgtgggacttatgagacttagaggagattgaaagcacataatattgaagctgaccccaaaaaattgtatcatagaaccttctgcaacaaaaaagaaatattctaactcccttattcttcatttgaagaaactgaaataatataatttcaatggatacacccaagggcacagagctcaattttgtagaactcagacataaacccaagactctcaaatcccaggctatttccttttccaatagagtaaaataaatgcacatatgcgtgtgtgtgtgtgtgtgtgtgtgtgtgtatgtgtgtgtgtgtaccacagtaactgaattttgaatacagtctaattctttccattgagtaggtggattaattttattatactcttggaaacaagagcaggatttgagatgggaagcaaacactataacatgttggcaatataaaatgttatattatagatatagaaagaaaagtacaatactaggctaatttatctttgtgtttccagtgtaaagtttattcactggtgtgatgtagaagcaatagttttgactacacctgcttagagaatagggaactcaataaatattggtacagagtataaactcaatatttaatttctgaatattcatgaatcttgtgaagaatagcatggtataacaaacttcaaagtgtatgtgtttactgaaacaattggtcagttgaaatgcaaaaccaattaagctaatcacttgcttaatgaatccatttaaacagttgaactcatggtcatgtgtagataaattgtgttaagtttttagaacttctttatctacacaatgccatggattcatcatgggaacccaaggaattagattttccaggtaagtggttagataaatacagtcttcaccaatccaatcttggttttgtatttttgccagttgtttttgtaaacattccaattaattcaattcctttattaaagttattaacaacattctatttacagaatggatttcaaacctcttcatatggcatttaaggtccttgtcatctacctcgacttatctttccaatgttgtcactggcccctgtccctcattatcttttctagctatatgctttgtgtttcttgtttttaatattatactatataccatatattgaataactacctcaaatttctattgtctgtatatatgacacattttctcatccctggacctttctttaagtttatttatcttactggattgcccttctaatccttctctactggtttgatgacttcttcaaagacccagatcaaatgtcaactaatgtaacaatccaagagctgggcatgggcttcacaattcataatttctgtatttacaggaccctccaggctatccacctgttccttttcctctccagagttccatattttttgcattctccaaaggagacaattcaaatctcaccatttttttcaaccctccaatcctaccactgttacctataattcaacaggctcactgaaaccagcctgttaactgtataatctactcagtggaattgctcaacctccaaatatatccacgtcttcactccagctttcctctcccacaaagaagtatcaccttacaaatcttctacccatgttcttttcacattcccttcccaatctagacttttgccatatgtttctcatacctttgactcttctttttcactatcctcttcttgtcagcctacaatatacttggttttataatttccattttacataacattttccaatattcctgccttttcctcaaaccaatgccatgttgctcattgcttgctttttattatctaaacaaatctgtgggttcgtcagttgatgcacatgcccttgcttcatttctatttaccttcagttcaatacatttaagtgttaacttccactgcactacggaaatggttctgaagtccaaatcgattatttttctttgtctgaatcaatggtatttttatcttcattctcattatcttcacttttatccaacattcaataccattgaacatttgctctttcatgaaatattgctcacacttgattttaaggatatggatcatccagtaccttctccacttttttgactgattgcctgtttcctaggagctcaaggtctaattggagaatagatccaatcatttcactctctttgtgaagtattctcagtagcttcccattgcctgtgataaactccatggcccttcacagtcttaatagaatccaacttttgcataacttttgtagtaactacaccagaaggccttcaaaatgtcatgcacatttataccttcgggccttggattatgctgttgccctctgtctgtaatgcttttttacacttttcatcttgagaaagtcatgcttatcctgcaaattatctcccaaatgtcaatctgctgtgtcatttgctttccctaattgtgacatggagaattagtaactgcttcttgtgttgcctttgcaccttgtatgtgtcctataagttttcagtagtacatgcaatgcattagaagtattttttttaaaaattctctatttcttattacactacttgttcagttatgttagtctatattaattaatctttacattcacagttctcagcatattataagtaatcactaattattaattcatttgataagattctgtcctccatgaaagttctttggtgagagaaattctgtaatatttctctatcatgtgaacctggaaaataatgaaagaaattgaataaataattatttttgcaatttaaatgttgaatttgcacttatgaggagaaaaatgtagacttttcttcttgtgattactaaaacaaaattaaatatttaaatcaatatttaaaatattacagttcttcaacatttattttatatatcagatcattcaaattcaattaatgcttgttagagctccattttttcatatttcatggtatctctgacttttctttggtttcccacagtatttttttaattgtatttttatttatttatttatttttttgacagggcttcactctgttacccgggctggagtgcagtggcataatcatagttgactgcatcctccaactcctgggctcaaacaatcctcccacctcagcctccgaagtacttgggacaacagacatgcaccatcatacccggctattttattttactttttcatggtagagacaaggtctcactaggctgcccaggctggtatctatctaattcccggcctaaagtgatccgactgtctgctttggcctcccaaattattgggattacaggtgtgagccactgtgctcagccattctaatgttattttaacatatttaaaccacagttctgaaaataatgccatctttagatgaatctgtactacaaagacattacaaaatatcatgtgaacattttataagttcttaatctcccccaaatattgattactcatctggtagtccattactcttctcagtctatttttacattatttactttattgagcttcatcctgcttagtgaataaaattgaatggttcagtgagcccattatgagtcgaactttgtcttattttaccttaatccataaaagaatctcctatctctcaaaggaaattctggtattcttctgatccacttaaggcttttgagaccagagatgaaagatccaatatctacagctcttgaactgtcagagagggtgtgtggagcctgcattcaccaaccaggtcatactgttcagttggcagggatgatactttatatggcacataaggcttgctaatatcccagagcctaccataatggctgtatgttataggtgtttataaatgaatgaacaatacctatagtatttatatgtcacacttaaacttattccattatatttcctatgtagttttaggattataagggtgtttgcaaataaatgtttaatatttgatacaacacaatgtattaaaaagttaagatgcatgaatttttaactcccaagaatttatttttgtcttaaaatatatatacagtcattatagcattgcctggaggcataacataccatgtgattgcacttgttaacttttaatctgaatactgtggctcacgtagtcacagccaacattctccctttgtagtcaatagggatctcactcatttaccagatgtttagaaataaacaactattgaatgtgtgaaattcaggcaagaaggtaaatggtttgattaagatggtttgataatatttttaaaatacaaagcaaacaagataaaaacaataacctctaataattccagaatgtagtaagtcactgagatttactcttcatgctccattccagataacttttataacactaagctgaaatcttaacatatcttacaattttgtattctgtgtattcacatattgccagacagaattgtctcagttgttaaaatattttaaattctttttaatggttatataatggtctagagatttgacagtctaaaatttacataatactctgattattattcacttatttattgaaaaacatttcttgagttaattataaagctataaatcagcaagcaattgaattaaaaagaaaaagtacttataattccccttctcagagacaataactgttaatatgttgaagcatctcttgaacattttaaatatctagctatttttctttctgatttttatataaatatgtgaatataaatatatattaagtaaatattttaatgtgaccgtataacacataataagaatatgtattttacaatgagaaattttattaaaagtatatatgacactcttcttaaatatacagtagagttatctgcatggtattacctttttggactgttggaatatataccataattttagagtagttcctatactcaacttttagaatatatttactttgttgcagttttagcaatgctaccataagcattcatattgttacacagttgccttgtcagaaacctcggataaattcttaaacatgtgttaaaggtatgcatatctttaaggctttgatacgtatgggctggataacttcaagaaaaggttatgcaaagttatattgccaacagcaatgatgtaacacaacttaacttttaaaaatatttttgaagtacttatttgcatgaattaccgaatttgtaaaccggttacaaaatatcttattcaagtaaagcccaattttagttatagggaatgtgagataatggttttattgaatatattccttctatatcacattaaaatggatgttaatttttctttttcttttttcttttttcttttttttttttttttttttgagacagagtctcgctatcgcccaggttggagtgcagtgtggcgcgatctcagctcactgcaggctccgccccgcggggttcacgccattctcctacctcagcctcccgagtagctgggactacaggcgccccccaccttgcccgggtaattttgtttgtatttttagtagagacggggtttcaccgtgttagccaggatggtctcgatctcctgacctcgtgatttccccgcctcagcctcccaaagtgctgagattacaggcgtgagccaccgcgcctggccggatgttaatttttgttaacacgacagtgatgagtgatatgttttctgcttgtcacttgatcataaattccaacataaaaatagaagcagtacgataatgatacataggcagtctcattccaattatcagtagcttacagatatacttatttcaaattaagcatttgaaaatgtttacatatattatacttaagtgagaactaaaaaaactgtgaaaaaatacttttcttatttttttctaggagatactatgccactttataagtagaaccacagagaatagctcagttggttaaatttatcatcagttagttaatactgtagagaatttaatgaactgggagataagaaaacatttattacgtatttaaatcccatttggttttcctaacttaatttttttcccagggtgtctcacttcagagatgactttcctaactttaatatctttttacaataactttgttatgcctttaagaaaggactaaaatatttgtaaaattagttcaataggaatatttccaggtcaaatggatccaatttcctcttactcctgaaaaaataaagacaaataaaattatttttattttacaatggataaatcttcttacacaatagattgttcctttttttattttacaatagataaatgttcctacacaatagattctgatctggtatttagtgatgtcaaatgtataatcaataagagaagtaatatcatcatcatgttttggtaatatcatccaccaccttatcagctgaatacaaagtagtgatttttcttctccctcagataccatcggaacagttctcggactcacaggcttgttacctctttactccaataagaagggggaaaaaagcaaacctcacttttcaagaccttttttttttttttgctacctctaactatacatttactatgtttcagttattttcaaatctaatccattttcaatacactaccaattgtatattttttcataaaactgatttgtacataaatagtatgctatgaatggataaaatggaaacaccaaattaaatttcagatataatcattacacatttcatactatctcttagaatgttttgaaaaatccaagaaatactacacaagataactcatagcaagtacattctgtatatattcaatggtagatatcataaggaaagaagaggaggagagaaaaaaggaggaggaaaaaagggggagagagtgagtgggagaaagaaaaataaagattactaagtgaatgaaggcctttgcataaccagctgttatcagaaaagtatctaccatggtcagaagaccacctgtaaaagagtaacactgcgtgttgttaaaagtagatttctgcatattgcctcatatataccaagtcagagtcctttgggatggggctcagggatctgtattcttcagtagcaacaaagatgaattttgtgccccctgaaatttaaaatatattaaagtgtaaagttatttgaacattccaaaccctggcctgatttttttaattgtgctggtttaaaaaaaatttttttgcattatggattgtcattaaagattatgaagtatatacattctgagagcattctaaataaataaacgtttctagagcacacattggaaagcaaaacctgcagaggacgtactcactctgttctgttcactgctgttgaaaggtgcatttgtttttcttacagagtatttttttcagagataatgtgatgaaggttcaagtaataaaataattaaggtgcataggtataacctttctgtaaattactgaagcacacaaattattttgagaatttgaataccaaaaagtttgcatgccaacatatttactataaatctatcgatgttggaatgtattttgcccaggcaaatattgcaagtacaatctaaataatagacaatggtggctgatttgattattgttaatagtggttttcctaaaattataaaaagcatgtatcttgggacatgctttctttatgtcttctgagattataaacatgtttctctacttacatagtttaaataagatttttgtctagtgaaaaacttagcataggaaaagcaagacatgagttcacaatccccaaggtcaagtactgattttgtatttccttcattttaaaaaattgccaatattgatgaaaaagtgattaattattaatgaaaaaacacaggtcctgtggatctctttttaacatgtgcattttaatttgtggtaaaaacatattagtctctgccttttttctctccaatacgtaaagctgaattacaacacaagtatattatgcaaatcaagacagttctttccaagtcactgaaaatttaatgtcagaaaatacatattttagcatacattatttagtgaaaagttcatttttacttttctgcaaaagtgctctaagctttggagtaagagcattttgtgggttcctggtaataccatatgttttagaggttttaacttcctcatgggtatccaaagatgttaatatttgacttttcctgacatttcactgatttcattttcttactgttgctgttgttgctgcctttgttattatatatgaacataaatgggaaattgctcagttgataagtgatcaacagctactttactcctggtattgaccaggagtggctgctttgggaagctgtgattcctttcggaagtgagatatgtcataatccttaaaaatggaataaagtctataatttaaagtattccacaaatccttctggaaacaatcaccaccaaccccaacccaaatgagaaccattgccctggacactatcaacaatggccagacctttggtgaactacctatcctggacaaggcctaccacaaagtaggtgcttttcaaaatatggttcagtcgttgttgaggctgagcgaacagatgaaatagtagaaaaccactgtggtgaaacttaggaggctggcttctagtcagcaatgtcagtaacttctttgaatcagaggaagtcaacggatctttccaggtcttagttttctcctttgagaagtggtttgaggtagacgattttgagtgttctttatggttgcacaatgcatgagataagaaaaatacaaaatacatggtggtgagatagacaacaattaggtcacaatgaggttaaaagtaaataaaaatgaaaaagcataattagaaaaataatataaaaaagtgaaatatgaagcatgtttggggtagaaagaaaattattagagcaagaaaaataggaaaaataattatgagtgtatctttaaaacacaaggcaatggacactggtagaaggatttggtaaaaataaaaagtagcagtattatttgctaaacttgcaagtaattaggaaatacatttttaaatgatataaaatgatataaagtgatataaaaactcatctgctttatgaatttgaaacatgctttttgattatttaacataaagaacaactatgtggcttcattgttaaaaattgtttaccctatggttttatgaggagatatatatatatatagtcttccaaagttgattaaaaacatacaaacccattgtacttcagagtcaattgattttaatgcctgaacatacccactatacactaccttgatattgacttaatatctatttctacttctattttttaagccacagtttttatcattatggtaatcatttgagatgacattttaattcttaggcacttgttttttctgtataaatccattgagatttctacatgcatattcaaacaaacaaaagtacctaagtttatatataacataagcaatatgataacaaaaataaggtttatatttcatgttattttatttttattacttaacattgcactattctgtcaggccaaattaatgaggtagatgattcttggggttcgtttgtttgtttgtttgagacagagtctcactctgctgcccaggctggagtgcggtgggatgatctcggctcattgcagcctctgcctcccatgttcaagcaattcttctacttcaacctcccaagtagctggaattacaggcatacaccaccatgcctggctaattttttgtatttttagtagagacagggtttcaccatgttggccaggctggtctcaaactcctggtctcaaatgatccacccgctttgggctctcagagtgctgggattacaggcatcagccaccgtgaccagccgaggtggatgattcttaaagcaaatacagaacatctgaatggacatgtactttctagatgtcgtgggagaagtgtcatatgatagagagatatagatagatacatatacacttatatacacacaattaatacatttttaaatatatgaaaatgtgatcaaaccagaaaataccctaaagatttagtgaggtagagaacacagagtttttagttgtagtagatgaagacaagactataatgccacattagaattatttaaccagaacttttatgattctcagaatttgaacagggtcacagaggtgcaaagagaaaggcatgagtaaaagcctaagtttgtggtatgtaatgtgttcttaggagacactgagtcgatgagtagattaacctgattactgcagaggcctaatataagaagtgtatatgtgggtgtgacccatttataaagagcttgaaatgccaggctaagatagtttgaaatttatcctgtaggtggtagagaggtgatggataatagaaatatttacattattcattgtgattaaggatagtttaatatatctttttttttatttctgagttaacatttttaaaggaaacccacttttgaatatgtgtatttcagggagcttaagtacttttttacattagataattatatgacttgccaattgtaacagaagaatttaagtgttttaataatactttatagataatagtaacactctcttagttatgtatccattgtgccttgctaatgttaccatttcctgtggggatgactgtactagacagtgatatatataaaatgtgaggacttattctcacaacagtttgatttattaggtgattaactgtgaatgttgcttctactaatgtacaaagattgctactgtaagttcttttttttttctttttcttatactttaaattctggggtacatgtgcagaacgtgcaggtttgttacatagttatacacgtgccatggtggtttgctgcacccatcaacccgtcatctacattaggtatttctcctaatgctatccctcccctagccccccaaccccccacaggccccagtgtgtgatgttcccctccctgtgtccatgtgttctcattgttaaactcccagttatgagtgagaacatgtggtatttggttttctgtctttgtgttagtttgctgagaatgatggtttgaactttaggaattttaatgttctttgaatctgatatggtttggctgtgtcccttttcaaatctcaacgtgaagtgtatctcccagaattcccacgtgttgtgggagggacccagggggaggtcattgaatcatgggggcctgtctttcccatgctattcttgtgatagtaaataagtctcacgagatctaatgggtttatcagcggtttccacttttgcctcttcctcattctctcttgtggctgccatgtaagaagtgcctttgaccctctgccatgattgtgaggcctccccagccatttggaactgtaagtcaaattaaacctcctttgcttcccagtctcaggtatgtctttatcagtagcatgaaaacggactgatacagaatcctcaagatctcacactatttttgtactcactgggctacattgggcttgcaagtgttagctaaatacgttaatagtaacagtaacaaaccagctttaaaaaataacatattagacctaatattacctgtagcaagtatgtaggctcacattaacttagagcatgcaggaacagtgaaaggaatttgacttattatgaataatggaatgcttttttttttttaagttttagggtacatgtgcacaacgtgcaggtttgttacatatgtatacgtgtgccatgttggtgtgccgcacccattaacttgtcatttagcattaggtatatctcctaatgctatccctccccactcccctcatcccacaacaggccccggtgtgtgatgttccccttcctgtgtccatgtgttctcattgttcgattcccacctgtgagtgagaacatgcagtgtttggttttttgtccttgcgatagtttgctgagaatgatggtttccagcttcatctatgtccctacaaaggacatgaactcatccttttttatggctgcatagtattccatggtgtatatgtgccacattttcttaatccagtctatcattgttggacatttgggttcattctaagtctttgctattgtgaatagtgccacaataaacctacgtgtgcatgtgtctttatagcagcatgatttataatcctttgggtatatacccagtaatgggatggctgggtcaaatggtatttctacttctagatccctgaggaatcgccacactgacttccacaatggttgaactagtttacagtcccaccaacagtgtagaagtgttcctatttctccacatcctctccggcacctgttgtttcctgactttttaatgattgccattctaactggtgtgagatggtatctcattgtgcttttgatttgcatttctctgatggccagtgatgatgagcatcttttcatgtgtcttttggctgcataaatgtcttcttttgagaagtgtctgttcatatccttcacccactttttgatggtgttgtttgtttttttcttgtaaatttgtttgtagattctggatattagccctttgtcagatgagtagactgcaaaaagtttctcccattctgtaggttgcctgttcactctgatggtagtttcttttgctgtgcagaagctcttcagtttaattagatcccatttgtcaattttggcttttgttgccattgcttttggtgttttatacatgaagtccttgcccatgcctatgtcctgaggccagcaacattctgataccaaagcctggcagagacacaacaaaacaagagaattttagaccaatatccctgatgaacatcgatgcaaaaatccttaataaaatactggcaaaccgaatccagcagcacatcaaaaagcttatccaccttgatcaagtgggcttcatccctgggatgcaaggctgtttcaacatacgaaaatcaataaatgtaatccagcatataatcagaaccaacgacaaaaaccacatgattatctcaatagatgcagaaaaggcctttgacaaaattcaacaactcttcatgctaaaaactctcaataaattcggtattgatgggacgtatctcaaaataataagagctatctatgtcaaacccacagccaatatcatacttgaatgggcaaaaactggaagcattccccttgaaaactgacacaagacagggatgccctctctcaccactcctattcaacatcgtgttgggagttctggccagggcaatcaggcaggaatgctttgtttcaaggcagttagtttcccagtccttcgcggctcctactcagctgctttctttgagtgttcaatggggagtttaaataagaatttaaactgcagttctaaaccttttcctttgtttatagtactcacaaactaaatactgaatctcaaaagatggccttatttagttttgaattcttatataaggtaattacagtattgacgtgattagtcagcaggctgaagttgtcaaagtaaaccaaaattgtctaacatttatgaaagaagtcaaacagtcttttggtaaatttattgagttagattctctaggaggcccttattattaacatcccaaagggagaatttattatcttaatataatttttgataatccaggtatacttttagtagtgaacattcaactttcaagataaccagagtaatttgatttgaccatcaaaaattgtgtgtgtgtgtgtgtgtgtgtgtgtgtgtgtgtgtgcatgtagatctcatttgatgtaatagttacacaaaaactatttctgaattttgaaactcagccaaagcaaaaaatcattggccttcaatacattttacatacacaattgcacgaaataaatttatattaaagataaacaaaaatattcaacataattttaatatttgcattgctttaggattcattcaggatatttcagcttcttttttttatttgttgggacatatgtatttttgattttacactggttttaataaaactttatatcttaaatgaaaatcctcagtagtataggcagatatggggaaggtatcttacaacatactttcttctgtctttagttttcaaaggtcccaaagaaatcaaacaagcatccactcctggaagaagaatggaattaagttaaagatcaaataaaattaaatacagtggacaaaaacttctatttggaagaataaaaattagttgatattatatgaaagggaaataatattattttgttaatttcaaatttaaaaataaattacgtttactttgaataattaatataagcactgatccgtatatgagatacactgaatctgaaacctacaaatatttagtttggaacaagtagccaatgcttattggaataaaaattatcattatttattatcatgaaaatgattaagaatctgtactgagttatgacactgttaaatgtagagttattagaaaatataactgagtatttataactaattatataaaattgatttgtaattagctctacaggggtgcaaaaataatttctgcaatattaatgacaactagattaaagagaagagcttttttctccttattctaattagtttggtagtttgatttacaagttcttatttatgaaacaaatataaatttatctttctctaaatgcctttggctcccaagctaccttttctaatagatgtttgattccttctctttactttgccttaaaattattaatgtagtcacactggctcccaagctaccttttctaatacactagatgtttgattccttctctttactttgccttaaaattattaatatagtcacacaaaggttataattaatgagaaaaagaaaaaaaataagaaacaagcaaatgaaaacctggatccaatcctaagtaaatgggcaaatcaggaaatctttgtgcttttaaaattccttttaatggattctattccattttgtctctccagacttcttgctgggaatccactaatctaatataaatctactaggtgctattctcccaactattacttgggaaatatgtagagaaaatgtcctgtcataaacagacttgttaagccaacccccaggtttaatcttcacaacatttggtattttttataatataaacttgtatttcatgcccttcttccctgctagaccaaaattcctgagtgtagaaacatctgttattggcctctgtattcctcagggacttactcagcaccagcaccctatgcctggccattgctggtattttataaatacaagtgtttgtagaatgaatgtgtagaagaaaaactctgtatcctgcttgacataaataccaataatcaagggcctgttttatcaattctgaattaattaatagtgaaaaggtatttattattcccttttgtccatgtatatatatatatatatatatatatatatatatatatatatatatatatatataatttctgactgtttcttttaaaaggcatgactttaaggcatgagttttattacttatgatattcattagatatctagttttttttcacatctaagcactctttaccacctggtactcctgtaaagtataaaagcctgtttaatggtttaatgtagtatgccactagaatgctaaaatagtacttttcagtgaaagtgttacaagcactcatgcatagaacatatctagtgaaaccccagcaacaaccaaatgcctctgtaaaagcagtcttgtaataatctgtaaggttgttgtaagatttggtaaaaatatctatgatagtaccaagcacccatgataagccctcaataaattatagctatcattgtatttcttactgtttttcaagccaaattgcatttgtgagtagcgtaggggcaactaaaaacagtggtattgtacatgtagaaaacttgtatggtagaattttgagaaaaaattaatgatctcttttcaccatttttcttgccagcttcttgctcatttctgtaaaataacttgtgttcatagtttacatatttagtgttgtgatttgcatcattttagaaacacttgattgacgaaattgagaaatacatctgtaagttgtggtgaaatgggatagaagtgaaagtgagttactttgttttttgtgttttttcaagccaccaaagttcagtgaataaagtggctttaggttcttgtagctgggaccaaatccatctcagtttgctatattagctgagaagctcaaagaacacaggctggtagagcagaaagaatgtaaaccacatgcatggttctatgtgcgcaccgccttctccacctgtagactctcctttaattatgcgggaaaacaagccatagacttgagagttagatacagtttatttgcttgcacttttaacgtcactatactttcataaggatgctcattgcccacctccattaatgaggattgagggatcccagagctgaaagcatttagcactatgcctggcacacagcagatcctcaagatctgctttccttcctttccccttcccaaccctccatccagtctggtgtgatatatgaaagcaatgttgaagaatgaaacagcttggtgtggtaagaaatactgagaaggaaattttcatttagatttagtggtttaactagcatgaatttttattggaaagggggaaaaaaggtgctattctggctgtatcttactagcaatataatcttgtgccctcaaaagttttctgaatctcattttttctcccacaaaaatgtggttttaattatttatcacatgcagctctaattatgtacagttccaaaatgaactatccaagcttcttatccttagatagtcccaaagaaatgttattatattttgccaatacaaaaatctgaaatacagaaaattcaaggacgagaaagcaactctattttctatttaatcttgtagtctttctctctttcaaattcagaaagaaaagcaactccctgaggaaagatcaatttcaaaggaatcttcagtatttctatgaaagattgataagtacatgtttcactgtgtaacatttgaactgaaaggaacaatgcacatggcagatgcttctttaacttgaaattttacagctgtcatctgttgcagcaacaatggttaaatgaatggaatattgtttattccacggagaaaattatccagcctttagtatataaatacaccttttattttttcacctttatatatgaaagcaatgatatgcacctatcctcatttataactagttgcttgttagttagatgtatcctccatcacactcacacacccctttaataatctggttctcacccttttcactccattgaaactgcccattcttattgcagccaccatctgactgcctgaccatttctcatcgctctcctcctcaatctctctgcactatttggtatgttttatggcacctttccaccatacacatgttcttgaactcctctgtactatcttgcattgcccctccattctgtgtcttctttattagcctgcctttcttcttttgtctgcaactagattacatgctcagatgagtgctctctttcaaactcccttgattcattcattcccataaattgagtacgattgatacctctagggacatgaatctcaaatctctatatgtaggactgacatcttacatatatatgcagctgctgcggagtatttcttcctggaagtaccagtgcacacctcaaagtccaaagttccaaggcaaaacttactatttccccatggaaatgtacttcttcttttattctcaccctgttgatagataatagttaaaattgataaaaatagataagaaatagataaaattgtatacagataaacaaaatagataaaagagttaaattaaaaaacaaccactttgtaaatcttctcttttattttgctgttcgtctgctttgtgctgtggaagtttcatccatgatttttttaaaagttacatcttatttccccgaatatcatcaaatacttttatttccattagcctgagctattttaaataaccttatcattggttccacataatctctttttctatcccaatcttgcctatgtctctgcccaagtagacttactaaatattcgtactgattgtattttttcctcaaagtagcttccattgccttctgcatcgacctggtacccaaggccctccacagaaacactctgatctaccttctactgggtactcacctccatattacctgtatttagaccaattaacttgattacatctatacatatctcactgcacttgctcatgttttctctctttacaaaactctccttccactgttataatttattaaaataattttctttctccctccctctctccagcactttctgcctttctttctaccttcattacactaatttttcttttgttaatttagtttttctttaatttttaagagtatatagtagacatatacgtatatgtatttatggggaatatgcaatgttttgatacagatggagaatgtgtaacggtcacaccagggtaagtgagatatccatcacctcaagcatttaccatttctttgtattaaggacattcaaattgcactcttttagttattttgaaatatacaataaattattttgactatagtcatcctgttgtgaatatcaaatactagctcttatttattctatctaaatatatttttgtagccattaaccatccccgcttctctctccctccaccgtccttcccagcctctggtaaccatcattctactctctatctcagtaagttcgttttagtttttagctcccacaaatgagtaagagtatgcatgcatgtatatttttacttgctacttgtccgcttatttaacaaacttttttagaatcttttgtgtgcctggaatagttctggatactgagaatagaatagaatgttataacaaaacaaagaccatgtcctattgtccctctggtctagacaaagagacagataatattcaaaaagtcatatacactgtgtcagtaacatgaagtacagaaaagagcacaaagccgtccttgacaggtctggtctgttattcaaggcccccttcaaatgtcaccttccttaggagtttcttaccaatcgtttacccaggatgtaaattttgtaccttaataaaaatgaaacttcagaaaacaaggatttttgccagtttgttttcatataagccaaataccttaataacaggacatagaaaatactttataaatattaatcaaataaacaactttgaagctcttacttctttgtttttaccatgtcttgcagcagttatattattgcttttcatattctatgtttatttgcataattatttttatcatcacttcagtctaaaaacagcaaaaagtcagggattttacataagcgtaaattactttacataagtacaatgtagattttactttttcttctatccttgcaatgcttattccactgtacactactctcacttatcaaacagaataagcaacatacattcaaagacatcctaattaatatacatattgcttaagtgctaatgttagtcaaaagttgtctctaattgacactggtctcattttgccacttggtaacatattttgcagtggcattccttaatggcctcacttgtttattatttgtttctataaaaaaaaaatttgagttttgagtgaaatggatcatgcgtataatttgcctcttttttttttagtctttcttgcatagtgtcatataaatctgaagggcttggaaaagaatttttaattttaataaactcatctggtagcaaagctgcattgttctatttaaacttttgtggtattaattaatttatttacacatttcttacatgtattttattaagaaataaaaggatttagttccatgatgcaactggaaatttgcaaaaccaaatataatactacttaaaatgtgtattatacatagtatgcgtttgacactgttattcagaaggatattaattcatttaatattttacaaaatccacggaggtaggtactattattatttgtatttacgtaagaagaacctgaagcatccagagtttatataaattgtcctaagttatacagctagtaggtaagagttggtacaatcaaattcagtaagcctaggcccaaattcagtgccctcaagactgttgctctactgttcctcctagatatgtatgtgcctatgaaatgagtaaaaagaaagcggatgacattcggaaaataaagagaagacagactaatctcaaatatgttcctacaaatataaaacaatttaatatatagctttttatgtaggcaatcccataactccaaaagtgaagaataataaaattattgagaaggcctaaaaataggaaattagggtgaaaggaaaataactatttataatttgatgcatacaggtctagattttatcaaaacacagtgatcaaaagcagtctggtgagaatctatttctgttttggctacatcctccttttctcatattttgttccacttgaaatacctattattttatatatttgagatgcattgtcatagtaagagtagcttaaaagctgtcttcaaatagagttattgtgttctctgaaggccagtattcctattgtttagcaccttttcttattagaattcaaaagctaccattcaaggtccacctgatatctatttgaatcaccaaatctcacatagcaaaggactatagctcaacattcagatttttaaaaatctttcatgtaaagcttcagttttaaagccttttactatagcttcagaaactctgtagtgatcttaagaaatagaaatcgtcattcaaaaattttatgagccacttcattttagattcgggattcaatgattctctagtcatgaatgttagtggcaatttccaaaggctttgctgcaattcagttaagaatctttggaagaatattttccttttacatcctacaagctagagattaatttccaagctaaagaatgtgtcatttcacttctaggaatgtagatggcagaaataaacataaagcacaagaagtttcaagcacaaagatgattgctactttcaaataattcacagcagcagaagacatctacacaggaaaggaaggaaaattttgtacattcacactgtggaatattatgtagccactaaaagatgcttggtaaaggtactaataatgttaattgaaaggtttagaacaaagaaattctatagtcagtaggatcatgatatttaaaaaattgggcataggaaaaaataaaacaaggctagtaggaacacttgtcatacttttctgtacatttgctatttttatattttgaatgagaaaacaatgcttttatgatagaaaaattgaatttacttaaaaaaatgtaaaaatgttacaacaaggtttcccatcatatgttttgggaactgacagactagatggtaagtagatacatagatagatacatatattgattgatcaataactaaatagatactaatattctattatttattataacaatgtaaatgcttactaaggtaatgcagaagataatatgttttatttccttcatgtttcagacataaaacatgataaatacgaatgatatttttctgtcatggatgttttttccatttgctcatggaaagatgtcttagaactgttctattttggttaataatcaagtcagtgactaacaatcttgatgcaaaatgactcatgcatgatatactctgttagatggtgctagtagatggttcaaaagatacttagaatatgggggtcatgttataaaataataaatgaagttcaatagctttattaagctaaataatcattgcttcttgcataaaaattcttccttcaagttaaaagtgtcatcggtgaatatctataaactttgtctggtttgtataaaaatgtcatagtaattatctcattgttgaataataatttagttaagtattccattccgttattttttctgagaacttcagtttttatttattcttcaacaatttttaacattgccctggtatgctgaagatttactgctacgtgcatcgctgtggaattcttcatatttgtctcacttgtgcttactcttgtctggttagtgattcctgaatctgaggcatgtccttcatcaattctgggaaattttatctattttcactttgaatatgtcccaggtgcattgtatctattttatgaccatgaaacttatattagatctagatgagacttattctatttgccatgtctcttaaacttttatttctatttctttatatctctgtgaagagttttgatttagttttgtcttttaggtcagtactcttcatgtcagatctaatccactgtttttaccatcaattgcattttaaattataatgattatgtttcactttctataaaatattacagttatctttactaaggtataatttacataaatatataatgtatttagatatatttacatataaatacatacatatttacataaaattaatttcagtgacttcaagggtacaattcatcggatatttatatatttcctatacatataatatatattatacatatttcatgattatacatataatatagcacaatatgcaatatatgtaatacatatgtataatcatgcaatattatatatcataatatataatatattatatatgtgttatatattataaatatatatgtgtaatcatgcaaccaccaccacagtctttgaaaatatttgtatctgttcttctgggaatttttccccctaatcttctgtctcatctttttttatagtatcttgttgctttcacatatttacatttattttatgtattctatcatttaaaaatatttatgttataatgtgcatccagtaaatctataatctgaacctcctttttctttttgagacagagtatcactctgtcgcccaagctggagtgcagtggcgcgatctccctcacggcaacctccgcctcccgggttcaaagaaattctcctgtgtcagcctcaggagtagctgggacttcaggtgcatgccaccacatccggctaattttctttttgtatttttagtagagacggggtttcaccatggttaggctggcttcgaattcctgacgtcaggtgatcaacccgcctctgcctcctgaagtgctgagattacagacttgagccactgtgccccgccaatctgagcctcttatggtctacttatgctttaatttttttttcgtaaattaatctcatggttgcttctctccttgaatgttttgtacatatgtactgtgtctgcatatttttgcacattttcatctgtgacaattctgtatggcctttattgtaggtatgtccttcaagagaagattggcatttgcttttgctagataactcacaggtacccaagaacacttaaaagtttgtattatgtaatgtttcacacataaacagaattttcatttatctatataagggaatgcatacatatatgcatatgtgtcatgtgtaagtaaaacaataaaataaatgcctcttcgataccgacagattaagaaacagaactttagatgaacactgatatggttaggcttcgtgtccccacccagatctcatattgaattgtaatccctataatccccataatccctatgtgtcaagggagagaccaggtggaggtagttgaatcatgggggtggtttcccccatgctgttctcatgatagtgagtgagttctcacgagatctgatggttttatatggggctctttccccttcactgggcacttcttcctcctgctgccttgtgaagaaagtgccttgctacccctttgctttccgcaatgattgtaagttttctgaggcctccttagccatgcggaactgtgaatcaattaaacctttttcctttataaattacccagactcagcagctctctacagcagtgtgagaatggacaaatacaaccactttttacaataacttcttaggacctaactatccactctggtgttcagtttcctccccattttttttttttgtacctgaaaatatttcttttgaataaatcatgcatttctttatatattcagcagatatattttgaatactgactaggtgtcagacatgattctaagtgctaggaacacaaaagtgagcgaaacagacaaaacctcctgctcttagaaagtctccattttagtaggggcaagataacaattaaaaggaataagtaatgcatttagtataccaaatgggaatcaatgctacaggggaataaataaggaaaagagtatagagagtgtcggtatgggcagaaagtacaccttgaaatgggaattcgaggaaggcttcactgagaagaaagaattgaagaaggtgaccagtgaagttgtgtggaagctgggaacagtaaaaacaaatgccctgaagtgttagggtatagataaataaaagcaagggagtctgcttggctggagcagagtgatcatggtgagaggagctcagagctataacaagggtgtactatgtaggcactggaagaaatttggcttttactccaagtggaactggaagcctttggaatgcttccagaatagaagtgatgtcatctgacttatgttttaaatagatcaatctggatgttgtgttgagatagactggaattggtcaaagataaagcagggacaccccaggaggctattatagcaacctagatgacaaagggtagtggttttcatcagaacaatagcagtggaagtgacaggaagtggtcaggtcagattctggaagtatttttaaggtaaagaatacaggacttgttaatggattgtatgtgggtgtgaaatagaagagtcaagaatgactacattgttttggcctgaacaactgcaaggatagatttaatatgaactgagagagactaggatggccagaacttggagaggtcagttttgagatgtcagtttggagatgcctattaaacatcctagtgtaggtttcaaacagaaaggtagttccaagggagggcaggactggagatataaatttgagtggcataagcgtattgattttattttaagagttgacacctgacaagctccccaaagtagtgagtaagaatataaaagagataaattgtagggattgagtcctagggagctctatattgcgagatttgggagatgacagaaagccagaaaggcagattgatattgaacagccctttaattaggagaacaacatgttaagtgtggtgtcctggaagttatgaaaattatggagtgatcaagtgccctaagtggtactgatagtatcaattaagatgaagactgtaatttgactgcaaaaagggcaggaaaggctcaatggagtaggttcaggagataatgggaagaaaggaagtgattttttaaaaaaataataataataaatgagcaatggggccatcggtaggtaggggagcagcgataaaagagattttttttttcagatggtaaacataacagcagtttgtagagggaaaaatctgaagagagagaaaaactgataatatgggagagagaaaagagaactgctgggattttgctccggaatagatgagaaaggatgagatctaatgtgttataagtggaggagctagtctttgttaagtgccaagagagcttaggatttaaaaggatgtttatcttcagggttttttttgggggggagggggttctatagttgtggtttgggcttttaggggtatgatgtctacaagatggtcagaagtggctattttcacaaatgtagtgcatcatctttgttagtgtagcccaaaaggcctgcataatctagcccctttctctatggctgagccacagtggcctttcagttactgaaagtccactcctactcatcacagggcctttgcacatgctcttacactcgtgtccaatggaacttaccccatggtttccttcaggccttcatagcacttctcacagatccaagtttccctttattttgagttcatctgattaggatccatctttaccattaggacttaatctcttagggctggaaccaagtcacttaaaaatgcacaaaacgcacatagtatacactgagtagctacgtgacattcattgttttatgaattgataagcctattatgaactaaaaacatttttcagtgtatttaacttagagttatgtggtacaaagtaaataatacaggtgccttttttttttcctcaatttggctgcctaagtgcaatacattaagaaggttattgccataattttactgtgctggctggataacatattttagtaagtagaatgtaatctcaatatgccagtaagtagttttgcctctgaagaagatgttctagcacattttccaaaaaggacaaaatgtgttcatacagaaaatgttatttagacattcaaaactaagcttcaatttgggaacctttaatggtgattctatagctttgagagagcactacctcaaatatttataatatttactcaccaaaataaaatgttcactggtctctaaaagtgtttagggtagtgtgttgaggctgatgattaaggttggtcagggatgtgggagaagaggttggatatcaaaattaaaaaacaaattgaactggaaactccatgtacatacaaatatacatataaacaaagaaaatagtaaaacaatgtggctaatattttcttgacacttagaagccaggagactttcaacactaattaaaacctaggaacataagctactcaatcaaattaggaattaaattaaatgtatgatttggttctgattcttgctacctgggtgattatcaaaagggttttaaatcatatagaccttaattccataaccacgggatagagtctgtagtattcttttacatatgcccactgtatgactggagtttatgagacagaaatataaaatagcatattaattttcacagaaggaaattagctattatcttataatttttaaaattttccatcagttaaatatgctgccttgagtctcataatatcctgttagctaatgattcaagtatcccatatctcagagaaaacaaatcaggttgttttttttttaatagctgtttaagtaacttttttttttttttttttttttttttgagatggtgtcttgctctgttgcccaggctggagtgtagtggcacaatctcggctcactgaaacctctgcctcctggattcaagcaattctcctgcctcagcctccccagtaactgggattacaggctcccgccaccatgcccagctaatttttttttatttttagtagagacggagtttcaacatattggccaggctgatctcaaactcctgacctcaaatgatccacccacctcggcttcccacagtgttgggaatacaagcatgagccaccgcacccaggcatgtttaactaaataacttataaataactgttgtgttattagatcattgctgtagaaccaaagcaaaattaagtcctaacagtttttagcatcaaataagtggagaattttctgatacaaagtcaagaaaatgaaggaattaaggtggcatgaagggttacataaaactacttagattcctaatgcaatactttgaattattaaatatatttttaacaaaaccatattattactcaaggtcctgatttttataaatgtaaaacaaaaaatttacaaatacatttagaaatttcaggtaattatttttctttggatctgcttttgaattgaagcataattaaaactgtttgcttaaaaatcaaattattcaggttattgatttttccacatttatctaaaatgactatcatgtaacaggagttctattttcactttgattataatagaaaatgctctaaatggaatttactattattagaagaggaaataaaataatctcatataagatagaacataatgataaaaatgagtgtttgaaatagatagctgtatctgctattcagacataccaagtatactaaattatcagtgagtagaaatatactttgtttaagggaggcaataaacagctaagattttacaatcaaaacagatgtaaaaagcaccatccaagttttcactttcaaaaaaatagtggtagctgaggcttattttaagaaaagtcttgatttcttatgaatcataagtatttccataatcagggactgttaacggtctccattagcaagtattatttttgacattttcagatctctgatggtatcagatctggaaatatcttgccttttactgtcacatggacaataaaatgctagatcaaggggaagaaaagaagaaaatttcaaagtaagcaaagtttcatattcagaaatggaatttataatgtgaaccacctttttctgtaaccaagatctctcaattccaacaaattcactgtccaaaagcaatatatagaacttggaatttctgtcctagttctttcttctatatattatttgcattcagacgtttggcaataatgttttttagtttaaattaaaataactagtatattactatttggaaaagtaaattccttttctgaacttttcttaatttcactggcattttttattgtaactggccagaaatgatatattttaaaataccatgaaactgaaaatgtcaggaattgattatccagcagaagaagtcaaggttatgagagaggaaactaagttgatataaaattagtaatgaaaatatgggcttttactacttgattatattcattttatccatctgtacaaaggcatggaagatgaaagatcgtagtgagccgagggtggtaatctttactctggagcatgggtcagggagtggggagggaaataagggacagtgctaaaatcatggtctgccacctaatttcgaagttttgggaaaaccccacctgccacacacactgtactaaagaatttggaagtcatcaaaacatgtatggcagaacaacttaaaaaaaaaaaaagagaatgctgaaaacaaatgggtataacgtgatctaacctacatttaatgctgaattttaataacattatagaaggtgaattgagaaaggaatcctggaaatacagacaaagtgggaaactcctgcaataatctgtgtgaaagatgacaaagtgctgcattacggtagggaaaggaatacaagaaggggcacatttgacaaagctatagagacacaataaaaaacgtggtgatgaactagatatgagtacaaaagacagaaaagaagtcaaagaagagcccaaggctactcacttaggcggcgggaaaatggtgaatgcaaaggtggagaagattaaaaaaaaaaaaaaaaaaaaaagctgattttactggttttggacatgctgaatttgaagtattccagatttttatggactttttaggtggaaaagtctttcagcagttgagaaaaggagtgtagagcttaaaagagaagactgagttgtatttatcagatttctcagaacagttgttttctccctatgagatatagaagtctgtttggttggggtttcacagtcattcaacttagctagttttgagcacggggtagtgaatgagaactctgagagagagcttgtgggtgaggaaacaagatgatcgagtgtggaaccttaggaaactcatcatctgaggttgccaggagaggtagtaagaaaaccagaatggagtggacacctggaagtcaacgtggaaatagttttaagaaggaaatagtcaaaaggattagattctccagaaagtcaaatgaaatgagaaataagttgtgcccccaaagtttgggaacatagttatatcttgaattacatcctctgccttaaatagcattttcatccttccttcattagagtggcaaaatctgtttcagatcactcctaaatttgtagtttcataatatgtaactcttttgactcacacgacaatgatccgagcccaaatggacatgcagacttaatgatggcattgttaatagcatcgtgtgttatcactaagtatcaacttaacagctaccttttcttttaagttccaacattaggagtttaaataagactacttcattttaattacttgtacatattttaaagcatacattctgaattgaactttgtatccaaagcgtgaataatctagtaggattagacaaaattaatataaaactcttaagattgttgacataaacatacttgtgtagaaagacattcagaaagtattattaaataatattaagatgtttaaatctaacacaattcttaaaaataaatgtgcttctataaacctgagaaaggtataatgttgatttgtctctgtttatttaaaaagtatgtcatagtcttagtaaagacacttatcatttttttctttgcttcataattatttgactactcatttcacctcctcgactagactcttaatttccatagtaagagggttcatgctcatttctgagtttcccacattaatttgcctctagacccaaagtctaaaattaaagatatagtgaaatattttcccagtaaatcatatcaacaaagatgatacgttactgccttaattataacagcatgcattttcatttttcaatgtatcttttttatctaattttttcattgcatcattgttattagattggttggagtatgatactagaaagatcaattaagggttcaaattctatgtgggacttttacttgtctttctcatggccacaaattcactctccactttggccatatttgcagctgtgcaatattggttaaaaataaaagagagtgggtggacagaagtagaaatattatatgaattcatttatatctctggaaaataagtttggagaacactatctgttctgtctgaatcagaagcatgcttgttctaaaggaacagcacaacatttacttctgcctgcctggaaatctgaaatttctgttgatgatcctcccattttgacatgttagcatctgcccactgtgtacttttctgtgtgctattaccagcagtgtgctcagaaatatgatcagcccatttaagacaaggttgttgcaggaagactttttaaaagacctgttcctttcaaaggttcatgattttaaaccaaaataaccacatccattctttataggaaagatcatatgtatacaattgacaatgtcaagataccttaatgtttcttgatttcatttcatacatgtaactgttcatggtgaattattttaataaagttatttttaaataatacagattatttcatccaagatagaacaagcattttttattaaaaagaatcttaatgtattatatataaaataagatagaaaaaattatgtgactaggagagaagatattacaaatattatagttctttaatgttatactattcttggtaatataaaagctttttggtatcagagcaacacaatatatcgagtccttcagtttgtggctttggtcaagtttaaaatttgaaaatcgaatcattgaactaaaatgttattacactgttcatattatcaagcagttaaaaagaaaatcaatttccttattgttttaactggataagtattcttatattaaagaatgaagtatttgaacttagaatcttcattatcttcttgttttactgagatcagtaaaccaattagctacatataatttaacatactaaaacaataaaattcattaatattttgcaaatttgtttaaaatagaaaaaagttgctattttcttaacaatcaccactaagggcaattcataacttacacatcatttaaccctatattacaggcaaaacattcataatgattacatccaaaaataatccaaacaaatatatttttctggaattagaaaagataaaatgatggagattaaaatgtcaatttgtttgctgtgataatcaagttaagaggaaaatattttcctttgttataaagtgtaaactctatacaggaaggttttttttttcctttgctctctgcagtgtcctcagcaccaagcacagtgcttacatatgtgagtaatttataaaaatttttaaatgaatgaaacatgaatctgataatctggaaaccaacttctgtttataaatcaacataattgtgctatgcaaagaaaaataacatgcaaacctagtctaaatggtaaactcttttatatcattctgtgcaactctgcaatttttcagtctatataatacccaaaatcacatgacatcatgtcagtttcttgaggttcccaatgctgtgctgcacgtaattcttactgtataaagctcaaaatttacatcagcaagagtgtatgtgtggatcagcacaaggctaataaccctgtaagaatagttacttaaactttatggtctcctaagtagagaacaatgctgtaatccagaaaaaatgggatattattaagagaataatggtactatgcttagaatttcatgtgtgtttatataattttctataaaaaatctaaaatataagtgatttaaggtagtttgatgattcccctctgtgacgagttgagctaaattcaaaattatagaacaaagcaacttaaaaaaatagccactttttgtgaaggatcagaaatctagaagattgcagccaagtttaaattctttaggagaaaatttcaactcgatatttctccagcctttaaattttgagttagttttgctgggtttatttgtggatactccatctgttcagtgctgagacgggctggaagaatatattatggatggccactgactccaaactgatgagtcactaaagcaagaaagtacgaggatcatgactgaattcagcaggacatgtgaatatactgtttataaagtagagttcaagatttcgctttgaagaatctgggtcagaccccaagcctttaagtttcggtcaaattgaatgtaagtattttttttttcctcaaactaagttactacctagtataattgaaaatatgtgagttaaaaaaaatccaagcatttaaaaactatagaacgtatttatttatataatatcaattcataaaatatttgacatacactattagaggagaattgtaggagaaagtttttttgtcagaaaatatttttgtcagtttcagaacacattaaactttgaccttacacaatgggacttcaagatatgtttgggtgttatgtttgctaaaataaggaggcattattttaaatactttccatatattcgctgcattctggtggggaggctttgctgaacctcacagagggtctaggcgatttgacttgtcatgattacaccaacactgttttccttatttggcttgaatttatatcactggaatatttgaagtagttgatcgtcttctttttgtggagtttgtagttagacaaaatatatgcaaatgatgtgtgctgcttccttgttctcttatttgtataataaagaattatgtgtatttttttcaattatcctagaaaaaaatttatcctaaatgcaaatgcaaacagtctacatgacttattaaggaactaagttacaccccaaactcacataaacatgatatatgttcctattatctttttttccttttcatttttaccctgactcttccagctcaaatttcatctcttgtgttttccttttggagcccttacatgttttttttagagttcttagattagagaggtcacaacatctataatttagattcttaaggaatctatttatagttttgtctgctttacagtataatttttctgttatggattcttcaactggtttttttctcatatttttcttgtagcattgttttttgctttgattttggttaaaagcagatttccttctgaatatcactcattgtttagtggattatttattttcccggtcccagcaattttttgaagaacaatgttgggatataagctagtgggctattagctggtggatcctgggactaggcctatatcaagacctccactctacaaggagaccacctctactcttggctagcggatctgcttggctaacatgctttgcatttctaacactctgcatatcaccagttctgaacattgcacttcttttctctagtatatcgaaaacacagctgctgagttgacttttgctcttccatgtggcaaactaaaagcctgagttgtattagaaatgccatgaagctctttctcacttggccccaacctccctgctaccctttgataaatgactctggaatctagtgcactcctgcccacacacctagatcttgtctttctaggcaaggggcgctggtgtggcactgaagagtgtatgttacctgagagatgcattggaatgggttcactctttacttcttccctgcaccattttttctgctttccgtaatctgttttcctagattgtggttcagggttttagctgttttttagtttcagcaaagatggagaaaactccttatttcctgcatttgtattcttgttggttagtttcagaaagaagattcaagcagagacagtcttacttcagcatcttcaacttgaggttccacattacattcaaatgtggtcagtgccctctgaaattctgatgagctgtctgctgcaagtatggatagatgtttaatctggtatggaaaaacggcattgccctgttcattgtagagagcaacaacacataatttcttatctccctgccatatatcttacttagaagtgaaacgttggctgggtgcagtggctcaaacctgtaacccccaatactttaggaggctgaggcagatggtttgcctgagcccagaagtttgagaccagcgtgagcaacatagtgagactccatctctattttattttttttaaagagtgaaatgtgaaggtggaatgaagttattcatgaaaatatgatgcatggaacttcagaattcatttgtatttgataatgaatttaaggtattaaaaatccatatgccttcaaaaaagtaacctgccttttgaggatcttaatttacagaatatgaaaaactgtttagctttttctttctccaattctccactcatcagtctaacctctagccctctcaatgggctctgtcctactcaaatatttttgatagaaagaaatatattaatttattaaatcatgcacaccccaaaccaggaactgcatacaaaacaaaaactaaagagcttttctctgtaagtaacttgctggctgttaggcttacctgaagtataggaaataattaaatctgggttcataaacctgctgcttttgatacttgctatattatgagatgtgtgagactataagaataaataaagatgctaacaatttgtactatcaatataatgtaaaaagtgaaaagtcaacaatagttgatatattcttccattacaattaatttttatgctataaatttattttacattaatcatagctataattgttatttgtgcaactgttcaaatatctttatagataatatggaaaaattcatttgccatttgtatgatataacatagataaatgtaaagatttctgtagagtatatatcctttaaagcaaaagattttatcaataaaaagtttcatttgctctttttaaagacttgaaataagatagaaagtgatttgtatcattcagggatcattgacatacctagctgaagaaatagatatgggcttaaagatgatctttccaataagagattatagtctttctcacttggaaaattggtttgttgatctggaggggaatggggggctatttcatggtttctgaaggccaagattccctctgagtggatttatcgtttgagccacctgtgtacttagactcccactcactttcttcaaggagaatcctgctgtctatggatttagccaggtttaaaatatatttatagtaggaactaccaaacattatctcaagctgagctataagaaagcccatcaaagttaacttccaaggcattctgatagttatgccttgattctggatcttgattttcccacacttctgttttcctttttatgtggaaaaaaaaatcagaggaaaactcagtattcagaaagaaaaaatgtacaggaaaataccagcctggacaatgataggtaaaggaatgccaggaactctgccaactgctaccaggatgacagaatctagcttcagaatccagttgctggaggctttctcttaaaagagcttaatagaaccttcatgcattatcaacgctcatttcccaatgtctcctcaaatgaggaattaatgttaacagatcagagggacacccaaaactgactagatgagcttactgtgactgtcctccctttgtagctcatttataaactgtaaaactcgcagtaatatagctcctgaggttatatgcagcaatttacctcattttcttttctcactcataatatagtattaaaaagaaacaaagaaacaaaaaacaaacttctattcctgaatttagctggatttactttgcttcccctttgtgcttcccattccaccattgcgtcatttttcaaatactacaaattcagattagatgtcatgacaagtgatactataattaatttatttggtaaactgtgttgttagcaaaataaattgttgtagcaaagtcaaatgggatgctagaaagcacattggtttaagtaggtgttgggatcctaagttcagagttttagagctgttatttatttagtgacttagtttatacaaattgctttacctctccatgcttgatatgctgatatgcaaagtggatatgctgtttcagctaaattcaagtgttgttttggagattatttcatgtgtcagtttgcatttatttgtttttcttctgattcatttcagaatctttttgaagtggcttacagacacataaaatataaacagacaattaaaacaaaattaagtcaagacaaacactaaactaatagtgaagccaaattggctttcagttccaagtcaacacaaaaacacaaaaagaaaaactaaactggttacatgacctgagaggaacacatttgccctctctctatctctctttctctctctcttccttcctctctctctgtctctctgtcacacacacacacacacacacacacacacattcccacatacacacattagaccttcctataacaagtcattaagttgtctaaattagaaatgtggtcctcattgtgagctgctatagaaatgcagatatcttttctgtcatcttctcttaggaattgcaacaacatctagcttctcacaaaatcaggtaaagttgtgttcctctgccattcctctgctccagtgttgtaatatattttaatcaaaatgtatctaaaactatgaacttcaaaatacatagcttctcatatggtgacttcattatgtagtgtcaaaagagccgtatgccaaaaggccaattttaccatttctatgtggacaatgcttacttttctgggaaggtttgctccatcattctcccaagtatccagagataagactttttgatgaccaaactttacatagatgtcaccttataggaacaaatttccaaactcctattggccatgtggactctgtctgtacctagccttacacttctgctcctcactggccattagaaaagcaaatggagggagatggagaaagatagccaaacaaaagcctctactgatcatcctccttgcagaaccaccaaatgtaacacctatttacacaaaaaagagcccttcataagaagcagaaatcagatgagcaattatagtacctggttttaagttcatattactgaaaaaggcactgaagacagcaggaaagacagtcttgaattgcccatgccaaccctcccctgtcttatggcagctgcagtggggcatggaaacaaaatcttgtatgcataggggagggagagcacagtgattgtgggatgttgcattaaagcttagtcctttccttttacagtggaaagcaacaccagacagaaattggcaggtgcccatagaagcagcatttagaacagacctacccagaggggaatcgcccatcccaatggtcagaacgtgagttctggcaaaactcaccaccacaggctaatactctgggattctaaataaaattgaaaggcattctaggccacaaagactgcaactcctaagcaattcctagagctgttccaggctcagagcaagtgtatttgggggacacgtgaactagtaagacaccaagctggggtggccaaagatgttgcagctctgaaagagactcctttcttttttctgtagaaggagagggaagagtaaagaggactttgtcttgcaacttagatactacatcaggccacagtggggcagtggagtaaggcactgggcagtctttttttttttttttttttttttttttttttttttttttgagacaaggtctttctctgtcacctaggctggagtgcagtggcacaatcacctctcactgcaacttctgcctcctgggcctaggctcaagtgatccttccacctcaacctctcaagtagctcggacagcctgccccaagggcctgtgctggtggctgccatggggagactcctctgcttttggaaatgggagggaaagaccttgtcttgtgggttgggtgtcagctcagctgcaggttaatagagaaccaggtagattcaagaggtagggaggatcacaaaaacaaacaaacaaacaaacaaaacagaaattaataacaaaaaggcaggagtaaatccttacttatgaataataacattgaatgtagatggactaaactctccaatcgaaagacatagagtagacaaatggataaaaaacaagacctaatgatctgttgcccacaagaaatacactacacctgtaattaaacacatagactgaaaataaagggatagaaaagatatttcatgccaacggaaaccaaaaatgagcagtagctatacttacatcagaaaaagtagatttcaagacaaaagctattaaatgagtcaaagaagatcattagataatgataaaagggataattcatccagatgatatatcaactgcaaatatatatgtaccgaacactgaagcaccccaatatagaaaacaaatattattagaactaaagggagatacagaccccaatacaataatagctggagatttcaacaacacattttcagttttggacaggtcatccagtcaggaaattaataaagaaacatcagatttactcttcatgatagaacacatggacctaatagatatttacagatcatttcatctagcagctacagaatgcacattcttttcctcagcacatggattattctcaaggatagactatatgttaagccacaaaacaagtctggagacattcaaaaaatttgaaataatatcaggtaccttctctggccacaatggaataaaactatcaatagaaataaataacaagaggaatttttcaaactatacaagctcatggaaattaaacaatatgctcctgaatgaccagtgaatcaatggagaaattaagaagagaatttaaaaatctctttaaacaaatggtaatggaaacacaacataccaaaatctatgggatatagcgaagcagcactaagaggagagtttatagttctgagtgcctacatcaaaaaagtagaaaaacttcaaataaacaacctgatgatgcatcttgaagaactaggagaggaagagaaagccaaacccagaattaatagaagaaaagaagtaataaagactcacgaaaggaaagacttcacatgttctcacttatttgtgggaactgaaaattaaaacaattgaacaaatgtagatagaaaatagaaagatggttaacagaggctaggaagggtagtgagggtgtgtgtgtggcaaggagtgggattgcttaattggtacaaaaaataggaaaaacaaatgacacctagtattttagcacaacaggatgtctatagtcaataataatttaattgtatattttagagtaactgaaagagtataattggattttttgcaacacaaaagataaatgcttgaggaagtggataccctatttaccatgatgtaattatcatacattccatgcctatatcaaagtatttcatttaacatataactatatacatctactaagtacccacaaaaattaaaaatcaaaaatttaaaaattaattaaattgaaatgaagaaaataatacaaaaatcaatgaaccaaaaagtgagttctttgaaaagataaataaaattgacaaacttttagccaggctaactaaaaaaaatccaaataaataaaattagagatgaaaaaaggagacaatacaactgatactataaaattcaaaacatcattagaggctaatgttaggaactatataactatacacctataaattggaagacctagaagaaatgaataaattcctagacacatgcagcctatcaaaattgaaatatgaagaaatccaaaacctgaatagattaagtaaccagatcaaggccataagaaaaggcctcccaggaaagtaaaaccctcaactcaatggcttcattactgcattttacaaaacatttaaagaagaagtaatattgatcctactcaaactagttttgcaaaatagaggaggagagaatactctcatactcattctgtgatgccagtattaccctgataccaaagccaggcaaagacatatcaaaaaaaagaaaactacagaccaatatccctgatcaacattaatgtcaaaatcctcaacaaaatactcgcaaacaatacactcaacaatacattagaaagatcattcatcatcaccaagtgggatttatctcagggatgcaaggatagttcaatgtatgcaaatcaatcaatatgaaacatcatataaacagaatgaaggacaaagcctatatgatcatttcaatcgatgctgaaaaaagcatttgataaaattcaatatcactttatggtaaaaaacataaaaaaagctgggtgtagaaagaatgtacctcaacacaataaaagccatatacaacaacaaaaaaaaaaacaggaaatgtcgtactgaatggggaaaaactgaaagcctttcctctaagatctgaaacatgataaggatgcgcactttcactactgtcattcaatatagtactggaagtcctatctagagcaatcagaaaagagaaagaaatggcatccaaattggaagggaaggagtcaagttatccttgtttgcatattatatgattttatatttcaaaaaacccaaagagtctaccaaaaactattagagataataaacaaatttagtaaagttgcaggatacaaagtcaacatataaaaatcattaatatttctatatgccaacaacaaacaatctgaaaaagaaaccaaacagtaattccagttataatagctacaaataaaattaaatgcctagaaattaacataaggaagtgaaagatctctacaatgaaaactataaaacattgatgaaagaaattgaagatgaccctaacaaatggaaagatattccatgttcatggattggaagaatcgatattgtttaaatatctatattttccaaagcaatctatagattcaaagtgatctgtgtcaaaataccaatgacaatattcatagaaatagaaaaaaaaaatcctaaaatgtgtatggaacaacaaaagactcagaatagccaaagctgtcctgagcaaaaagaataaaactggaggaatcacattacctgacttcaaattaaactacagagctatagtaaccaaaacagcatggtgctcacataaaaacagacacatagaccaatagaacaaaatagacaactcagaaacaaatccatacacctacagtgaaatccttgataacacagctgccaagaatgtacattggggaaaaactatctcttcaataaatggtgctgggaaaactggctatccataggcagaagaataaaactagattcctatctctcacatatacaaatatcaaatgcaaatggattgaagacttaaacctaagacctcaaactatgaaactactacaagaaaacattggggaaaccctctgggacattggtctgggcaaagatttcttgaataataccccacaagtagaggcaaccaaagcaaaaatggacaaatggtattacatgaagttaaatgattcagtacagcaaaagaaacaatcaacaaaatgaagagacaactcacagaatgaaaaaaagaaaaatatttgcaaactaaccatctcacaaatgattaataactagaaaaaagagctcaaacaactctataagaaaaaaaatccaatagtccaatttaaaaatgggtaaaagatatgaataaacatttatcaaaagacaaaatacaaagacatccattatgagagaaatgtgaatgaaagctgcaatgagatattatctcacacaagttaaatggcttttatctaaaagacaggtaatcacaaatgctagtaaggatgtggagaaaagggaaccatcctgaactgttggtgggaatgtaaagtagtatgatcactatggagagcagtgtggaggtttctctaaaataatagaagtacccactgctaggtgtatacccaaaagtaatcaggatatggaggagatatttgcactcttatgtttattgcattactcttcaaatagccaagattgggaagcaacctatgtgtcccatcagcagacaaaaatggataaagaaaatttggtacatgcacaaaatggagtattattcagccataaaaaagagtgagacgatgtcatttgcaacaacaggaatggaactggaggtcattaggttaaatgaaatgtcaggcacagaaaaacaaacttcacatgttctcatttatctgtgaaagttaaaaatcaaaacaaatgaactcatgaaaccacagagtagaattatggttaccagagtctgggaagggtagtgggaggtggggagggaagtggagatggctaatgcatacaaaaaaatagaaataatggataagatctggtatttgatggaaaaacagggtgactacagtcaataataatttcattatacatttgaagtaactaaagactgtaacacaagaaagggttaaatacttgaggtaaatggatatcacacttagcatgatgtgactattatacactgtatgcctgtatcaacatatctcatgttcctcataaatatatagatctattatgtactgataaaaattaaaaagaaagagtggaagacacagaagataaaaccatttgatgatagaggcagagattggagtgatgcatctataagtcaaggaacaccaagcacagtgacagccccagaacctggagagaggcatgggacagattattcttccagagcttgctgaaagaccagccctggggaaatgctgatttctgatgtctggcttctgtaactgtgtgatatggtttggctgtgtccccatccaaatctgaacttgaattgtatctcccagaattcccacgtgttgtgggaaggacctagggggaagtaattgaatcatgggagtaggtctttctcatgctattcttgtgatagtgaataagtgtcacgagatctgatgggtttatcaggtgtttctgcttttgcttcttcctcatcctttcttgctgccaccatgtaagaagtgcctttcaccctctgccatgattgtaagacctccccagccatgtgaaactgtaagtccaattaaacttctttttgttcccagtttcaggcatgtctttatcagcattgtgaaaatgaaatactacagtaaatttataccagtagagtggggtgctgctgaaaagataccccaaaatgtggaactgactttggaactgggtaacaggaagaggttggaatgatttcgagggctcagaagaagacaggaaaatgtgggaaagtttagaacttcctagagacttgttgaatgtttttgaccaaaatgctgataatgatatgaaaagtaaggtccaggctgaagcagtctcagatggagatgaagaacctctcggaagctagagtaaaggtgactcttgctatgttttagcaaataaactggcagcattttgcccctgccctagagatctgtggaactttgaacttgaaagagatgatttagggtatccagtggaaggaatttctaagcagcaaagcattcaagaggtgacttgggtactgttaaatgcattcagttttataagggaagtagagcataaaaatttggaaaatttgcatcctatgtgataaaaaataaaagcccatttttctggggagaaattcaagctggctgcagaaatttgcataaatagcaaggagcctaatcttactccccaagattatggggaaaatgttcaggccatgtcagagaccttcaaggcagcccttccatcacaggcccagatgcccaggaggaaaaaatgatttcatgggcaaggcccaggggccccatgctgtatgaagcccagggatttggtgtcctgtgtcccagcctctccagccatggctgaaaggggtcaatgtacagttcaggctgtggcttcagagggtggaagcccaaaaccttggcagcttccatgtgctgttgagcctgcaggggcacagaagtcaagaattgaggtttgggaagctccacctagatttcagaagatgtttggaaatgcctggatgcccaggcaaaaattgctgcatgggtggggctttcatggagaacctctgctaggacaatgtggaagggaaatgtagggtcagagccctcacacagagtccctactggggcactgcctagtggagctgtgagaagaagcccaccatctgtcagaccccagaatggtagatccgcttgcaccatgcacctagaaaagccacagacactcaatgccagcctgtgaaagcagacaggagggaggctgtaccatgcaaagccacaaggctggagctgcccaagaccatgggaacccacctcttgcatcagcatgacctggatgtgagacgtggagtcaaaggtgatcattttggagctttcaattagactgtcccactggatttctgacttgcatgggccctgtaacccctttattttggccaatttctcccatttggaatggctgtatttacccaatacccatacccctattgtatctaggaagtaactagctttcttttgacttcacaggctcataggtggaagggacttgccttgtcttagataagactttggactgtggacttttaggttaatgctgaaattagttaagactttgggggaatgttgggaaggcatgattggttttaaaatgtgaggacatgagatttggtggggccaggggtggaaatacattgtttggctgtgtccacatccaaatctcatcttgaattgtatctcccagaattcccacatgttgtggatgggacctagtgggaggtgattgaatcattgttgccggtttttctcatgctattctcatgatagtgaataagtctcacaagatctaatgggtttatcaggggtttccacttttgcttcttcctctttctctgttgctgctgccatgtaagaagtgtcttttcgccctctgccatgattatgagacctccccagccatgtggaactgtaagtcaaattaacctccttttcttcccagtctcgggtatgtctttatcagcggcataaaaacggactaatacactgttaaagaataaagttatgttgttttgttgttaaaagaggtggggtcggggaaagaagaggaaaagcaaatgaaatcaaaaggagtaagtaaaatgtagaaagtaagttcagaaggaagtagtagaagattgttttttgaaaagaaggaagggagacacaaaggaaaggaaggaaaaaaaagaatagaaaaaaagaagaaagtgatatcaactaagtacaaatttatgaacctgagtcatacaactgagaaattaaatctaaaaaaagacgtcaacataaaatcatttctacaaatctaagatttaaactaagtagaattaatatttgttaatcaagcataaaattaaaatcagtcacttaataaaaataaaaacagtttataattttaaaaggattaaaaacttttaaacataaaaataagaaattgtgactattaaaaagtcacttttaaaaaaacaatgaagaggtaatagtaaaagcataaatctttcatactggttattcagtccaatgatctattaattttatcttgcactctggtaataatacatgaataaaacacaatctattatccctattaatagcaacaatagcaacttcccatctacaaatcaaaggggaaatgctaatctttgctcttaagaaatgctaactaagaaactaagaagctaggtaaaactcaaattttgagtgttttcatttaaaatgagcttttaattaacatactttgacttgggagtgaaaagtcatacaaaaagcaagtggctatgattctgcattaatctaacaaactagcttttgggtgttctatttagttttttaaaatatctcttctttctcagaccaatcacatatttttactatgttttacataattctatttaaatatgtttagcattttgtgttattaagtctaaattctaaaatttctaaattttataatttctaaatcaatagagcaaaggaaaattttgacagaggaacaagtaacgtaagcattgtttttgtttcttttgtcaaaattggttcaccttataagtcgttattctctcaggtacagtcctatcaaaatttaacaaaacctaaaaaatatttcatttatactgacattaaaaattttcctaaggcggcattagcattcgttgaattttccattgattttttaacattgacaattcaaagactaacttaatttttaatgtatcttctcagttaataaaaacaccattcctgaaattggaaggaataaaggaggaaacaaaagagtacatataagattgattaattttttaggaaaggttaaatgctcacccagacttggatgatggctgaaatgtttgagttgtttattcggaaggttttgaaaaggaataatatttgccttaatcgctaggtgagaaatggttcttgaatcatgaaaagagatataagaaaacatcagtttccttcaataatcattcccagtgaaagtacttcctaatatatttgtattaatacgtttaaatatatatgtgtctgcttgaagggtttgcagtaaagtctaaggaatgaccacaatgtagactagcatctaagctacacatttaagttaaattctaatttacaattcaaaaaaaaaatcactgaaaatttaagtaatctcttatgtaggagaggaaatattgagggaagaataaaatgcatgcacataagtgttaaacactgaaattatctaaatcaaacttgtgaagttcaattagtattcagctactgaaaataagattattacacctttttaacacacttgcttccaatttttaaagaaatatattttattgttttaggcaaaattgcatatccttaaagaatacaaataatactgaaaattaaagatgaaaattcaaattctaccactctcaaactctcatttttagcattagctggacactatctcacccaagtctcaatgtcacaattcacctctctatgcaaatatacagatagaacttccatctgtatcttctaacttcttagatagatgtttggatggatagctggatggaaataatttataataggggaaccatagtatagaagtttttttcaatcaaatgtgtcaactttagtttcatttgaacttcatagcagaaaataaaccaataagcttaaagaaaaagtgagaagataatataaaaatcttttacaatagaatgattttttaaatcaccttcttcaattttaactttattggattcctgtttaaaatatgtgtgatattttacacatatttaaaatatgtgtaatagtggtattaccacttttacatctcttcattttaataaggcatgttatcgtttacattgctcatgtttaaaacattcacattttgttctgtaacctcaggtcccatagtttttttattaatagttatgtatataactggattcagtgtgcctcaccatttcattttaccatggattctcgattgctctgtgttttttttaatttatcttttaattggacatacttgatgctcaagcttttttacttttttactcaagaagggcacctgagtatagttatcttaattcattcttttttgatagcacctatagcctttatctctgaataacatcttgaatggtgatagaattattgggttacatttttgttactttagagggtgcagacgttgttttatcacctcttgcattgtatgttggaaatgtctgcagctaccctcatgttttctctcctgttaggtgacactttgtgggagggttgtggggatctgaatagtcaataggttgagtaggccatgtcttattgttgactatgtcaagtttacttgaaattgtatacttctgatgttcagattaagttacttatttgggaaaataatattatagattcaacatgcatcttctcctacgtttgttgagtctctacttcacagacatgaattattgttatgctgtattacctagtctcacttccatatctacttgtttttctttaatcattttaatcctcttcatttacaatgaagcagcattcattatataaacctcaacatttttaacaatatcacttatttgatttctagtcaagtcaattttgttttcactatttctgaattatatattgttacataatggtggaatattgatcctcaacttgtgttcataagtctgatagacattttaatcatgtgtacttgtttctcacatttgagctcatttttgaagaatttacattctcaatgtgttatttaataatatgaaataattgtgagtaattccattctgttccatcagttacttttcttccattttggacacttggctttgcttcctttctttgatcattttgggagttctataaagttctatctgctctgataaaacatgggtaacgtgtttagcctcttcctactatacctgataccagttaatttttctttcaaggctgcagtttgagctgcatgcatattttctttctcttctctctttgcctccttctgtctctctctctttctctctgtttctctgcctctctagctgtctttctctctagttttcaaatattatagtatcgtctttccttttctggacactgttggtaatatttttctttttacatgacaatttttgctcattttcctaggtatcacttaggaaaattctaatactatgaagatattttagctattttaaccaagaagtaactatttaatctttaaagttctgcatatacattatcaaatgattatccaaacatcacatgtaatttttaatgatcattacattattgagataattatgctgcataaactatggcatttaggaatagagagagatttgttaaatgatacaaaattaccctgatctgatcactacaaattataaatatcaaaacatcattatttaccccatgaatatgtacaagtcttatttgtaaaatttaaaagaatcctacggtttttcaatctatcattttaaatttaatctttcaatctttagtgatagaaagtttatcatattgtatcgggatattctttaaatatattcctgaactacttttcttgtgattatttcaagtaggtaaaatgacttttggaaagtttcaggaggataaataaaagttacactaaagatatagatttcacggagacggtgatatttctgatattcttgactgattcatgaaatcataggcaatttatttgcattgtgcaatgagccaagttttattatatgagaaagacacaaaaaaagttttaaatctctttatatattattcatttcaacgttgtttactataacctattgtaggtttataagtccttgcactttattccagttgttactatgcttcctcccaaatacatttacaatttatatttcctctttctttgtagaatttagatattaaaaattatttatcaaataccacatacttacaaatacgttttaatcatgagtgtccagatttatccatttatcttaatgtagccttgaatgctgtataaaaaaagatttatgcttcatgtcttttattcttaattagtaagggctccacagatgaaagcatttttgtaattgggctcagaagtgtttaaattgctaaattagcatatattgaatacattaagtaacattgaaaaattataaatacatggtaatagacctctaacaaaaatgctcaaattattttatatgattagtacaaaactgtattattatacacacaataacttgtatatcgttaaagagtatagacaaacactttagctatagctgaaaagctcatagaggccacctgaaattgttttatcccagaggtaaacaaatgtattttggcttcattaaacattttgatatttaaaaaaagctccaccatttgtgccaacactatcagtggcatctttttaataggatccttctaggaggaagaaaaaagctatataagcatattctatctttcttataaatgctcaacattttttcttttaaaaaattgtagtcttcagtgctgcacactgtaacaatgcaggctgtcaaagactagataactaatttagttggaaatgaattaatgctgtcctcatctcacattaattttgttagaattttgttttaagtagaaaatattggctctgagtatggaataatgagttacttctttagactcaatagactaaaatgccaggaatggaaacaatgtcacctttgtgactagaatactaaatgatgagccatatatactgctcagcagcaaaaatgtcctcagtgcagacttgatccatttgaccaaggtcagcatttaatttcatacctgaaatatcatatagtttacattgtatgtattctagagcctagattttattccatgaaattctcattcattagtgtctgtaatttatttttacccatgagtaaagctttaatcttttatgcaatcatgacaagccaaagcagaacaaattatgatatatctttgtacaataatatctgacagaaattgcccacagtaaatataaagaaaaatgcattcagaaaaaaccaattaacatcttataattgagtaaagatttcataacctgtattgttttcaaaagattttaaagcttgatacttaataaccataagttgaaataaatgaatggtttcattcattttgtggcaaaccatttaataatgcttttcatcctgtagtgattcttagctgtctaggtaaaaacaggttttcattactggagaaaatatgaaatctgaaatgttattacacagagaagaaaacatgtaggtattgagaaaacaattagaattttaactatttctgtccatattttgattaagaatataactgtataggatatattatacatagctctctaaggggtgcaacattatttatctgctcaatctgggaatattttcagaatttgtccatttgaaatctatctgtttaaaatgtctttggtagtaactgaagaagttgttctaacttactcagacttgcaaaaaaaaagtaaaacctaaaaagatgtgagaatgattgaaatcacatgtcaaatgtatggtttacaatttattagaaagttcacttaaacatgaataagggtaacatagattatcaatattatggttttaattttacttccaatctttcactacaaaggaagcactaaaatccttaaccatgcatgtgcgaagggaattttctttgacccagtcctgtacagatcttttattaatcatcttaattcttaattctgcactgcctgctcatttcttgctgtgattgttttgtagtgatctatataaaaatggctactacctcctatccagacacagtctcaggattttgtgtcgttgtttttgtcttttgttgatcaaaggctctatgtgcacaggctccatccactctctttctaaagcatttgtcatttccttccattaggtaatctctgcagttctctggctatggctgttaaatatctggaattagtttatctatattgagtttgcctcattgcaggttcaagagcttggctttactgttaaataggaagaataacatcaagagatttattatatagcatggtttctataattaataatgatatattgtattttagagaaatgctaagaaggtggatgtattctcgccacaaaaatgataactatgtgagataatgtacttgttaattagctagatttaaccattctacaatgtatatgtactttcaaatatcatgtaatacacaataaatagatgcgattgtatatataaattttaaaaatctaaaaaatttttttttggaaaaaagcttgtcttttttttggagctttgctagttggtgcaaacaagtgaccagcctataaaaaactgtcctcatcttagcaaagggtttggccatagagaaaagaaatgtcctccctgtgccagcattttacagatttagtgtctgaacttctagatcttatccactgaatacctcactctaatcattctctgcacctctgactctagggcacagatttctctctgtgttttccttgccttgcctttctgccttgatacctgatgccacagtctatccaccttggaccccagctgcagacttcagagtctctcccagcattgcctttatctctctgggatgctggccaaagatattcatggagatcctatggagtattactactgctgcttaatcctgccccaaaaacccatccctgcacctgctcctacatgcagcttcttaccactccttgtctttgcctaaggagtcagacctaggcacgacagcttttatcaggaaggaacctgcatccaaactgacttgaaaagagcttcttccaggcctaagtcttttgctgcattttgcattattacattgtccctttatgaaaatcaagtattctgttttactcttttttgcctgtttcttagtagatatcaactccaaatatcttttaatatctacagcaatggtgattgtttcccaggccttttaaagacaataaaaactctgatgttgaatacttgcaaatagcaaatatagcctcaagttatagtgtcttcaaatagtttcctgtccactgtccttatgacagtctaccaagacatgagctttgtgatccataaaattaatttaaacactttaggggaaaaaactaatagcattaatttaatttaatttaatttaatgtaatcatgtgttgacataatttctaacaatgaatttctaggtaaaatatttatactgttatataatatatgtgatttattaaaatatatataacactaaaatatatcctttgatattattaaatattttaatacctcactttgcaccagtattaaacaaaatcatttttgtaacacatgttagatgattaaaaaactttactcttcaaagaacaatagaaaatcattaaattataactcatagatttaattgtattgcccaatattaagaatgtactggattagtaataattctagtccagggggcactgactcatgcctgtaatcctagcatttcagaaggccacggcaggaagatcgcttgagtccaggagttcgaggtcagcctgggcaacaatagtgagacccccatctctacaaaaattttctttaaaaattaggcagtgatatggtttggctctgtgaccccacccaaatctcatcttgcagctcccataattcccagaacaaggtgagagatggttgaatcatgggggtgggtctttcccatgctgttctcatgatagtgaatgggtcttacaagatctgatgtttttaaaaatgggagtagacctgcataagctttcttcacctgctgccatccacataagttgagacttgctcctccttgccttccaccatgattgtgaggcttccccagccacatgggactgtgaattctccattaaccctctttcttttgtaaattgcccagtctcaggtatgtctttatcagcagtgtgaaaacggactaatacagtaaattggtaccagtagagtggggcattggtgaaaagatacctgaaaatgtggaagtgactttggaactgggtaacaggcataggtttgaacagttgggaggactcagaaaatgagaagaggttggaaagtttggaactccctagagacttgttgaatgtttttgaccaaaattctgatagttatatgaacaatagggtccaggttgaggtggtctcaggtggagatgcagaactttttgggaactggagcaaaggtgactcttgttatgtttcagcaaatagactggtggcactttgctcctgccctagagatttatggaactttgaacttgagagagataatttagaatacctggcagaagaaatttctaaacagcaaagcattcaataggtgacttggaggctgttaaatgcattcagttttaaaagggaaacagcgtatttgcagcctatgtgatagaaaataaaatcccattttctggggagaaattcaagctagctgcagaaattagcataagtaatgaggagctgaatgttaatccccaaaacaatggggaaaatgtctccagggcatgtcagaggtcttgacagcagcccttcccatcacaggcccagaggcctaggaggaaaagatgatttcatgggccaggccctgggctctcctgctctgtgcagactgcagacttggtatcctgcattccagaagctccagccatgcctaaaagaagccaaggtacagcttgggttttggcttcaaagggtggaagtccaaggtattggcagcttccatggggtgttgagcctgcaagggcacagaagtcaactattgaggttggggaacctccacctagatttcaaaagatgtatggaaatgccggatgaccaggcagaagtttgctgcattgggggcccctcatggagaacctctgctagggcagtgtggaagggaaatgtggggttggagcccccacacagagtccctactgtagcactgcctagtggagctgtgagaagagggccactgtcctccagacccctgaatggtagatccactgacagcttgcattgtgcacctgaaaaagctgcagacactcaatgccaacccatgagagcagctgggagggaggctataccctgcaaaaccacaggagcagactgcccaagactatgtgaacctgcctcttgcatcagtttgacctgaatgtaagacatggagtcaaaggtgatcattttggagctttaagagttgactgtcctgctggatttcatacttgcatgggccctgtaatccctttgttttggccaatgtctcccatttggaatggctgcatttaggcaatgtctctgtacctgcattgtatctaggaagtaactaattttctttttattttacagactcataggcagaagggacttgtctcagatgagactttggactgtggactttttgaattaatgctgaaatgagctgagactttgggggactgttgggaaggcatgattggttttgaaatgtgaagatgtgagatttgggaggagccaggggcagaattatatgatctgactctgtgtccccacccaaatctcatcttgtagctcccataatttccacttgttgtgggagagacccagtgggagatgattgaattatgtgggtgggtctttcttgtgctattctcatgatacttaatgggtctcatgagatctgatggttttaaaaatgggagttaccctgcaaaagctctctgcctcctgccatccatataagatgtgacttgctcctccttgccttccaccatgattgtgaggcttcctcatccatgttgaactgtgagttctccattaaccctcttttgtaaattgccaagtttttggtatgtctttatcagcaatgtgaaaatggactaatacagtcaggcatgatgtttcatacctgcagtcccagctatgtgaaagctaaggtggaagatttgctcaaaacctggccaggcactgtggctcacgcctgtaatcccagcactttgggaggccaaggcgggtggatcacaaggtcaggagttcaagatcagtctggccaacatagagaaaccccatctctactgaaaatacaaaaaattagccaggtgtggtggtgtgtgcctgtaatcccagctactcgagaggctaaggcaggagaattgtgtgaactcaggaggtggaggttgcagtgagctgagatggagccattgcactttagcccaggtgacagtgcaacactccaaaaaaaaaaaaaaaacacctgaggttgaggctgcagtgagccatgatcatgtcactgcactccagactgagtgacagagtgagaccctgactcaaaaaaaaaaaaaaaaaaacacagcataaatacaattttacagtattcacccaactaaaaagtacatcagggaacacagccatttagagccattacctttgataagagaatggcttggggcttgcaccctctgaagcaatagcctgagctctacattgacccctttcagctgcagatgggacacagggcatcaagtccctagactgcacacagtgtgggaggccctgggcctggccaacaaaaccattgttttctcctgaccctttgggcctgtaatggttggggctgctgtgaagatctctcacatgcccttgagacattttcctcattgttttggagattagcatttggctccttattacttatgcaaatttatgtagccagcttgaatttctccccagaaaatgggattttattttctactacatcatcaagctgtaagtttgcaaacttttgtgctctgtcaccctttgaatgccttgctgattagaattttcttccaccagatatactaaattatctttctcaagttccaagttccacagatctctaggtcagggcaatatgctgccagtctctttgtatagcaagcatgatctttactccagttcccaacaaattccccatctccatctgagaccacctcagcctgttattgtccatatcactatcagcattttggtcaaagtaattcaacaaatctctagggagtttcaaactttcccacatcttcctgtcttctgagtcctctgaactgttccaacctctgcctgttacccagttccaaagtctcatccacatttttgggtatcttttcagcaacaccccactcctggtaccaatttactgtattcgtctgttctcacactgctagtaaacatgtacctgagactgggtaatttataaagaaaagtttaatggacttacactttgacattgcttgagaggcctcacaattatggctaaagacaaaggaatagcaaagggatgtcttacatggtggcaggcaagagagaacttgtgtaggggacctcccctttataaaaccttcagatcttgtgagacttatttgctaccatgagaacagcatgggaaagacccacccctaggattcaattatctcccaccaggtccctcccatgacacatgggaattatgggagctacaattcaagatgagatttggatggggacacagccaaaccatatcagtgtttattgagtagctatgataggccaataattctcaaacattttggtctcataaattattgaggagccccaatattttgttgtttacatagataatatctattaatagaaatgcaattgagaaaatatagaaatatgaaataattcatttaaaaataaaataattattccataacataatagtaactataggtattttatgaaaaataactatgtatattttccaaaataaaatatataatgagaatactggcattgttttacatttttgcaaatacctttagtgtctgtttatatggaagacagatatatttctgtatctgcttctgtattcagtatgttgtgttatgctgttctatatatgcataaaaagaaaatcaagcctcacacagatatatatatagttcaaaaggggaagaatctttattttattttattttactttttatggattcaggggttacatgtgcagatttgttacatggatatattgtccaatagtgacatctgggcttctagtgtacccatcacttgaataatgaatattgtacccaatagttgatttttcaactctaatactcttcccactctcccattctggagccccagtgtatattacttccctctctaagtacatgtgttctcattcttttgctcccacttataaatgaggataaatgataattgatttcctgtttctgaattatttcacttaggataatggcctcccactccatccatgttgctgcaaaagccatgatttcattcttttttatggctacatagtattccatggtgtataccatatatatatgccacatattctttatccagtctttcactgatagacacttaggttgatttcatgactttgctattgtgtattgtgctgctataaacataagagtgcaagtgtctttttgatatgacaattttttttcctgtggggagatacccagcagtgggattcctgggtcaaatggtagttctattattctctgagaaatctctatactgttttccaaagaacttgtactgatatatagcaaaagggaagagttttttaaatatgctttttttttaagagcagtggatattattggggctactctaaaactcaaccagtggtagtttgttaaaagttagttacaaagtggaatatgaagccatattgacacacatttcagactcattgcatttaaactcatcgatctatcttgcaccacagatggatcttatttttcacctcatggaccctggagagagtcttgaatttctcaagagattcctgggccactgtctgagaaccactgtgctagtcattgcttttgcaaaacaaaacacagcatgaaataaaccctattatcctcagtttgcagatatgaattccactctagtagagtggatatttcctggcctctataatccacctggcctaggtttgcaacccaacttcactatttaccatctgtctaattaaaatattctgggagggcacggtggctcacgcctgtgatcccagcactttgggaggccgaggcaggcagatcacaaggtcaggagactgagaccacggtgaaaccccgtctctactaaaaatacaaaaaaattagccgggcgtggtggcgggcacctgtagtcccagctgctcgggaggtggaggcaggagaatggcgtgaacccgggaggtggagcttgcagtgagccgagatcgcgccactgcactccagcctgggcaacagagcgagactccatctccaaaaaaaaaataaataaataaattctacacacttgtcagtatacaacagttatgcaaatatgcaaatctgtactattttattttcaagagaccatagcaaaattaactgccttcagtttccaaattgtaggttattctttttggatggagtcctgtcttcaatgaccattagtctaacataattgttagaattaagtaatcttggagtcaaatgttatctgttcaaatttatgtcattttctgtctgtgcaaccatagcatgctacttacctctctgtgcttcagtgtcctcatgaactagataaagttgtgagaattaaatgggggtaatatatgcaaagtgcttagaacagtgtctgacattttataagagctagattagtttatggtatttttaaccattattgtcattatcattactatctatcctactgttcttgcccactcttgcttctcgggagcaagtcagacactgtcctgtcctggatcccaacttcagagctcttatttcaaactttccaactcatcctgtggaaactttcctcactatgtttaaagaggaggagggacccccccccccaccccaattcagcaatgctttctccttatgggcataaagactcaccattactcctttcaaagaagtcttcacaaacctcctcttttccaaaatctgaccatctttgatatctttgatgtagtcaaaagttgtgacattaatttttgttattgtttcttcataaaatctgtctatggggagatgtctctcactcacattggtatctgcaatctatctgacctacaccatgggtgcaccagaatgggaagtgtttcatccttaatgtttcattacacaagcaataacagttcaggaggaagtgcttatgtacagcaagtggtacagactcttcacaaacatactctcctgcaatcttcatagtgattttgtgaagaaggtactatattttacagagttggggtcagggggaccaagtctcagggagattaacttgccacagatcttaccaagtatcaaaatgtgacaatgtccttagctaagtttacttagttttatgtattaaatttcttttcccttattttcttcacttttacttttagtttaaaggtctgatatatatgagagattgttcataaaacaatgatccctgcttccctttcttttccactaaggctatcacttttacttcttttggatgattgttttagcatttatcttcttcatattacatatttctattgcttcctcttgattaccagttttaataatggtttcttaaattcccaccacaaatgatcaagatttttgtctcttttctttcccttccccttccaattgtcgtcaatagaattgagttataactttggtataggtaagtgctaagcatttgcattactaacattatgaaaatgctattcacagctatgattatttttccttttatgtactactttttgttttccctgaagttaataattactatattttttgtttctttagttttgtgcatacttaccaatatttcagtcccaaagtgtttgccacttatctaaatgttctcataagacattctatatgtatgtgtaaataaaggagtagtttccttttcattaattttagcactctatttgccatctatttggattttcagagatactttatgttattcaaattcctgagtacagacaaaagaaatggtcaaatatattagagaaattcttagtaaagttaccatatatatgaagtaatatggaccatagtgtttctcatcacatattgactgcaattaagtttaagttaattgacaatactttagcaattataataagataaattataatgtgtttggggtaaaactgatacattttattaaaataatcatttagtatgattttaataaataatttattaaaatatcatttattatgaatcatacttcttgatattcaataaaatttacaaatcctttttaaatgatatccaatcagtttgcaaactcacacattttgaaaaactgtatgtccaagtacagtacataaaaggcatttattgatgaatacacttaaaaatatacatatgaacacactaaaattaaactctcagcttttagactacttagagaatggcttttattggatagctaagttttccaaatggctgatgattattgcctgtaagctcagaaatcagccttacttaggctctctcaatatccgttacattaaatcatgcctttcttaaaaggtcatacccttttttaaaaacacctaatgaattgcaattaatatcccggggatatttgtgggataaagcgataagtaaatggcatatgcattatactaaattattgcatttattctagatctctctgctattggagttgtgtctttttcctaattagattttctttcagggtaccaaagatcattataattcagtatttatacccctatcaattcttcttttttataatttatttcttctcttcaattacaggctttataccatcttatcaaaattatttgatcagggaaaaaacaaatatttcagatatgatgcagtcttatatgaataaagttcaccaagtttagtgcatggatttgtaatacttattggactgcccagaatatattttacttaatttcttgatatggctatatctatgcacagttaagttatggcacttatagttgccatataagtgatgtgttagcaactgctagttctaataatcccctgtatatcctctcctgtaataaaggaactttcattttgagctgaggtcacggtggccaggaagttgcagcaaattgactaagttctgggcaatgagttggaggaaaagtgtgccattttcaggccatagtcttaaaggaagaagtgtagtttttctgctcctctctaaaacctgttgcttggatctcagacattcttggataggaagagaatgagagccacaccctagggatgatggagcagaaagctggcaacggagtcactgaactgaagacaaaataaacgactccttttgtgtaaccccctgttatttggaggtctatgttatgtttctgctaattgatactaattactacaagaaaatagctaattgtgtgaaaacagcatctcctttgctcaagttactggccagttcatttgttctgggagctcctgggttgagctaaaatccctagtatattaatcccacctgaaaattctggggcttgaagcattagtgttttctgaagatagttggttgtctctaggttattaatttgtaagacattataaatgtagcaagtagtatctgaatagattgttgattacagcagggccatttttctcagtcttctaaggtttacactccacctgaaagactatactatatctcttaaattctcgttgttttgacctgttgaagaatttgaaggaatgatgaaattgcctgctttctatactgaaggctaactcttggtctgcaaatttatttgtatctctggttctagcttcctcttgtccagacatatattcaaaaatataataaaataaataccaacagaaacctgagtcttgtttcacccccagtttatgaggagtttcaaaacatattttgctcatcctcagaccctctcctatcccccattaatattttggatataatatacattttttttctgtgattttgataatgaaaagtccagttctgataaaaatttaatcccaattgattaaaattacattttctcttttttcccaagcacaaacttatccaaggctgagggatctgaagttataagggaagggaaggatctgtctttcttgcctcacctctctcttcagggttaccttctctgcaaggtgaagaagaaatcctgattctctcatggggtacataggtgcatgctttgaagggtcctgtgggatcttcctgctcagttacctagtgtgaaagttcaagatcatactaaaacattagccctcagccatcttcagccctcatcatgggtggaacactccatgctgtaactgcaggggtccctttatctggtggacagctcttttgggtggactatcagcagaatgattcaagttctccattctcaaaattctcatggccatggaaactcattcattttcctgtactgaatgctgggtatgtgtgtggtttagtcctgcaccttctgtctaccttcctgctgtctctctgcaattccctttttgctcagagacctaagccaaatcagtaaaactattacccaagcagatatccaatgaagcaacagaacaatagccttcttcctcctttccaccatggccaggagaagaaattgcgtcttaccagtaacaaaattttcacaagacatatgattcttacactacctctgtttttcacccatatatttgctagacagagatcagagtggttctgtaatctcttgagactcagagaacaatgagggagggatctgatcccaattatgggtgcctcacttcagaaggtgggttacttaaaacttctttgtgtcagaatttggcactaagtcccactcagcaagtcacatggtttggctctgtgtccccacccaaatctcatgtcaaactgtaatccccacatgtctagggagggacctggtaggaggtgactggatcatggggccagtttctcccctcctgttctcatgatagtgagtgagttctcaatgagatatgatggttcaaaagtgtgtggcaattccccccttgctccctttctttctcctgctgccatgtaagacatgccttgcttccccttcaccttctgccatgattgctagtttcctgaggcctctccagccatgcagaacttagcactttttctttataaattacccagtctcagttagtgctttatagcagtgtgaaaatggattaatacagaaaagtggtaccacgagagtgggtcactgctataaagatacctcaaaatgtggaagcgactttggaactggataacaggaagagtttggaacagtttggagggctcagaagaagaaaggaagatgagtgaaagtttggaatttcctagagacttgttgaatggttttgaccaaaatgctaataatggtatggacaatgaagtccagactgagatagtctcagatggagattaggaatttattgggaactggagcaaaggtcactcttgctttgctttagcaaaaagattggcagcgttgtctctgctctagggatctgtggaactttgaacttacaggagatgatttagagtatcgggcaggagaaacttccaagtaaaaaagcattcaagatgtaatatggctgctcctaatagtatatagtcttatgcattcacaaagagatggtctgaaattggaacttatgttcaaaagcagagtataaaagtttgaaaaatttgcagactgaccatgtggtagaaaagaaaaacctattttatggggagaaattcaagccagctggagaaatttgcataagtaaagaggagccaaatgttaagacaatgggaaaaatgtctccagggcatttcagagctcttcatggcagctcttcccatcacagacctggaggcctaggaaggaaaaatggttttgtaggctagtcccagggtgctgcttctctgtgcagtctcaggacatggcaccctgcatcctagctgctccagcttcagccatggctaaaagggggaaggtacagctcaggctgtggcttcagggggttccagccccatgccttggtggcttccatgtggtgttgagcctgctggtgcacagaaggcaagagtttaggaaacttcacttagatttcagaggatgtatggaaacacctggatatccaggcagatgtctgcttcaggagtggagccctcatggagaacctctactagggcaatgtagagaggaaatgtggggttggagcccccacacagagtcccactgtggcactgcatagtggagctatacaaagaagccaccattctccagaccccagaatggtaggtccacagacagtttgtactgtgctcctggaaaagccacagacactcaacacagcccatgaaagcagccgggagggaggctgtagcctgcaaagccacaggggtggagctgcccaaggctttgggaggccaatctttgtatccgcatgtcctgtatgtgagacatgacgtcaaaggagattattttggagctttaagatttaatgactgtcctgctgggtttcagacttgcaaggggcctgtagaccattgcttttggccaatttctcccttttgcaatggcagcatttacccagcgcctgtactcccactgtttcttggaagtaactaacttgcttttgattttacaggctcataggccaaaaggacttgccttgtctcagatgagactttggacttttgggttaatgctaggatgagttaagactataagggactgttgggaaggcatgattgtgttttgaaatgtgagaaggacatgagatttgagaggtactaggggtaaaatgatatgatttggctctgtgtccccacccaaatctcatgtttaattataatccccatatgtcagggaagggacatggtaggaagtgactggatcatgggggaggtttcccctatgcagttctggtgagagtgagttagttctatgagatctaatggtttaaaagtgtgtgtcatcccccacttgctctgtctctcctggtaccacgtaaggtgtgtctttcttcccattcaccttccgccatgattgtaagtttctgaggcctccccagccatgtaaaagtgtgagtcaattaaacctcttttctttatacattacccaatcccaatcttctttatagcaatgtgaaaataaagtaatgtaacatgttgttatctttaggaagatttttgtgctaggaaccacaaaccattttatatataacactataattttttaaccaaatccacaaaactggtttaagcaactatacagtagtttcacaacatacatttaaagcaaacatttatttttctttgctcccaaaatacctattttgaagggagcataaaataatgctatttatagattttattttgggaaaaaatctagttttaggaattgtcataaccttgataactattattatctttctctgagatgctttgaataaatattatgatacacatttgtgcaatatttctgtgtagacatatgccagatgtgtgatgacaagctgccttgtaatacaataatacaaactcctggaagtgttggaaccaaaaagtatttaacatgctgaatatgattctggaaataggacttccagataatgatgtgtgtgtgtgtgtgtgtgtgtgtgtgtgagtgtgtgtgtttaaacttaatcttagcatcctatccagctttaaaattctgtgcttttgttttgttgatgctccctcaaagcaaaatgaatactttccaggagatgccaatgaaattaatgagtttaacctcaaagattttatccttctcagcagtcaactggaagctaaagtacattagagagaaattaattacaagatgcttgcatttcaattattctgcatttatcactgcaattattccatgcatctatcactttctaaatataggaaactaaaaccaaagactcccaagtttttaatcccttcagaaatgtaaatagcctctggttgatatagaaactttttaatgtatttacaattttaactatgactaaagccatagttaaaattatttatagagattttctaaaataagaaattcaaggaatatctttagttgttttgagtaagccaaatgtatggttcaaatttagagtgataattatatctacagaagcttaaattttctggacagaaaaacctaggagagaaatcatgcaagaacatcaaagatgagttcaagcatttatgatgcaaataatgctgacaaattttagcaagcaacatttgtagagccaaattagttaattcaaatcataaatacaatataagagcaaatgtctattcctaagataaaatgagaaaaagtctatgtttccaatttatttgtagttatggactctcacatatgaaaaattaaaagtgttattttaaattccagttttatgtgaggcctgcatacatacataactttgaataaaaggcaacattcttttatttgcaggggaggggggcgggtggcggggagacagagtctcactcgctcactcggtcacccaggctggagtgcagtggcacaatcttggcttgctgcaatctccacctcccaggttcaagtgattctcttgcctcagcctctccagtagctgggattataggcacaggccaccatgcctggctaatttttgtatttttagtagagacgggatttcaccatgttggctagacttgtctcgaactcttgatctcaagtagtccgcctgccttggcctccccaagtgctgggattacaggtgtgagccactgtgcccagccgaaaggcaacattcttataatgtggaagccaaacttatctttcctaatatagttagccacatgatttttactgaatatcctatatcagaaaccagtagcattatttcgcatgaagactggctgttagatatactgctacatggatattatagatgagtaatagggcaatgactctgaaaaaattcttagaactcatctggttgagaagtcaccaactggtggctcaggagccgcattaaatcacagttgtacttggactatttagtattttaatcatttggaaattttacatagaattctttattatcagcatgtcttgaaaaatcaagaggagcttggaaatacattggtcttatctagccattagttgttttttcatcaagtttccacagctcctattatcctttttatctcagaccgtttgctaaatttatttactaccctcatagcatccaaagacatttgagcttttgacccttgagttaatccatctttcacaggtgaaaacattgagtcattattgatcccccgagttatccgacaatgaagtgtagtggttaaagtgttgtctctggagtcagtctgcatgggttcaaatcccagcttagccacttgcccactctgtgattcagagcaagttattgaacatttctgagatttagtttcctcatgtttaatatgaggagagaaataatacctgcctcgttgggtttcatgaggctagaccagtaaatatctgtgatgtgtttagaagaatgcctggcaaattttacactcagtctgattgctatgttattaaaccactctttagaaggtgagatgcagagtagcctgctcaaaggataggtccttctgtggcttgacactaatctagcttctgcttatagagccctattcatttaattcttcatttctttctaagtgtttgagtgaaagtccctgcaacttcggcttttgtaaacttacccttctcttggacaacatggtcttgaatatgaggaatgtactaaggcggatggaaaagtcagtcccagcatataaaagatcagagacagaaatgataaaaaaagaattgttttattcttatgaacaactttacttctttaagaacttgtgcagatagaaaaagcatttaagatttccatcctcagttgtctattacaaggaggatgaagaatttatttttttccatttatatttgaaaaatgcttaattaacattaacattttgagaagctagaaacagatgactgaggggaaataggggtaaagtgtgaagacttgcattaattccctttcaaaatattatttaacttaggcaaatttaatggtctcgtttagaattgtgctgattgcatgggggaataaagattccctttttctgattgttcatataatcaattttgtactcattaaaaaaactccttgtgaatataaacaagcatttatagcatgtttttcttgttgataagcttatttgccacaaagtttaacatgtgtgttcccaaatgtcctttttccataatttgtattttaagttgacttgactccctgcaccaactaggaagctctctttctctaaaaacattcttccatttgaagtttttaataaaggattaagagagttattcacttgcattagtctattttctgacaaaaagggctttaaagtcatacataaaaagaaatattgagcatatgtcttaatcattaatgacattaatgagggtaataatttattatcctctaatcaaattaaatgttttatctccctaaaatctacctaaaggcgagaaagaacatttttgtggaatgaataatatttcattggagttaagtctattctttctttgattaggtttatttcttcataaggtcatctttgatacttaaacttttgctaaaattttgtgtaacaaatattttttcattgatatgactgtcttacggtttttgtgattaagttataaattaattttctcttgctgtaactttcaaataaataaagtgtgtaaacagacatgtaagactttgagatttggagagcagttggaaggatggaaagtgtaccataattccaaatattgtacaggcaatgtttacagtatttgcaacagctaattactcctgtcaggttgtagaaaatgataatttttttgaagacaagtctttgccagccttagttagcatttgtttgcctgcagaaatactgtgtagtgacttggctacctgttgtatttattttacataatgcaatagctaagtttttattaagaagaaaaatagaaaatatggggaaagtgaagataaaaattgtcaaaaaaggtattatttgatgaggaaaaaacaactaaaagtgatttttaaaaaggaaacgtataagaagaaaaaccagaaattgaacaatttgttgaagagctggtagtaatttttaaaatgtttcatctttcttcaattcccttaagtaatagtgttattaaattctccagatgagagtttgccaggatttaatgtttgtatgcagtatacaccaaaatgattggcccttgtgaatgggtttattagttctgtgatttcttttatctcatttgaattcagtatataattactgaaataacacatccacaaaaactgtagtacaagcttgttttacggtttatgtggctatctttgcctttaaatgtaaccctaaataagacttcaaataaactgcctagtgcttagctgctctgaacaggaaagacatagtagttctgggttctgtgtcagtggcccatttggagacacctggaaaatatctagttaaaattttaatgtatttttttgttgctgatcaagctcaaacactctaggaccattttacaaaataacaacaaaatgccagataaagtggagaggagagaaatgtattgaatatttggctgtttagattcattaatgtagagtggctacattcttctccaagttccacaaacccaaaaaccacacacgttcctctctgtaacttagcaattggaacatgtgatggttttaggaaaacagcattgctgaaacccaaaactgagatagccatttatgaattaagagtttgcaattactaaaattgtaacaaatccttcaagatgtcttaaaataggtggtattaatatgtaatatgataaacatgctagcattgtataattccaagccagtctcagcaaaagcaatggatgacactcatttctaaatagcaggtgaacatactctggttttaggtttggctacttcctgtgagattgcagtttggattacggccatatttcatgtatttttctccctgaaagctaatgaaagtcccctggatgtaatgccattaatccctggggaagaaataactggggcaaaatttaatataacagatgtgatttctataagtgctagtgataagataggaggcagtgcattagcaaaaaggactagataaggaaaattaaaaatggtgagtaaagattctgcttatcctgagggaaatttcatgattaaccaatgccttcaattgttattttcaatgatataaagtaataatatgtaacattcaaccttaaattattgactatgaattccaacaatgaaaagtgtacgatatcattacaagatgatctaagtttcttctccagtattgacaatatattcattcttggggtgagggattaagaaggaaagtaaaattatgataacttcattttactaggagtttgtattaaatatttaaaatgcttatattacatatccctaaaggtaattctgtatgcctggatgaacattttattttataaaaaaattagcatatattctttcttctctccagattagttaacataactcagaaaatcctaaatattaaatgaaagctctaaatttatattagttgttaaatagtataattataatgattgaacactgaagatctctggatgctaatattccacacattacagtatgtgccaactctaaaatttgacttttagacttttaggaatttttatgatatatatttttcacaccgtatgacactgttgatagtattaggattttctaaaatgatgggataattttacctatgataaatgctaccatttataaatgtgatttcggtatgcatgaaatgcacgattttgcatattactgctgtaactattatcttaaaatatgaccttctgggaaataacatgttatgaccttataatttattattacattcacaggtaactcctcaagtatctaggcttgactgttataattatacattcttcataactatgaattttgaattatgggttaagaattatgaattatagactcaaacacactttaaaacattcttttatcaaagggcatttagtgtggctgacactctggccttttagaagttaataataaataaaattgtcattgtttcctgaattagctttaagtgaatccatgtgttaagcttcaaatttggtaaaatgctattttactaaatagcatttttgaaaatcttatttatatagcttaaagaaaaaccatatgactttaagaaaactaagaccaatgttaatattttagtagcttaaacatatagtgctggatactgtcagaattccatacatggaattcaagtaaagccactactaattaattttaaacactgatgactgtgtatcaaactcttcgctattttcatggaatttgcaactagattgttcagttaagcagtctatatatgaatatctttataattttaaaatcatgattcacagagtaaaattttgggtatttggctcttcaaaaacctgaatttaaagagtgctctagtagtagggcaaatgctctgggtgcagatagctgtgcctcactgatatcccctcaatgccttaatgacaatccaccacaagcatcagtttgggtaaaaatgaagcatttactttctttctttctttcctccttccttccttccttcctttctttccttctttctttcttctttcatttctttctccttccttccttccttcctttctttccttctttctttcttctttcatttctttctccttccttccttccttccttccttccttccttccttccttccttccttcccccggcccctctccttcccccttcctctccccctccctctgccctcccctcccctcccctcccttcccctcccctccccttacctttcctttcccgaaacaaaattatgaatagaatgttgggtcttaacttcctttcatataaatacttgcctaaatcagctgatatatttggtaaggttaaaagggaagcatgaaagtgagccattgcagatagaaacagatgttttcccctagctaattactaataatgtgatcttaagatcacatctagcaacaaatgcacatgcctagttaaaactataagaaatagtttaaattttagtactggacttttcttattcctgatgtatgactattatttactgagattttattttgtttcattatgctgacacagtattactaggataacggcattattattgccattttaaggataaggaaatgagaacggtaaccaggccttgtagatcccaaagtattacagtattttaaatatcaactatatttacaatattttaatcacataaaaaaaataaaaacaaatgaccttacttcaagtaaataattttggtgttaagaagtgacaccttttcctgagaatgtattattagagaggaattttaattttttaaaaaacttacatagaatgagaaggagaaagcctattaatgtataccatatttcccccatatgattataagtgctgttgtcatccatatactgtatgtttaagattaattgttagtgttttcaatttaatgctaaagcataaactagaatgaatcttagtgggagttacttggaatataaatattaatttttattataaaacatttatattcatatataattcggctactcttaattttaaatataaataatttaaatacttattcaatcaataaatatgtattaaggataccaatcagacagacacagtctcagctcttaaggaacgtcctgtctagttattactatacacatatacaagatgacttacaggtaaaaagatgtcagacagaaatgtgaactgctgccttgtgaaggactccctacgggagctgtgtcttggtgggatagatggagccttctttctaagtattgaaactgaagcgtattagtcaacaaagagatgatcaggctgtgattaatagactcatttaaactaaactcataagaccaaagcacagaagtgaaagcagtattttgttgatttctgaaaggtgacactagtccacgctttcatagaaagtgcctgggacttgaaattattactagaagattttgctaaatatatagtcgcagcaaaaaggattgctagattgtgtgaatggatggatagtttacttttcttataggaaatcagctctagtctattcctagaatggcttttttgaccaaaatattttgttttccatatattgttagtctttatggtcaatgatgaataaacagtgctaaatactttctttttatggatgtaccaaaagcaacatttcaattcattaagtaaacagttacatttatgtattgtctttctctggttacatcctagtcaacttgattagaactgggtatttatcttctgcaaaatatttacaaactgttatgtatttttagcatatggccatgttttctttttattgatggttttaactagtttacaggtatggctcttactgatttttttcaaaattataaatattttgtacacacccataatgcattgaaaaaactagggctcaagtggctatatgttaattttaaatgtttaatcagcaaataaatacttcaaacattttattttgaaacacatcttataaatcatctttttaagttttattactagtattagtattattttgatccacatatctcttgacttttttcttttaagtccttgataaaatattcattaattacttaatgggtagcctttatagttcccttcagaaaatattcagcaagataaatttatgtgtaaattaatgggtaaaattatatgattggattctttataaataatctacgtactttttttttgtttctagacattattagtctatacccaactttaacctttaggtggcagcatttgagaacagttatagatacttgccaccatttagaaaaacaagatgaatagtgtatatgttcaaaataaagaatttaggattttttttttatttagactcagaacaatcgcttatcaagcactgcactatctcataatttgtaacattaagaagtattttcatattcacataaggctactttaggtttataaaaagtccatcatttgcatggccatttgttcacagttatactttcattgaaggcaggggttcttccaaatggatattcctaaaggacctttgttctcagcacatctccaattttaatggatctgggctaattagacatatctgaaaatcttttctaaagtattgaaaacaaagacattatctttcttcttgcaatttattggtttaaaaatactttacatttatgtatagtgagagatgaaagggcaagtacaatataaaaccaatttatatcaaggactttttttaatagtccatcttagttgctaactagaataatcatcacaaaagatacattttgctgaataactgaccgattagtctgatctatcactcctatcttgttttctttttttaaaaaatgaggtcaaccaattttgcttcactagccaagtacctaatcaagatcaggccatatatgaataacttcattaagatatataatcaaggctagaatctattatgtttaatggaatatgagtgcttaacttttacagagactcatgtcagcttttctacaactataattcctgttgctgtatgattaactttttcattatattaaacttaaaattactttcttttatttttctctatttggattttaatatagttaaataaatcttttaggataactttttaaaatacttctttttctttttattgaaaaatgttccaatatttttatcctgatttcagttcagaggattttattttgtgtttacttcattattataagaaagacataaaatttcaaataacttatttaaaaccatgtttatatatagctgatcctaaagactaatgtgtatttgttcattttggccctataaaatattaaatagttttgctaaggaaagtatttgcagtgatttttactgatggcaaaattgtaaaaaaaaaaattaatacctagttatcatttaaataatttatattttagacaggatccaaagtatacaacatgctttgtgttttagacatttgtgtttgtgctatttacattaagaaaacttgatcagtatctataaacatcctttccctatagagaaatggataatctgttaatttgtgttgtaaaagtcatgtagttccatgaagacagtatccaaaagtatgggtactctgtgaccatttcagtttttgtcacatttttctatttgcctgaatccctcaaaatggcatgtatgtccattttcacactactgataaaaacatacctgagactgggcaatttacaaaagaaagaggtttaactggacttacagttccatgtggctggggaagcctcacaatcatgatggaaggcaaagaggagcaagtcatgccttacatggatggcagcaggcaaagagagagcttgtgcaaggaaactctcatttttaaaaccatcatatctcgtgagacttactcactatcaggagaacagcacaggaaagacctgtgcccatgattcaagcatctcccaccggctctctttcacagtgcatgggaattatggaagctacaagatgagatttgggtggggacacagagccaaaccatatcatggcataagcaagataaatgatttattgaccaattaactgaaatttttagaggcttgaatgtctggaaataggtgctccaataatgtcagaagtctgattctccatttctcttttctgctttactttttgtcgctttttttttttttttttttttttgacagagtctcgctctatcccccaggctggagtgcagtggcaggatctcggctcactgcaagctccgcctcccaggttcacaccattctgctgcgtcagcctccccagtagctgggactgcaggtgcccaccaccacgcctggctaattttttgtatatttttttgtatttttagtagagacggggtttcaccgtgttagccaggatggtttcgatctcctgacctcgtgatccgcccacctcggcctcccaaagtgctgggattacaggcgtgagccaccgcgcctggcctactttttgttgctttttattctcagtaaatgttttcccccaactggtagcaaaaaaggtttccaccactcctgaccagcatgcctgatagaaaaaaagcatgtgtgtgtgcatctttctagtggtcttggggaaagtttcagggagaactttctttgttgcaacatgagtcacacccccatacctgagcttatcattttaggaagtgcactctggtctgtgatttttcagatcaaattgcttagatcccagttccaaccaaggagggcagagttactataagcctcatgccttgacagacattttagctgatgcctcatccaagtcatttggcagcatcagttgatctttatgttcaaaaagattctgaacaaatgaatcaaagcagatatgaggctttcactctttccactagcactttaacccagaccaattgcatcaaaatgtgtctatatggcagccaaataaattgtgagacataaaccaattttaataaaatagaattttgtgtgtcatgacaccttgataataatagcgagacatggtcagattgcttgcgaattgtttaaagtggagagattactgaatcaggagacaatcctgacttctgacttcggataaggcagccactgcctgggataaggggagtgtactgcagagaactggctgatggcttttggtcagtcagctgggcaagggtgaatcagaattacagtctgcctccatctgctagtaattcctgcagttaaagccaggcatgacaagttgcagtgttacagatggcctatggtatcagtttcaaataaatagcttccttcctttcctatacaactatatgctactgtcactttaataaaggaaataacatgcaagtcaaatttgtttcttaagtgtaaaaactcttagactgacaaaacttcttttgcaataagtttaaaaaattaccttttttgccatcccaccctccaaaacatccctctccattccatctagcaacactcctattcaagcttgctggatgtgctgtgaatcctgagggactcctgaagctaattcatactacagcgtaaataacttctgggtcaatgctccccaaggggtttgtactttataaggaagtcatttatggaaggtgccagagggaactttgcaattgaactttgcaattcaaatgaaaggtggggcttttttccacagagcatctccaggaaaaaagccaacagagctattgtcccccaaaacaaattaatatatatagttcattcacaaattcattctacaaatattggctgcctatcatattctagtcattgttgatgtttttctttttctcatataaatgtatttcttactttaaaaaagaggccaaggaatataaaggaatataaagctaataaaaaattcagccctatttgtataaattttacaagtcattaaaaagtcggtgagaaaaattttattttttatgtttttttaagtggtcatttgttggttggaaactatgattagaaacagttttccctctttgccaggtaagtactatgctctaggagggctaataggatggttatattgcctagtgaagagatctggggcaagcagcttaacccaggtatacccccaggttttaaactaccattccttataaagtttttttttttcaaataaatactatacattggatattttacatatttagcatcaaatccacagttatgtgactgataaaatacaaatcttgcctccttctcatattttccgtgtgttgcagagtgatctctctcaaatgccaacctatttattaagtcttgtatctgattttccaccttcaatatatgccttttttccacatttagtacaatgctggcatgtagtagatgcccagtttgtagatattgagtagctgaactatattcaattcagtatatattccctgaatatacattggcatgcaaggcagtgtactcacgagtacacggatgactaagacacattctttctcttcttgtagttttgcatttagtaagtgtggatatttggggataagtcatgacaaaaatcctaataaaagccaaccattcaagccaaagagagtcagtcgggaacaagtggctatgggaatttagtctctgacaccagaaatcatagcctctcagaaattacagttcactgtggaacactttagtgttttggaaggtagctctgtctttcaatggctagcttttaatcagctttttgaaataaatgaataaaacaccctttgtttcatttatgtgtgtgcttcagtttaaagtagtaaaaacaatgatcatattcatctgttccatacaagagtcgacaaaatattggatacatatttaagtattaccataattatagtttttatttcattaggcaacttacatcgagatttttatgtacacaggtctgtgactataataatccattcctaattgcttatgtggaatctatgaatccttccttgtacagtattttgttctcctaggtgttgataaactagagccgttagcaagcttttatgttctcttaaaggttatttgactttgatttagaaatgttacattcccattcatttcatgaatattctctaatgctttttctaaacctgggacataatatggatcttacttctacagaaaattatggagattatcagtaattgctctattacaaccacaaggaaaaatatatttagattgtagagtcccaaggtatttcaaaaacatactttgaagtagtgactcaatattggtaatgtatgtagtttgcatacaaataataagtattatactttcatgtataacatttaaaccacaggatactgaagttctcatttcctgttgggaattttccatgtgaatataggactgttcctctatctgaagagctagagatttcccttttatcatattgagcatacaatgaaatgatcatgttttgatttttttaattatcatctcaaaggttttaaaagaattatatgcttcctttacattgcattatctgattctatccagtgataatgtcctatatagttatctctctaaattgaaggtgactgaatgggatgattttcttttttgtagtggctcctagactcctcccttaagtcctggcatgcaagtcctcaatcataactgataccaattatttcagggtattctctgtggcagtacagatttcctcctcttccctacttttattataaacagtttatacaacacctaaaaagcccttctgaaataatgtgatatgaaagagtcccttaatggttatttccctggaagaccaactaggtaagcacatagtcccatttactaccacttctattactagttttttttttgttttgttttgttttttgagacagagtcttggtctgtcgcccaggctggagtgcagtggtgcgatctctgcttactgcaagctctgcttcctgggttcacgccattctcctgcctcagcctccggagtagctgggactacaggtgcccgccacaattaccagctaatttttttgtatttttagtagagacagggtttcactgtgttagccaggatggtctagctaaaggattgtaaatacaccaatcagcaccctgtctatctcaaggtttgtaaaggcaccaatcagtgctctgtgtctaatctggtgaggacttggagaacttttgtctagctagaggattgtaaatgcaccaattagcaccctgtcaaaacggaccaatcagcgctctgtaaaatggaccaatcagctctctgtaaaatggaccaaccagctctctgtaaaatgggccaatcagcaggatgtgggtggggtcagataagggaataaaagcaggctgcagcaccagctgcggcaatcaggttgcgtctccttccacgttgtaggagctttgtttatttgctctttgcaataaatcttgttgcttctcgctcattgggtctgtactgcctttatgagctgtaacactcaccacaaaggtctgcagcttcactcttgaggtcagcgagaccacgaactcactgggaggagtgaacaactctggactggaggaatgaacaactccagaggcactgccttaaaagctgtaacactcaccgcaaaggtctgcaccttcactcctgaagccagcgagaccacgaacccaccagaaggaagaaactctgaacatgtttgaacatgagaaggaacaaacgccggacacgtcacctttatagaactgtaacactcaccgccagggtctgcggcttcattcttgaagtcggtgagacaaagaacccaccaattctggacacagaaatactgaggcaagatagttacaactatatgtatctcatcaatttaattaaaattggaattaataaggcttgaacttaataatttaagggtacttccaaggttgctgtcctgtcaatggatatttgtttgatggtgtgaacaagaaagcagaattaaaagatattttaaaaaatgatttgactagaattcagagtgctttgtttggcactaaatgtgacacctgagctccttctctctcttgcgaatgagatcatggctttggtttccatgatttccaaggttcatttattttttaaatcgacttacttttagattcaatataggctttaacatatactctttcacttccttagtaggtactttatgagcacttcgttcatgtaaggcacagtgccaggcacggggatgtgtcaggagagtgaagagctcctttgctcatgggctcagggtttgggggagacaaacattacataattacacaaataaatagaaactgtgataagcgctgcaaagacatcatggagggtgtcaggagataaaataatagattgacctaaattggattgagagtgagaacatgtctctcagagagtaagagctttaggctgaaacccggggagtgagaaaaaattagttgaaaaataaagcataagttagtatttcaggcagaggaaaaagttaacagaaaacccctgagacatgaaatcacccagagtttaggacatggtctgagatgaggttggagacagtgggcagaaactacatcatgggaagcctgaggtcagagtaggggcttttatcctagatacaacgaaaatctggcagtgaaagagatagagaaaaacaggtaggtgtggggaggagttgtgcgcaatacacaaaacataagatgctgaatgggtgagaggtttggctttcttcatttttgtgttttgtaaaaatttggcctttttggaaaggtcagattcttgggagataatttcagacaacagtacatgtggaatttgagcatcttgaaaatgttttttaaaaggcttcctatacctcctagaagtactcatacatcaatttgaagatcactgatataaaacccagtacctaatcttaggaagttggtaatataggtagagagataagtcacaagcatatgaaaagttaatcataaaatatttaaataacagttcaatacaataataaactataataagcaaagtgtatgaaattgccatgtttaattgcttaattaattgtgcagaaaatgattggtcagaggtccccagtggtcagggcattttttggggatcttataaaactgggagaatttgaatggtctgaaggaaggatttgtgatatttcaagactaacagtaatatttattgagggagaaaattgaaagatgtttttgagtgcctacaatttggtgaaatgattagaagatagtttgattacaaagagtatggaatgcgaccttctccaggttaatttttttaattaaaaattttaaataatattaattgaacatattatgtatttatggggtacaatgtgatgttttaacatatgtttacatttgtggaatgattaagtcaaactaattgacgaaaatctatcaccacacatacttgtttctttgtggtgaaaacatttaaaatccttttagtagttttgaaatagacagtatatatttatcacatgctcagtaaaatggcgaggcacagaaggacaaatgctgcatgatctcacttgtatgtagattcttaaagtgttgaactcatggaagtagagtacaatggtggctaccagaagccaggagtaggggattggatacagaaaggggagatattgatcaaagatacaaaatttcagttagccttcagaaattgtactacactttgtgggtcctgggtatccactgtagactttggagtagggaaatactaggataaaattgacatgttaaacgtatccagggaaaacctgacaaagggatttgaaagaggaaatggtcaaatttagaggcttagagtcaaaatcctagactaaggcaataaatagcttatgtaatggatatgaaaatggaaagaaggaaggaatatttttgaaacgtccagtgaaaataaaacaacacaaaacaaaaagacaagattgggtaattatttggatatagaccctcaaggaaaagtgaagagtcctagaaaacaattttgtgccctataaacgttaggaatggtttttgtgattatttaatcaatttgcttgttacagtaatagtagtgttagcagtggaaatctcagaaccaggagctgaaagtacctgtatctccactgttgtcaaattctggtatttagacttgcttgtacttgcaagctggtgtttaccttgctggacattatttagtcactctcattaaccaatattttacctaaagtacagtactcattaccaaacctaaagtatagtactcattacttagtgaccaaacttctttaatgtaattcttcatatgtctctcttctaacaggagcaacttgggcaataatgacccccattaatgctgtaacttttctctatccagaaagtaaaagtagaaaattagcagaaatatggactgtctcacatatacttcttctttttattcactaacagctttccaatatcatagatacacctaagcacagttcattcccaaacaatgaagtataatacataacctccaaccagaatattgtcttgtttactttttaggcaatgtttcaaagtgctgtttaaatacatattttagcaaaatgaacccagattcagaaaactaaagagcaaaaataattagattaagaaatcatccttaactgtaacattcaaatagaaccattgttcatgttttaccacatatcctctcagcttattttctctgtgtatacataaaatatcacttttgttatggaaatgagattttatgtctaaaaatataatcgctttatatgtactgttctgtgacctgctttttcaattcattatttctgtgaatgtctcctgaattaataattgtagaataacatcatccctataacttcaatgaaagttctagtaaccttctggttttgtaagtctgggtggtttgcaatattttatattataaatacaattatctaataatatttgcatactcacctaaaaagatataggaatattttataactctgttgtaaatatatatatatacacacacacacacacatacatatatgtgggtattaacgcaattctttatcaccttagagtaagtttctaaaagcgatattgttagttcaaagttgtgcagctttaagatttaaaaatattttcaaattgccttatatagttccattttttctccccccaacaggatatgtaaacacccatcccctcactctttcaacaatagaaaaaatgggcttaaccattgatacgtatccttgcagtctattagctagtacatgatatcttttgagttttggcttgcatttgagggggaattacttgtaggtaaacattattttatgtgtattggttttttatgtttttactttttgaactgcctgttcacattcttggcacattttccaccagagaggtcaaactaatttcttaagtactattttccggttagcagacaacataacgagtttcaacagcttattaaaatagtggagtttcttacatctgctattataatggaaaaaaatttctgtgccatgataaaaaatcaagatgctaaatatctagtgttgtctaactttaatatttccaatttgacttaactctttgtttaatatctgttttacttaaaatgagtgataacatttatcaacattgtcttatgtaatttatttttttatgaggattatatttttaaaaacacctaaaatatattaaagggaagtgtatacaacaaaatatttcttgtgaaagccaaaagttaagtggctgccctatattgccactaaaggtgaaccttattttcaactgtatcagatatgtggcacaatgtggaaaatttccaagttcgttatgaacaatcataaaacccaaaatccccactcacacacttgatggctgacaagagctgagttttcacccttctcatattggtgctcctttccaagtattgtgctttctgccaaagtaatgctttttcattttagtacaaaatcttagttacttaaagagtataaaaacctattcctctcatagctagaggcttatgtgaaaagtaaaggatgagggacaatttgagattgacaatgggagatcagattgcagtggagctcatggaacaatcaagttagagtcctcaagagagggtaggaagaaaatgtttatgcacagcactgataatcaccattcccaaatgtctacagaagatccatgacaacagtgacttattaatgcagttcaataaatgttttcttatatttataataagagatacggtaatagcattaaataatttgtttcgtaatggacggttgaattcattcttgtatttttcccatataattgtggaagagagagaaatcacaagtgtctgtgcatttgatcatatagacttgaattgtcctataggataaaattgatattgtggtcacattcatttattcaatttatgtttatttatcaccagcattttcagttccttttttgggtaatagatacacacacacacacacacacacacacacacacataaaaaaaactcctgccctccagctaccttctaatgaaagagattggtaacaaatatataattatggaatataatgagagataataaatgcaatgaataaaaattatggcacaataaggagatagggaaatggaggcttattatatagggtggtcattgaagaagactatgaggaaatgacatttaagtatggtcctgggggacctatgcagcaatctagagttaagagtattaaaggcagagggaaagacaaatggggtggtcctgagacaggaatgtgcttggtcctcagcatgttcaagggttatttagaaacttatgtcacttctttacttttctattttgatttttttcaaagttaacactcaaatccattaattgactcagatggctagaaagtgggaaacataaaagttatgttcactgatgtatttgctttcagacatacttgtgttttgtcatgttagaaagtacttaaagacaaaggctgtaagaggtggatgtcagaggaaagacaggatcaatcaagataggtagaatagtgacacaaaagtataaattgtttttgtagaaattttaagaataacatttcagtggtgttactaataatttgtaacaatgactaaacaaattcacattggtttacgtctccaaatattgaaattcagacttcatttaattcagcattttgtttgccatgattgaagttatgactgaaaaaaacaaggtagcatcttagaacaatattgcttccaaaagttgtgtccacatttggttcctgaattttgttgatggctgatcaacctgagactatgagcttgtacagtggcacctaatgaaattggtaatatgtccacattttagattatatttcatttgttgctccagtctgacattaaaataaatattccttttttttcttttctcttttatttttttttttttgagacggcttctcgctctgtcccccgggctggagtgcagtggtgcaatctcagctcactgcaagctccgcctcctgggttcacaccattctcctgtgtcagcctcctgagtacctgggactacaggtgtccgccaccacgcctggctaattttttgtatttttagtagagatggggtttcactgtgttagccaggatattctcgatctcctgacctcgtgatccacctgcctcggcctcccaaagtgctgggattacaggcgtgagccaccatgcctggcctaagtaaatattcttaaacgagcaatagtgaccacagagaatgggtttgttgataacatttgcaagattaaccaaaaattgtgaagtacaactttcatattcctttgtaactacatatatattttacatatatcattatataggtatataaaaagtagtgagtactgttgtaaaactctatacatggccaacaattaattttgaatttcaaaatatttcaaatgatttctcaaaagtatatgcaaataacaaaatgtcaatattttctgtacattgtatgattacccgatgaaggtattttctacttgaaataccttttaataaagtaccaagaaaaccacaaagcacttaatgcatcaaagatgttatcttatctgttcttcactttgaaagccatacttcatcttgagctaaagaatttgagaattgaaatcttggcagaggttaacttacaggtaagtacaatcacttgagaattttactcatgatgttcaatttaaatccttcaaatactgttgccctaacaaaatagaacattttatgcttctttccacaggtaagagcaatccatctgagggactacaacgtgactgaagacctctgtcccaaacttttttaaaggaactttgttataccacagtttagcaatctttagaaagatgttacacttattttgatatccagataaatcaagagagagtatttccttatagctgcaatgaaatctgtaatgaatttgtggttatttgtttattttacttaattaaacacatatgccaattgttgcaagggatataaatttgtgtacactattcttgatcttagaggttaacaggtacaagacattaataaaatctgtgatgcagggtggatagttgtaaactcaaaaaacaaatacataaaaggaagaggcagagagagagatttttaaaaatgcactaagaattaatgaaagaaaatgcctagtattgaatctcaaagatgacctcatagaacatgtagcatcataaatgccataaatggatcttaaaggagagttatgacaatcatagagggaggtggaaagtttagcaggcgaaagaaagatagtataagctaacttgaggatggaaatgcatggggcagctttttggaatagcaaatgaactaaatgtaggaatagtgtattagtccgttttcatgctgttgataaggacttacctgagactgggaagaaaaagaagtttagtggacttacagttccacatgtcttgggaggcctcataattgtggcagaggacaaggaggagcaagtcatgtcttacatggatggcagcaggcaaagagagaatttgtgcagggaaactcctgtttttaaaattatcagatcttgtgagacttactcactattacaagaacagcacgggaaagcccagtctccatgattcagttatctctcactaggtccctcccgcaacacgtgggaattatgggagctacgagatgaggtttgggtggggacacagagccaaaccatatcaaatagggaacagtaaaattagaaatccaacattattttatcataatactgggaaagcagtatgtatatttgaggaccttgatttaaacttaagactaatgtaacaatgctggtctggaatgaattttattaaggaaattataagaaaaggctagacaagaattaactaggtaaatttaaaaatgaaaagtatgtgagacattatgatggtagattatgtatgatcaaacaacttaatgaatgtctgagtcagaaggaaggagtcagatgacttcaagctggtgactaagagactagtagtgccattaatgaaaatagagggttcaggtttagttaatactcatgaggaaaacaaaacacttatgagtgtcttgaatttaacccaccttcataatagctctatgaagttgttcaactggctcctgaaaagctgtgtctggagtggaggaagaggagagggagatgctgaagggaaaggaattagagaagtggtcatagaatagtcaggaaagtgaggaatgaagatgacagagccaagatcaatcttccagctggtagttactgcagaagggtggaggagccgaagagtggagaccaagaagatatgggtgatctgctagagcagcactgttcaggaatatgtccctgcactgatgaaaatgttctgtccatactgtccagtctggtttccagcaatcacatgtgactattgaggaactatattttttattttatggaattttagttagtttaaatttaaataccctcctgcagctagtggctacagaattgataaatgcagctatagagaattttaaaacacctttgtctcactgaaatcaattttccactcagccatcaagtgtcatctctaaactatagtttggaacatctccttctgcttaaaactctccagtggcttttcattgttgaggagtaggatccaaactactgaagcatagcaataacaaagcatctccagcctcactccatccatctgaagccctagccacagcagcctctgagtttccccaacaggctgaaccttttcctggtcaaggcctttgtgttcttgttcttgcttttcatctttcaggcctccagttaagtgtcactcctcagagaggtcttccttgagccccttatgtaaattagccagctcattgctattagtctccaactcaacactcaatttatttcctttatggtatagatcataatttctatttatttatttattttccttggcctccaccactggattgtaaactccctaagagcagggatcatgtgtgtcttaacatttctcatacctctcagagggcctgggttgtgcaataaatattggctgggtgttgataaataccaatacgaatatgtaactactaagcagaagtttccataagcaagtttgttgttatcagtatatttcggcaaaaaaacactcggagaaacttatatagacaaattggcaaaatatatacctcaaaaagtttattaagacagaagaaactgaaatagtatcagttgaaagatgcaatttggatagtacttaatggggaagaaagttacataatttttgtactttataaagcctcaagtagagtccccagcctctcaagttccacctgacttctatctacaccagaggaataatttatttcttagctgcttctctaatgcctgccttagttttattctttggacctctatgacccttgaaaacattggaaaatttttgctcagggtattttctggaatttcagtaacaatatgaaattaacatcattatcattactatatagaaaacaaaatcaaacaaaactctcagattggcagtttattagagaaagagaaaggatctgttattgcttggaaatgcaggaaaaataaagactattacccagaaaatagttgtttattttcatagagtttgtgaaataaagcagctggcctatcaaattgctttcattacctaagtaagcagaaagtgatacttttaataaaattgtatttcactaggaatgaaattgatggtgcaatatttttaggtttttaaaataaaagaccttgtctgagacatatctttaaagttaaatataaaaagaattatatatgaaagccagtatttttccttagcattcaaaatgagggtacatacctactgataaagaaaaaaaagaaagcctgtctccaggacaaccaactctttttttttttttccttcagtgttatgctttctgtcccactgctatgaatgatttaaaaagaaaaaagaaacaaagaggaggaaagagaaaaaaaggacaatagaaaggaacacactataagtattatgcttttatgaaacaaagcgagcatattttaacctcaaaggtatcagtttaattaatgctaacttatttccaaatataagttaaaaattacattccatgtacttaagttttttgccaatatatagtttttgtaaatattaaggccctggaaaataacattggaatttataaacagattataattctaaccctaactttattcaaatactgtacttatatacctttcttcctcaaatacttaatctggtatttaacttcatcactctcaaagtcagtttgaaaagcataaaatttcttaaatgagcatagatgatatatgtatcaataacatggtttatttttagatgatatattttaataatataaagttaatctttaactataaaaagtaatcctgctacagttttctccaaatgtagataatcttatgaataatactatgaaataacatttatttcaaaatccttttttaattacttcatcatcacgtagaattaagcatagttgttccatgacccattgcttggcacatggtatctattgaatttgataacaataatacatccccatgtaggaatacattgcttcctgaccaatgctccacatttagaaaaagcaaaatggtgctttattttagcttctaaatgataagatggatataaaatatgggcatattgtatgaactgtgtaaagttctgctggtttaattgttgaacttccagaacatctgttctgcagaatattcctgttctatatgagttacaaggtatatgtcaatttctttctagactatgcctctttagatagaagatgtgagaaaatcaaaaacagataactccaaaatgctgaaaattatggaatgagccctcaaaagactgcactttgttccctttatctgcctcccttgcccaaaggagtatagtagaaagtagataattaccttatgaactcatgttatatacacaggtggattggttagtatagaaaaaaaattgcattcatggcctgtgaaattcagatgaagtacttatttagataactccatcaaaacactaactctttctgatctcagaaatttaaatgagtctaaggaacatgcggtgagcccagtaattttggcataaacatttcacttaaaatcatgagttaagatacaagcttgatttgttacttcaaataactattaatcctcttgctatgtgaatgagctatttttttaaaattcagtgttcagtgtttataatcagacaagatcccattatcagtaggtaatccctaactaactgcatgcttttggttatcaaaaagcatcatagttgaaaaaaaaagtctgcttttgtcaaaatcaaaatctcatagataaaagcagttagtggagaaaattattaagtggtattaaatatactttttaaacacaataaataaaaattctagaacgtattcttttctgaagatgatattcattagtataataatccttccccagatttaactttcttttgctatctccttcagtagttcaatattgtactggtttcataagctgctgaatctgctgagactaatttttttttttttttagttcaatgctgtgaagagtacacttcctgttgaagtctttgaaacaagtcacactgacttgaaatataatgtatttagcacttgtatttttctttgctttatttttgcaagtcttgaaaaacatgtatttagtgtacaggattttgcaaaattttgtgatgacatctttctaggactggggttctagccatacaccaagagggtggaattgaacaaatctgtttgtgcactatttcatagactgaccatgtgctgtgtagaacagtatttgtcatatgctctgattaaagaggaataaactctcttacatgaaaatatttcatatcttgaaacatgagtatataaatataaatacctacagtcttgaaacttgatattagtgagggattactgtattatacagtgtgccaattgttcagatcaatgttttccaatgtttcctgatgagcaaaatcaccaaataacttttttaaagtacagaatgttaagacttatagcagatcaataaatgcctaggaatggaaactgggaattcacatagtgtttttttttcctcctgaattgtcattattgtgtatattcttgaagaaataacttattttttttaagttgatctgcactagcagacaaaaacatataaaatatcaaagtattaactgttaaaaacaaaatttatgattatttattattaaaaatatggagtagagagtgagaggcaaagcaaaaaacagtggtatttctttgtgtgggttacaatttcacatggggaaattaaaattttgataagaacacaagccagaaatgaagttagcaatcactttttgtgctgttaaaaagtaatgaaactgcttcctttaagaagaacatacacacttggtaaggagtaggaggataggaatttaggtacaagtagtacttgaaagttagacttctcttagaacttgttgacctgacagctaataatcacgttaggttttgaaaaatatatgtaagagaactggagattttataatagtttctgtctgtcctctatgccctgatacatactactatgtagagggaataccaaatgaaaaatccaaaggacctggggacctggatcagagattgtcaggaagggatgcaaaagtttctcttctctctactcaatataagactattctcagttattattttttatagaggagaaaaatagctgaaaattttcaaaagtggctactttaaagttatgaagtaattagaaaatgccgagaattttgctttagtaaaaatccagttcttctctttttgattgactgtaacttttctgaactacaaactttctgttacattaagcataattgcaaaggtaaaatctggtagatatgttagtttcactgatgcaaagctgtttcttgcttgagaagcagaaagcgtatggggaaaggaaagaatcaattaggggaaagagaaaggagttggaggttgaacataatgttatactaggaattttaaagaaaagtagcattctaaatcatcgcctatccaatttgatcatcaaagataaaaatacctgtctactgggctagacaccttcattctgttgccactcacaataatactctttccagggagaattatttctaacacctgatttgtagaatcagagcctataactttaaacagactaacctaattcccatagtatttgaaaaccagtaaatctcttggcccctcgctacacacaaaagccactcccagcagctcctctgggggttacaagatcaatcttagacttcaatctcagtcctattgtagtcatgctaaggcacacttagggataaaccaaacaactgatccaaatcggtgttcatgtagctggtgggagagtggttagataaagggaagatattgcagaaaggagaagggatgaagataattttattgtgaaacaacacttcaggttttatttgtctaatacaagaaatacagagaggtttgggtgtggtgacttaggcctgcaatgccagcattttgggaagtcaaggcaggcagattacttgagcccaggaattcaaggctgcagtgagccatgacagcgccacttgtattccagcctgggcaacagaggttatttcgtcttaaaagaaaaagaaggaaaggaagaaggaaagaaagaaagagagagagagggagggagggagggagaaaggaaggaaggattgaaggaagggagggagggagggaggaaagggagggagggatggaggaagggagggagggaagaggaaggaaggaagggagggaggaaagaggaaagagggaaggaaggaaggaaggaaagaaagagaaacaagaaagaaggaagggagggataggggagggcaggaagaggaaggaagggagggagggaggaaagaggaaagagggaaggaaggaacgaaggaaagaaagaagggaaaaagaaagagaaacagaaagaagaaagaaggaagggagggagggataggggagggcaggaagaggaaggaagggagggaggaaaagggagggaggaaggaaggaaggaagggggaaagagaaacagaaagaaagaagaaaaggaaggaaggagagaaaaagagaaagaaagaagaaaacaaaagaaaaaagaaagaaagaaagaaagaaaaaagaaaagcaggaaaacacattattattaggattctccagagaaacagaaacaaatatatatatataatataataataattatatataatattacatattatatatataataaaaatgtatatatatagagagagagggagagacagagagagagacagagaaagagaggtttattataggaattgtctcataggattatggaggccaaaaatttcagaatatgctatctgcaaggtggagaaccaggaaagcctgtggtgtacttcagaccaaatcccaaggcctgagaacttggggggccactggtgtaagtctggaaatccaaaatcctgagaacctggagctctgatgtctaagggcaggagaagatggatggatgtcctagctccagaagactgtaaatctgcttctccttcccctttttgtttcagctaagccctcaatgaattggataatgcccactcgaattggtgagggaaaatctctttactcagtttactgatttaaatgctaatctcttctggaaattccctcacagacacacccagaaataatgtttcgccaactatctgagttttccttaatccaggcaagctcatagtaaaatttacgatcacaacattatagcaaaacttcagagtatttgctttgagagaaaaggtattcctggcactattttaaaaataatggagttagaacatgactccccaacccttagacatggacttcacatagtgaatttcttccaaagagtacagtgtggaaaaggggaaagtagaataactttgcagtcgagaaatcagtcaaatgccaactaaaacaggtaactaagctatcaacagggataattcatgttcattacatgtacccttgatgtgatgtgatgagaatgatcttcctcccaaaatccataacctcaatctaatcatgagtaaaatattaggcaaattccagttgagaaaatacatgactagtgcacctcaaaaccattaaagtcatcaaaatgaatgacagtctaaaatttgtcacaacaagatttagaagacatgaatactaaatctaatgtgataactttattgagatattagaacagaaaaaggacattgcggaaagtctaagaaaatctaaaaacagtatgggcttcagttaataatatcaatattggtttattagttgtgacaaatataccatagtaatgtaagatgttaacattagaggaaactgcttgtaggttatatgggaactttttgtacgattttctcaacttttatgtgaatgtaagactaatctaaaatttcaaaaaatttaaaaaattagttgacaactaccaacaaattaatatcgaaagcctttggaaatagttttgacagctagaactatttcttagataaattattttgccattcttttttttattatactttaaattttagggtacatgtgcacattgtgcaggttagttacatatgtatacatgtgccatgctggtgcactgcacccactaactcatcatctagcattaggtatatctcccactgctatccctcccccctccccccaccccacaacagtccccagagtgtgatattccccttcctgtgtccatgtgatctcattgttcagttcccacctatgagtgagaatatgtggtgtttggttttttgttcttgtgatagtttactgagaattatgttttccaatttcatccatgtccctacaaaagacatgaactcatcattttttatggctgcatagtattccatggtgtatatgtgccacattttcttaattcagtctagccattcttatatagttgttatcatatttatataccaaactgtaggccaaatggactaaaacattaaatattaattaaatattgcaataataagaatatatattatgtctcagcagagaatttttctaaggtttaatgtggtaaaaaaataataaaaattactaaacaatgtgttagataactctattaaaatttttaaatacataaagaactctaatgaattcatattttaaaatcaggcgttcagtagctgactgagaaaaaggcatgagtaatatacctgagagtaaacaacaagcaaaaaatacttacattttaccttgagggtaatcaataaatttttttaatgagacattaaagacactgtcttgtacacagtagtttctcagtaaatagcagttaaatgtattgactatgtgtatgcatacatgtataattatatataagtatacatttagaaatatgtaataataggatgacagtcaaatgaatatactcttatattgttggtggcagtggaaaaacatgatagcaatctgaaaacaattactaaaactataaaaatgaccatttattttgatctgttaccttatttctgagaatgtgcttacatacagttgttatatattgctgcataaccagaagcacaggtctgtagagattcaaaggctataagtaaatagttggctagatattcaggggctcatagggaacatgacagggaaagtagccacaaggaggcctggggaaaagatatgtggatagacctctccaaataggcagctatctgaagatatctgaagatatctagctcatcaaagattgacttcagcagaaaaagagcattttattaaacaagtagataggatgacccattctgtgaatttcagtcagtgtccttccccagccactcctgtcattgcccactgagctcatgaacaaagtaccatggtgacaaggatggaggttacacattgatcagcaatatgaactcattgacagcaatctggctgcatctattgctgagtgccccatttaccagcctcagagaccaacactgggcccgtgatgcagcactagtcccctggagcatcaaccaattgaaccatttccatcatagaaggaacagtgcttctccttactgaaatatatacttactctgtatatgaatttgccttccctccctacaatgcttctgcaaaaactatcatctgttgatttatacaatgacttattttgatatttcaaggataataacttctaaccaaaaaattcatttcccaggaaataaaacatgctaatagttccatgctcatggaattattgttcttaccatgagccctacttcttttcccaagtctatattagttgtttatatctaaataacaaattacctcaaatttagcagtaaataataacaagcatttattatctcagtttctataagccaaaagtaaagttcctaacttagctgcatacctctgcttcaaggcctttcaagaggttgcctttggccagaatatggtcttatctcaagactcagctgatgttagtgggtggaggggggtggggttctacttccaggcacactcatgttgttatatgcaggccctggctccttgcaacatgggcctctccatagtgcctcagaacatgatagctggctttttccgggacaaataattcaagagacagttagagagaacattcaagtcagaagaatccacagtctttttataacccaatcatcattacctctgcaatactctttttggtacaagtgagtcactaaacccagatgctaaatccaggggattcacacagggtgtgaatgtcaggatgtggaggtcattgggaaccatcttagacactgtttatttgctacactaagtaaattttaacaattaaaatatttcttttgtcattatctatagtaccagtgtataattttaacaacttaaatgagaaacagtaaggaaaaaagtcatacattaaaatattagataaaaagtccttaaaatagctatatatactacatggcataatgaaaaattcttgtaaaataatcttaaacagaaaagcagagaacaaaattatgcaaatacagacataacaatgaatactagtagggaagacgcaaaaagtaaagcaatgttgtcaaggtagcatgatatagttaagatttgtttttttcaaaaatgtttaatattgtttttaaaacatttgtacattttttaaatgggagaagtggtgacattggcaatatttaatttatattttttagctggaagccgtcttgttctcaataaatgaatttgtgttaagaactattatgaaatgggcatgacagagtatggatcactcactccaaaccttttatcactagtggcattaggtttttaataatatcatcttggtgtatagaatgcacaattttgtaccttatgttttatatatattctgaaaccagtgtgtgaataacgaggtattcacactgttacttctgattcaaaatggcaggtcagccatacatattgaactattttattcaatgaaaattgtgtctgttatcacactaaaagttgtactaacaatagagacgttctctgaaacatttttaagacaataaatcaagccatctgtagtaatttttttttctgcttagggaatgattattaacacatggtagtgtcaagtgattttcatttatctttcattacgcaagaaacagtagactagaaactgatttcttcattatgaatcaataattaaggaatattgactgctgtcctctattatgctagaaaaattttaaaatgcccctaaataaatatagaataagaggatttaaagaaaaacttaacaggtaagatactattagttcagatttcaacactaaagttgtgattaatatagttggttgtttgatattgaaaaaggccataaaaaagccaataattaaggccttatagggactataactagctataaaagtgaaaaaaatacatgtaaccacatataatcatgtgattctgtttgcatttgtatgataaactgaaaaaaagctttacctaatgatcttgacactagcactgttaacttaaactctgcatgactgagtagactaaaaggactagacactgattaaaagtctttctcacctcacatatatgattttgacataatttttaaattgattaatatcacgttttatttcattgcaacttctctggtttctgtgaaaagtctctgattatggaatgtagaaacaaatatcaatccacctgtttttgtatgtatgaattgattacaggcatagactatttaaaatgagactcctctagatatgtagaacatgtaatttaatctaggacaaagtttaataaactagctggtccatgatttacacttttgacttgagctcactagcagcaagcatgctgatcaaacaataaaacaaatcttttgtgaaaagaaggtagattatttaggtaggcaaggtgcaactctgtaaataacagtcaatgacgggacaaaattaaacatttcaggatataaaattatgaataggagatcatgcattattgtatctctaaatctcttattacttaaaattgagaaatatcaaaatgacctattttaaataaaataccattataaaaacccgacctcatatttcttaatgaatagaaaaagattacaaatttagtgataatatttcaaaatattatagcttaaccaacacatatttatttgtctcaggatatatttagttttccagatatcagatgaaaacataaatgaactaataacacaatatcccatcagaattttttaaatataaaattttgcttatacttgcaactgaattgctgctatttggaactcaaatgaaaatattgcctataatgcttataatatctgtaacacttataacactctaagagcagtagcaggcctgctcctgtgcctaactgctgtcatcttagacacaaccacctctgatgctttctaattactaaccttaagagaaaatggggccaggagcagtggtcatgcctgaaatcccatcgctttgagtgggaagccgaggtgagaggatcgcttgaggccaggagagaccaacctgggcaacatagtgacaccctgtctattaaaaaaatagccaagtgaggtggtgcatgcccataatctcagctactcaagaggatgaggcaggaggattacttgagcccaggaggtttaggctgcagtaaactgagtgtgccattacactcaagccaggtgagaaagcaagacaatatgaaaaaaaaaaaaaaaggggagaagaagagagagtaaacaaggaagggagggaaggagggaaggagggaaggagggaaggagggagggctggagggcgggaggaaggaaggaaggaaggaagggagggagggaggaaggaaggaaggaagggtgaaagggaggtatttgggcatgaaaatattcaaatttgtaaaggctataaacttaacagcaggctactgtactgtaggcaattgtaacacagtggcaagtatttgtgtatctaaacacacctaaacatagaaaaagtaatgcattgcactatgtaatgacatatgtcattacaaccctgacaatattgctaagtgacatgaatttttcagttataatcttatgggaccactgtcatatatgtggacctcatttaacatcattatgttgcatatgactgtatgttgactacacactttgctacttctctcgtttggctttgctacaaagacgtaaccaattttaaaagttgatgtaattctttggagacatttctatgtttttagaaacattacatatgtttttagtgaaggtctaaataaatggaatcattgctgattatctgatactattcatttgaaaatttaccttggtgattcttccaggccaatacacataaatctgactcatactttaatccatttaaaaggttttatatttggatattataatttatgtaattattgcttattggtagatacttaggttgtttccatggagatgcttctaaccatgggcatccaggaatccattggtttgattttctcctttcatatctctctcatgatcttgtttcaaatgctgaaactagctcacaaaggcattccttcaataaacacccaatctaatgaagctttattatgattttcatcacttcagtggttgtaggactttcaaaaatgaaaatctttcttctttcttaatttaacatggagcatgtttatgcaattgattatgttacttgggcattgaattttactccatttttaaagatgaatatggccaccgtgtgtggactgccaacttggctcatactggacaaaatcacaatgaagaaaatgtatgtctagattgttgggactgttacctatatctcatattatctggccaatatgtagcattattgcataagtattatataacgatctgttttaatagtccccaaaagtatatccaaacccatgttgtggtttatttgagttctattcctaaagaacaattattcagggtacacatataaggtcacctaatcaattctgaagtttgcttcgttcgtgataggctaatcctttttccagctgacatgaacttcacaaagcctccttccgagcctctggtgtgaagaataattaataagttaattctatttcttactatatgagacatctctttattttctatccatcgggattgagaaaaaacacttcctttattatgaactaaaattataaagttacttgcaaatagatgtattttgtagcaaataggctatgatctattttaatcacaatagcaatgacaattctagcaggcgtccctttctgcttggttggtcaagcagtcaattacctgtgtcctacttcaaagcttacctgctgcaggctggtccatgacctccatcttcaattttatcattctacagctctaagtagaaatgggatcatccccacgtctccttgcttcacagcagttcgttgattgtcttcaaactgtaaattagttttgcaaattaggttaaaaagttcccaaatattcactctactcttccctctagctattgtcccagttttctctcttctttcatagggttgtagaaggaaggaacctgaccactgcctcagttttctcacaacctactttctcctcaaatacacaaatctagtttccctctctatattctagagagaatgtcctgaccaccaattttgttaaaaaaaaagtttcctgcttgacttttagaattactgtataatccttgtggataatcttcaaaagataatgaattataaagataacataaactatagcctcatagaaataaataccacaagtttcttttttttttctttttggttcttttcactgtctttataaatgtagcaggagcttttttgattgccattaaaatattttggaaaatgttactcaaatgtggcattaatttcattattagtagttgttccttaatttctaattcttcagtatatatggtatatattggtatatagcatatatattgttgcttgtggcctacaagcaagaaggtataccacatatattggaggtataccatatatattgttggtataccatatatattgaaggtataccatgtatattgaaggtataccatatatattgttgcttgtagcctacaagcaagaaggtataccatatatattggagatttttcaatatatatttaatcatacatcattgaccatgtgccatagtgtttttaatcagatagattccaaaaagtagacttactgggtcaaagaatgttggaaattttaaagttgctaataaaaatggtcaaattgttaaaagacacattttacataatttagaatccaattgcattctgagtgctcattttatgactctcttaaaagtattgtttatgttttagacttttgctaatctgatagataaaaataattattgctattgcagtttatgttatttgaatggttaatggaatgagcatgtttattagttattgttataggtttgtctgttaattttgtattcatgcaactttgctgcaaatatttttcctggtttgttgttaaactttaaattttattcataatgtttctgatgagcaaaatctttttataatgtactagaagctttcgacagtaaaatctatcacatctattaatatttgcttctgtactgtctcttcacattttttgccttcactattttcctttttatcctgccacttaactgtgagacattaggcaagtttattcatctttctaaacctcaaatgaaaataatatatatacaaaaggataacagtaaggagtaaataatattctgaagcactcagcagcatctgactcactcagtaattcggattcaaatttatagttatgctcccaatagctttagcatatttatttttaaattcactgctggtcttatactttgtttttactaaatttttagaaattattgtttataatttattattgatatagcaaagctgttaatttgagtattttagcacatattcagacacaatgaaattattaattctactggttttaaaattgagcttttataactttattgtctacacatttaaatgatttgtttcttttttcattgtttgttgtataaattctttgattcttattctgttggatctacttccaaaccagtgtgaaagaattattgttataatgagcatccttgatttgtactttttacttctgagaatgcctttagagtttcatcactaaatttgatagaactatgagttcgagacatttgttattttttctaatttttttagggattcctattgtaaaataattttaattaagtagagttgatacatttcagactttaccaggtttatagaaattatatttctctcaatgatttcccaatgttaatacctatcttaattccttgaatggaccctgtttttagttgtaagcaatttatctttcatgcactagtaattttatcctagtattttacttagtattttcagataagttattttgccttatggttatttttaaccatgtttgccagatgttgctctctgtgttgtcttaattttctaaaacacactaggtagcttttcatcctttccatttctgtaacattttatatgtatcaagaaagaactttaatataaaaaatttaaaaacaaacccttcaatgtctatgagttttgtcctcatttgtatatagttctttaatattttctatttcttctttattgaacaatgaaatatttctcctgtttcttgcattaccttatcttttatgttacataaagttcgatgagatcttaatattaatgtttacaataatatcaactttaatattaaagacaataaattatttaattaactattgctgtcttaatttctacatggatttttatctcttcattgaatttgctacagtttttctgctactctcaaaaagaaacatctattggcattattgatcgatgaccaattctaaggtttctttttttctaattaacttatttcttcttttatctttttggaaatggtttgatatttaagggtccacaatgactaccttgtctccaaatctagtaaccttctgaacgcctaagagcatttctcttattccttgaatatgtctcagctagacctctctggtgaaacactctcctagtttttctgtctactttcactattcctcttcacctgatttcaaacttcttgttttctctcctaatctcaaaagtgggctttctccaaaagcagcctgtaggtcttatttgctttgtagaccctatccaacctcacccaatcacagtcaaaagtcagtaagcctatatcatcatattgacagtcttagtctgtatttctaactataggctgaatatttccattaagaagttaaactctcaaagtgaatttgaactcaaagtgaagtcacaagctttcaaaacaaagcccttgttgtgacttccgtattgctatataatttctattatttctatatatttttatcttgaagttataaaaatcctcattcacttccctgagcttcagaaactaatccacttctgtatttgtagttcacatggtctcacctaagcatctcctctcttccgtatctgacatcagccgagctgacaagcaagccttgtggttaaatggacatccaatcagaaaagtttcagtctcccttaaatatataagtgattctcctgagaccccctctttttcttcttttggatgaaatcctgtcaatatcctatttgggatgaccaataaatggtgcccttttttccttggaagacattggagattttaattaagtaaaatttcttgaatgatgaaatctttgcactattaggtaatgtgtgttaacaggttctcaagaaaaccaaataacatcttgttatatgtgcttcctcacaaaacacagtccaaaacttggaagataatgttactaataatttttttggtagtggagttggtggacacataatatattttttctagcattttatattttctattatgaacttgaattacttttatatgagaaaacaacaccctgcctgtgtgtatttacttttagtatcgtaggacaaacaacattgcttttaacacaaacatacttaattttcaatctgagctctctaatatacagtgtaactagacactattactttatcttctacttcctcatctctacattggtgaagaaataaaaaggtttattccacagaaatgtaaataaggcaacaaattttatccttctactaaggcatagtggcatagtcagagctcatgaaatgttgttgtcacttcagaacaaaaggaagaaaatgttgacagacctctctgtgacttctgagtttaattttatatgatcatttgatagtaactttgtcatgcatttttagatatcgcttctttgtcggtctcagagtgggacttaaatggttcctatcactcttttccaaacaatctactgcttgaagcctaaaaatatccttctgtaggtagatgcagtatgaaatttaaagggtaacccagtctatcattgttggacatttgggttggttccaagtctttgctattgtgaatagtgccacaataaacatacgtgtgcatgtctttatagcagcatgatttataatcctttgggtatatacccagtaatgggatggctgggtcaaatggtatttctagttctagatccctgaggaatcgccacgctgtcttccaccatggttgaagtagtttacagtcccaccaacagtgtaaaagtgttcctgtttctccacatcctctccagcacctgttgtttcctgactttttaatgattgccattctaactggtgtgagatggtatctcattgtggttttgatttgcaattctctgatggccagtgatgatgagcattttttcatgtgtcttttggctgcataaatatcttcttttgagaagtgtctgttcatagccttcacccatttgtcgatggggttgtttgtttttttcttgttaatttgtttgagttcattgtagattctggatgttagccctttgtcagttgagtagattgcaaaaatgttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtctgaatggtattgcctaggttttcttctagggtttttatggttttaggtctaacatttaagtctttaatccatcttgaattaatttttgtataaggtgtaaggaagggatccagtttcagctttctacatatggctatccagttttcccagcaccatttattaaatagggaatcctttgcccatttcttgtttttgtcatgtttgtcaaagatcagatagttgtagatatgtggcattatttctgagggctctgttctgttccattgatctatatctctgttttggtaccagtaccatgctgttttggttactgtagccttgtagtatagtttgaagtcaagtagcgtgatgcctccagctttgttcttttggcttaggattgacttggcaatgtgggctcttttttggttccatatgaactttaaagtagttttttccaattctgttaagaaagtcattcatagcttgatggggatggcattgaaactataaattaccttgggcagtatggccattttcatgatattgattcttcctacccatgagcatggaatgttcttcatgtggcacatatacaccatggaactatgcagccataaaaaatgatgagttcatgtctttgtagggacatggatgaagctggaaaccatcattctcagcaaactatagcaaggacaaaaaaccaaacactgcatgttctcattcataggtgggaattgaacaatgggaaaacatggacacaggaaggggaacatcacacaccggggcctgttgtggggtggggggaggggggagggctagcattaggagatatacctaatgttaaataacgagttaatgggtgcagcacaacaacatggcacatgtatacgtatgtaacaaacctgcacgttgtgcacatgtaccctaaagcttaaagtataatttaaaaaaaaaaggaaattttgagggtaaagccacaggtcaagacagcaaaccacaaatctaatttaaatgcctgagtcattaaattcagtgtgatgctctggataccagcatgctatgccctctgtctatataggaggctgtgtgtgagaaagagaggtttaacaattaaaaagaaagtgcacatttagaaggtatcaaacctgattcagcagtgttacaaaagggacgtgaaacttaacatttatgtttaatttgggcatttaactctactactttccatggtctttgcaaaaataagtttaaggctggcaattacttttttagctcatgatgtcttttcatttggaaattcatttctgggaaagtttgaaagttggctttttggaaaattactttttttttttttttgctacacaaaggtcattcctaaatgtcaaacatcatttggtagttgtttctgtttttttttttaatgtctggaaggatatcttttgagacttgtttttgaggtcaatctagtgtttaagggaagtggaaaattctgatctgtgaaactactgggtttgagaaaaacatagagcactgttacacagaaaaataaagtatttgtatgattcagttgtgacctttttgaatgattaacagattgcaagcctggtaaaagagttcagttctttctcagccatttactaagaataattgagtactgttgtgagaattttattcttttattaagcttggattcagaaaacctttagggtctatagaggacaccaaaattaatgcctttcagtctcagtaatttgtggaatgaatatataaattactgatttttttttctgtgcctcttccagaatgaatctactgtggcctaatattaacacttattaatgcttcattaataatgtatattcatcttctttttttattattttattttattttattttattttattgttattatactttaagttttagggtacatgtgcacaatgtgcaggttagttacatatgtatacatgtgccatgctggtgtgctgcactcattaactcatcatttagcattaggtatatctcctaatgctatccctccccgctccctccaccccacaacagtccccagagtgtgatgctccccttcctgtgtccatgtgttcccattgttcaattcccacctatgagtgagaacatgtggtgtttggtgttttgtccttgcgatagtttactgagaatgatgatttccaatttcatccatgtccctacaaaggacatgaactcatcattttttatggctgcatagtattccatgttgtatatgtgccacatttgcttaatccagtgcctcactcgggaaacacaaggggtcagggagttccctttcctagtcaaagaaaggggtgacagacggcacctggaaaatcaggtcactcccaccctaatactgcgcttttccgatgggcttaaaaaacggcgcaccaggagattatatcctccacctggctcggagggtcctacgcccatggaatctcactgattgctagcacagcagtctaagatcaaactgcaaggcggcagcgaggctgggggaggggcacctgccattgcccaggcttgcttaggtaaataaagcagccaggaagctccaacagctcaaggaggcctgcctgcctctgtaggctccacctctgggggcagggcactgacaaacaaaaagacagcagtaacctcagcagacttaaatgtccctgtctgacagctctgaagagagcagtggttttccaagcacagatggatatctgagaatgggcagactgcctcctcaagtgggtccctgacccctgacccccgagcagcctaactgggaggcaccccccagtaagggcagactgacacctcacacggccgggtactcctctgagacaaaacttccagaggaacgataagacagcaacattcgtggttcacgaaaatccgctgttctgcagccaccgctgctgatacaggcagacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaacctggaaactctaaaaatcagagtgcctctcctcctccaaaggaacacagttcctcaccagcaacggaacaaagctggacggaaaatgactttgacgagttgagagaagaaggcttcagacgatcaaactactccgaactacaggaggaaattcaaatcaaaggcaaagaagttaaaaactttgaaaaaaaattaggtgaatgtataactagaataaccaatacagagaagtgcttaaaggagctgatggagctgaaagccaaggctcaagaactacgtgaagaatgcagaagcctcaggagccgatgcgatcaactggaagaaagggtatcagtgatggaagatgaaatgaaggaaatgaagcgagaagggaagtttagagaaaaaagaataaaaagaaacgaacaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagtgtggaggccaatattcaacattcttaaagaaaagaattttcaacccagaatttcatatccagccaaactaagcttcgtacgtgaaggagaaataaaatactttacagacaagcaaatgctgagagattttgtcaccaccaggcctgccctaaaggagctcctgaaggaagcactaaacatggaaaggaacaaccagtaccagccactgcaaaatcatgccaaattgtaaagaccatcgaggctaggaagaaactgcatgaactaacaagcaaaataaccagctaacatcataatgacaggatcaaattcatcttatttatgttccataaaagaaattttggtagaggcaaaatttcaaaggtatgtggttgttaagggtgaaaatgttagagaggaagcagtatgataccttactcatcattaaagtgattctacctcatgttaatgactccataggattacattctttttaaatgtatcttaatatcaattcacattgtgaggcacttaatctagcatattttgcttcccatagagtatcaaataaaatctacaaaacagttgaaaggaactgacagctaagattataaaaacccagagcatatatttgcctgattctctgttaatcatatttgagccttgctaccataattaacaccatgaagagatgtctgcaaatttagaaaagtaaaggatacaaaggacataaaattagttataatttgaaagaaatcttagtggtcttattaactatatgtccttatacttgagagcatgacttggccatcaatttgacgcaattttttttgagtcccagatccagcacatattagctacgtaatgatggacaagtaacataacctcttgaaacctcatcagcttcataagtaaaatgagaataataataggacctaactcatccagttaggcacttaaataaagtgcctatttcattggaaagaattccagccacatggcaggatgggctgatattaatagacccagagctgttaaaaattcattaaaatgttggataaaatgtaatgacagaaaaaatgagccaagcccaaaagaaagggaaatgtataggtgttcataaaatacaacaggaacaataaaagacaaaatattaagggtacgctggatgatcttaattattttagacagctatatgctctaaatggctaagaattgggatctaagtgttgttgcgtagacaggagagtgtcctcggcctttgtagttttggagaactaaaagcaatccaactatagaaagtctgaggcttcagaaagctgccccatctatcagcagagatctagtaaaactactcagtggcctgggaaacagtgagaagaaagcttgccttctgtctggagctttgagtgggaggggaaaaaaaaaactacccaagaaaaaaaacaaacactggcacataccgcacaggtgtatggtgtgaatttatgctgtcatgattcagtaacctaaaaccaaagaatttactgctatggaagttgtggaaggacttttacagtcaggcattatatgagtttcacaggggaaaagtactgggcaaaatgaacactcaatagaaataaaattaaataaaaaatataaagaaaaataaattaaagaaggaaacagaaaaatatgcagaagaagcagcagatgcaacacaaggagcaaaccaagaactaggaaaaaaccaccttaaataaactgtgaaggagatatgtttaaagttactttcctaaggagttgaaatcattttaaaactatgaataagaaagaatgaataagtaaaaatagaataaacatgagcagattaagaaaaacaggactactaaaaattaaacatacaattactaaaattaaaaattctgtagatgggataaacactaatgtaaaaggaaatgtttgtgaattggaagatatatctgaggaaatcacctagaataaagtgagtaaagttaatattatgagattgttcaatgaaaataatctttctccttcccctctctctcctctctctttcttttctctcacccttccaaagtacttttcagttgcttaccaggcaaaagatacagtaatggacagttaatattcctactcctgtgaagctcacagttcagtggtttggtggatacagcaatttattaaaacaaatgaacaaaaaccaaacaaaacacaggttgatgagttctttgcaaataattaaaatttggtcttacgaaatcactgtataagtactttgtatttgatagtcgggaagggtctcttgaaaggggtgaaattttaggttagataagaatgacaagacaatctgtcaagcacaattagtttttcagttgaaaaaaatcaattcgtgcagaggagaaatgagctatgcatgttgcagaaacgaaaaggaggccagtatggttagagcatggtatgaaagatgcaagatggtcttgaaggtgtaggctggggcagattctactgggctttttcatacgagacagggtaaagagtttggattctattctaaatactgagaagtcataaaaggactttatatatgttttaccttgtaaaggatctgtccctgtgctatgtggagaattctcagcagcagaaatgctgggggttgggcggtggtatgatgtgagcagttaggagaccattacattggtccaagtgatagaggctactgggatttggactggagtggtagaggcatcagctctaccactgattttacagatttggaaaagctttggatagggatatgatgggaatttaaaattgacaggacatggagttgggagaaagataagaatcacagtcaattccaggaatcatagataaatccatgtaagaattatgtctacaatattcattagtcacacagccaccatttaagcacttccagtgatcaaaggcttggtaggtacctcgtgtggccactcattccttttcatgcatcccaaatcattagaaagttcttcctatggatttgacctacttttccttataaacaatatagttgcctaaacaatatagttgatttatttgtaatctttcttctacatgataagtttctaaatatttgaagataattactattttttttcctgaagttttcttgtttcaagttaaaaaatctcagttcctgatttctgttagaatctatgtgtatgtagcttagggtactaataactcaatattgaagtttgattgtttggatttgtcctagttttcttactggattttattctctaaagtgccttatccattgggcactcaaaaattatttccaaaataaaaattaaactaatctctttttttgaaacaatcttcactctccttctcacctttttaatgttctgagcacctttctttgcacacattttactttatcaatatgcctcttaaaaaataaagaccactactaattgatatgcaattcaaaagttctgaattccatgcttcaaaaatgcaatcaaaaattaaatttaggtttggtatagctatcttacaatgttgactcattaaactttggttatcaaataaccaatgcaatcattttaatataacttattttaagtcaattgtatccccactaggaggatatactcttatacaattttctgccaaagaaataataatctacagaatatacagattcatagagggattttaattactggaaaaatgtcaggtaaaacatttttttaagaaactaaaacacaatggaaaacatttttccttcagagaagcaaaattgtaatgacttctacttacttcttgatgaaaaagttcattataattggataattagtgctaatgtctcctgtaaaggttgggatgttgggggaagaaaaacctgttaagatggaatagggaataatttgacatgtaagagatgccgtccctaacccccttgcccatccttggccacttggtcaccagccttgtagaagcacagtcatatgatgatgagcaaactattctggactccttgctagatcatgttagtgttctcatattgttctgaaaatacaaaatcactggaaggaccatgtttaatggatattactaatatgcaatacccagatacaagtaaaagaatgtgaatttataaccctagcattgtcatcaaggtgctcccaaattctctagccttccaagaacttatctttaatttagtataaatttttaaacacacacttggcttacctttaacataatttagagctagaaattcaacatcctcttaatatttctaaagattctttgaggcaggggttgcatacatttctgcctgtccactcatccacttatttcatccgtattatcaataactgctttgcattttccttctggggctattttctttattctgtctcccttttcaacctcaacatgaaaccaagcttttttttctttaatcccttccttttaagtatctctaatgcaggttaagtaggcatttaataaaagttggatggagtagagagggattatattttaccgcagcgtagtatttatttctatctaaatatcactattattaataatttatttttcaattccttccacaatgaatttttcagtttttttcctctggtctcattttcccaccatttttctggacatgtctttttttattcctctcccaagacttcttagcctcactctccttctctattgtccacagtgagcctcaccttctctctctggaagcctcagtaaactttaattattactctgcaattatgtaaagtatatgtctattctatagccagtaacttttcaagccggcgtcctatctttatataaccaaatgggttcagcacaatattttgataagcctaaaacagctttctgcagtatttctgctcaaattatttttaattttatatttatttattcatcaaatatttattttgggcactgtgtgtttgttaaaaagaaatgcgaaatgtacagcaaggagtagggtctcctaagggaaatgattatttcttttaataaatgctgttagcaaaatatttatgaggcacttagtgtaggtggcctgcaaaatgtatattggccgatgagagtgagagggtgacagttatttgcctaaaagccatacctgatcctgtaggaatgagtgagatttctggggaagagaatgttgaggcagaacctaagggaaaaactcacatttagaggatgaagagtcactaaggcaatgaaagagacagaaaagcagaaaaaaggaggaagaaaattaaaatcctgtcagccttgaaagccaaggaaggtgagcatttcaagaacggttgtgggatggggagggcgggataatgtcaaatcctgaaagaatcatgatgaacgtgacagttcttaaaaggcaattgactttcaagagagcagtttcattcaaggcaggaggtttgaagtcagattatctgacattattgggtgagtgggaagagaggaattagaggatactcttttgagaggtttctgtaacaagaaagtattgttcagagaatgaaatgggaaattatatattttgcagttaccctttattaatcaagaatcaggggctcaattatcatagagaaaattattggaatgtgagggggttgagatggaagcagagtacagctggcggtaactcagagcatccaaaacaaacgtggaagaaaataaattagaaagttagctaaggaggaaaacattcaatgtgctctgctagatagctggtccttgtactgaaggggaacacagagtaccaagtaaacgaaatgaaaaacacgaatatctagacacactgataaaatttcaaagctccaaagataaaaagtcctaaaaagcgggggccaggtgcggtggctcacgcctgtaatcctatcactttgggaggccgaggcaggtggatcacctgaggtcaggagttccacaccatcctggctaacatggtgaaaccccatttctactaaaaatacaaaaaattagccgggcgtggtggtgggctctgtggtcccagctactccggaggctgaggcaggagaatgacgtgaacccgggaggcggagcttgcagtgagccgagatccgccattgcactccagcctcggcgacagagactctgtatcaaaaaaaaaaaaaaaaaaaaaaaaagtcctaaaaatcttccaggtatagaagtcgttctcttataagaagactcgtgggcaacactggatactacgagtgagtagagaagtatcttcaaagtttaatgagaaaaaaaacttaaccctaaatttctaaggcttgccagactaacgttcaagcgtgtcagggtgaggtaaatcaactttggcccattctctgtgaaagaatatattgaacaaaatgataaatgaatccaaaaaagaagacaaatgaagaaactaaaaaaaaatctaatagttaaatctaaattattaaagcacaatgtacaaatgtaatggtttggtaatacatgacaaatggatgtaaaggaagaaagggaagtgatagcagacccaaattattgtcttggttggaaaagcctatagatgctgattaattaaagagattgacagatttttaaaaatacgctttatgtatatgtaaaaaattagggtataacacttttaaataattaaattaggatatctcgagaaaaaagtagcaatggcaattcctatcaatccaaaaaaaattaggaaaaggcaaaaaataaacagcaagaaaacatggtaaagacaaactctaaaataagacagaagagaaatgttcaacatcgtaataaatataataaatgtgagtgggtttaattccctattaaaaggaagagggtcagatgggatttttaaaatccgactatatatgttatgtaaaagatacatgcttgaagcaaaatgacactaaggggctgaaaataaaatacagaaaaagatgtagcagacaagtgtatcaacaaggcaggaataataatatcagacaaaattggagtaacatgaaaagcacaaatcagaatgaagagagatgttgtatgttgatagaaatcaaatagattcagatgaagaagagttaacgtctgccctgccaacactacgtgtactgaaatatgtcaggattaaacactaaacacttcggtggggggtgtggaatgtggcaatatctaacaaaatttaaattgtgattcctcacagcaaaaccactttaggagaccctcttcaagtagaaaaatctttgaagacaacatatatgtctagcaatagggaaatataagggaatgatgtagttcaagtacatttatatcttcttgggcagttttaaaaaataaaaataataaaatatataatataagaatagaaggatagactgataaaggacagatattatcttctgaggtatagagagactagattggttcataacaaaaaaaaatctattaaaattaaaaagagagaaaactgtaagcataatacaaagaccagtaagaccgcaatatcgtttgtgtcgtagtgacgtggcttttgtgtccacagttttaatttaaatggtgctttaaaacaaattttgtggaataataaaatggatgagatacgcacttggttttatatgaagtactctatgaatgaaaaactaaattaaaagttagttataagagaaatgtatatataactactgctaaccttcctaaagcactggcttgttaatttaattttcattcaatatttcataagccttttatatcagactagggataacaataatgtttttctatgaaaaacaagatttttgtctgctatgttcacagctacatctccagtgctgagaatcctgtgtggaatgtaatgggtgctcatttaatgtttgttgaatgagtgaaatgtattcattcccaaatgcctttgataaaattcccccttataaaaaaatttctgtctcatgtggatgccagctacagcatagatgtactttttaaaataagtattaggcaatctgagatttcacatgcaaggtaaaccttgatttaatgcttagatgtggatcgaaataacttcaaccttgaatgatttgagaaaatgtcttgaggaaacgaaacaactcttatgttactcagactcgtgcatgtgcacacattcgtgtacagacctgttcatcgagcttgaccaggtcttctacaactcttggtctgctgggagatagcctatatgttcatgaatcaactttcaatctgagaaaaaaatgtaattttagagtataaggagaccttagagatcatgttcccggtatctccttttgcaggaggaggaaacaggtgcagggaatttaaggcgtgatgccctgaagtatgagctgcatctcctgattgcttatttatttttccacccctccacgttgagccttaaccttcatcccagttaaaatggtcttaactatctttagtatgtaaagcacagctttgaaaatgctaattatttgtagatctctctatagaataccacttgtcccttagtataataacgactgatgaaaacaagctcaaagattagttaattgattaaaggaatttttacgtagtagaaaaatactgaaaatattttccatgatcttagttcatttctgaaaaataagctaaaaggttaagggaatagttaagatggaattagagttattttagaaattataaacgctatatacatgtcttagtagaatcattcttattaagaaagtcaggtttgatacttttcattaaatgtgtataaaagatactattttaagttaaaactttttgtaataaactaaaatatagtggtagataaatggtaaaacatgaccagaactactttggtatttctagattctcttttaataaagcatttttatatcaatataataggtaaagtaaaaatatgtaaaagacagaagaaacccttctcccttacctccacgtacaaaaagtaagccttgagatctttcaactcaattgattgtaattcaagtacaataaagatgtaccagaattacctaaataccagtgttttatgaaaaaagaagacatttcatactccacttatatttttttggtcaagcaaccattaatcaaatctttaaccttcaattgtagggtagcatttattttgtgctaataatatattaataatgtaccaatagtagtactataaaataatgtacaaattattttatggaatattttaagttatttcagtaaatatgtatacagtgatattgctttaagttaaattattctacactgcactgttataataaatgataatgagctttggtgaatttaaaagtacaatactggacttttaagagaattgtccatccttttggtagcccctattaaaatcttctctgaagacagagtgtgcatgtcagaaagtttggcagaaaagcaaccaagccatgttctagtttggaaaatatagaaataaccatccagggacaattcagtttactttcttatatttctgactttctaagatcttgtcaagaaacacattagcaacaaggttattacaattgtatgctgtaagagttttagtctgctgtaaaggtgttaacaattatagtaaatcatcttattttgccactggtatgctaatgtgctaaattaaggtctgaaacaaatcgacaacaaaaaatatccaactgctagtactactgaaagtagaattgtatttgtcgtttatgtgcttctcatcaccaacaaataaaacatatttttaagcaaactattactgctgatttataagaattcagtagttgtctcagaaagagatattaacattcaattgcataatggataagaaataacaaataattcctgcctgattacacacattgatgaattcttgcatggaagagtgtgtccagcttactaacatttcctggatggcaaacagaataaatataaaaataatgatttaagggtttatcctctgaatttcctggaaacattctcataaaatatttcattacataatcttcaaacaaatgtttgaggagttccaaaagaaaatctattatatgtaattatttcatcatttttacttggagtaatgttaaataaatacagcattattgtctaaatataccgaatatatttggtaatcacttctacaaaatgttataagtaacataatgtaacaacattgaaaactcttgaacatttttaacttttctataaacatattagcagtgtgccctttgactatttcatgttttatccatttttagaagtgccctaaaattactcatttgcttaacagagttacgcccagctacccaacgaaatcatttctgtcgaagtatttcggaaagcaagtttcattttgttactgtaagaaatagcattttgggccctgtagccacatatctagctttgggaatggaaccaagaaataataagaaagagcatcagttaatctcttaaatgttaatgatatatttatcagatttctactatttttaatattgattaatcttattttatgtaaatatatcccaatatttattaatttattatataactgtcattattgaattttgtagaagttttcttccctcatctattgtgttttttatggttctatggggaaatgaaattagtatatttataatcagtagtaaaatatccgtttaaaaattgtattcagttcatgctaactgtagaaatgtttttgattatataaactccagtcttttctcctatcctctctatcttttcacagaacacttggctatataggtactaaaaaatatcaaatgagagaatacaatttttaaatctgataacatttttaaacactattaaaatcaaggcaaactcttacaaattagaaagataccaaaatcctgacaatctgggctgctcttcactatcaaaatatctcccaactacagtatgcaggaaatattttcatgcaaagtcactgtgccacttctgtttctaaatgaccaaatttaataatttatattcctgcctaaatatgagcctataaggcattaaatctaataacatttttcagaaaatatatgggtgcttctcaacagaatttacttgcctaccataccttaagccagtcagatgatggaatctttcacctgtcagcaaatcatattttaatattctttcttgttaggttgtgataaatgagataccacttctaatgtaagattgtatggcttgaaagatttaattgtatttctctttggcgacatattaaaagattatttttattttctctttggagacaaattagcaagtcattgtagttgagggcattccagtatttaggaaatttatataaaaaatgagtctcaaatgtagctcaataatattttgattataatagttttatatatttcaaaggatcaggccatgtataatggatttccttgaactatgagctttagaatatcagaagccatttctgattcatctttataactttggttcctaagacactaattaataaatgtttatttaaaaaataaagctttgtttcaggacagtgacacttaattttcaaatgaagcagtatttcaattattttaataataacctgaatatttatggataataaccttattgacagcaggaattttgaccatcataatcatacataactaattttcaagtacttcacagataattttgtttttctccccattgaactaagcaagttaaagaaatggttctcgacatctagaaacttgcactttggagaaacaattcctaatgcaaaatttgtttgtttgataaataaatattgaacttcagttatgtccaaagcaggaggtgattttaaaattcataagtaaaacttccttttccttagaagtttttaatctgctaggaagagtaagacaatctaataattataatgaaagtccatttttaattcaaagccaagaaaaatggaagttaaggaaggcagaggttgtttatgtttagttaatgaggagacagttcatggaggtggtgccatttgaattaggcttggtgagagatttacttgcaggcatcactagaaaagcaggtgttttaagtttaggaaaatgtaagaaacggtgcagtggttttacgaatcccatagcaacaagtagtccactttggccacacaatgtaagtaggacgtaactcaaaaagtttattgagaagcaataatggcctaggtgaggatgacttcagtggacacgtaaacaaaagataactaacaatgtgaagtagtatttccattgctagatagattacagtaatgactcttatctcctcatctatcgatgtgcttgtctgtatgtttaaaaatacacatggtaaaataagaaacggatatgtgtttgtgttttaactttttaatgaattcgatttcacattattatgacctttaatttccagacaaaaactttataactgataattgactatcaaaagtcaaattttaagtctatttgttttttaatgatctacttacatattcctggatgggggaagaaatgacataaaattgtactgaaggaaattatttttaaaatttttctttcatgtaactttgattgtatctgacttccagagcctattgctttttagcaagaagcacagtgaaagattgagaaaatgtgcctaaacatggcagtcatctctaatcatttgggttttatacatgaacatagttatttacccaccacttcattgataacatcaacataaagatataggaaataaccctgtatattcataaaccatgtaccatgtgtacatacataatgttatgctatacattatttcatttgatttcataacttgctttccattgctttcaccaaagcagatcatctttttatttggttatgttctttttctcgtgtaactaatgtaatatattatctttgccaactaagaatcatttgaatatgaatcaaccacccatgaagaatttatattattcagaaagcctactatgctaaaagtttacctcaacccacattcaccacataaaataatagcaaaaataattggtttttcctaagtttggatgatccaattggcctaaatttttattaaaagtgaagaagataatgccatcttgaaagacagcacaaatgtttttaaaataccccattgcaaggtatggagagaaccataacattatctgttaaatcttactgttaatagcaactctaaaacaaagaagatttttattttgaaacatgggacgtaaactttggcagaagaaacacacttggttaggtaatagtttatatatttcaattacaaatttgaattaagtctagaacaatggatgtggaatattcaaaaaaataccaccatagtgttgttttcccatctgaaaaaaaagaatgaatttttaatatcttctctcttatgaggaatttagttacatcaggacctcatattaattcttattttttcaaaataatttttcagatacattatattgttgtacaacaataatcaacaattccaattcaaacttctgattatgtaataagtttgtaatcaagttcataaactattgaagaatttcttatcgcaaatattgtgacatgataaactatcagcactagtattcatataacattgattattgataagtggaaataactacggtgtaggatattgaaatttaatttctaggatattgaaatttaatttgcattacacatattttaagagatgtaaatcacattccaactaacaatataaaatgatttacttaaattcgttctattctttaaaaaaatgaacacttcaacttgttttaaacttaagaaagtgttaaaaattgaatgtgacacttttaaaatcatcccaaggctggccatggtggctcctacctgcaatcccaacaatttgggaagcagaggtgggaggatcccttgaggccaggagtttgagatcagtctgggaaagatagtgagacctgctccaacaacaacaacaaaaactaaaattagctaggcatggtggatggtgcttgttgtcttagctacttgggaggctgaggcaagggagaggatcacttgagcccaggcgttcaagtttacagtgagctatgattgcaccactgcacttcagcctgggtgacagaccaagacccacggacatactcagaccttctaaatttcaagttcatagtctctattaaaaataaaccattttccttagaagagagatttcagcctattatcatgctgccactgagttgaagaattaccttctaccagaacaggttatacagttatttactacataattaatttgtaggcatgaaataatcttttcagcattctttgcctgctcagtgccaaaattaccttagtgtgagcatcagagcccccagatgacttatgtaaacctgtactctgacataaatgctgaaaacaatagacatacccgcaacttaaaatacaaattcaagaggaaataaggtgaagcatactgttgataaaaaattactactaaattccggtgctatttcatatccagaaacattctaattgcatataatatttgaaaatattggatagtcagtctagatataaaattcctaaattgttcattttcaaaattgttaaatgagtgattagatacttcttatggcctggcaaaacatggtttagacaccacatacagcacacataactgaatggaatgaaaggatgttggcggtaatggaaaatagtgatggattttacaaggtcaaacccactgacattttgttattgataagcagaatcagctacagtgtaggatattgccgaattctaagcaaatgaatttttaaaatatattacatagaagctattcttttacattttctgccttggatattttctcacctgacaaaaacaaacacacatttagatttctcagatttctcagaggatgttcttttgagtagattatctgtaaaaaatttctgacacatcagtcaggtgtcatggtttaatttttatgtgaggatttggtaggacagatgaaaatgtgtgctagtcttttctccttccatacaagaattggtagaattagtgcttacaagatacacagcttaattacactatctgcagtgtcactggaacacacttcacccagtcatctttgtcatgtttaagagacctggacttaagggcctagtagttttcttgatgtaaaagatagcagcacaatttcttgcccctcagtattcccttcccatatctaaactcctatgagacagaaccaacaactattccatatattaggctctgattttagtaaaaccacttttcagtcacagttcaataagcacagatctcttgcagaattctaagaatatgaatttttaaaaatatgttatatggaaggtattcttttactcaactaatttttttctttcttccatttgttcccgaattagtaccagacattttttttctgcctttcttgaaagttctactatcaaataatcaaataacagaaggctagaaacaataaattttataaatataacttttaaaagagaaaatattctcttacatgtgattagaaaaggggggaggaattaattggggcagggaaggaaataatgagaatgaacaatgccactatattccatgagcctttgagaacaccaagggcaacctcatctttggatgaaaaaaaaaaaaaaggtagtctattaagtgactgggtttaccttagaaaatataagttacaggactgagtaatctagtaacaagaaaactgctgacaaacttctgggggtgattgttgtttagcaaagaagcagatgcaactaagtcaggattctctctctaaaaaaacaacagttaacactgtggttgtatttttttcttatgtgttacttcaaaaccttatcagaaaagagtacagtatctctgttaagttcacttaaaatctgttgtgtcattttattgactattactgttttttgaaatcttgttcatgtttataggttttctgacttgagtttagagatattccaagcagattagcctagcaagtttagaattgtgaatttaataattatcttctaggtatgtataggaacatattgcatgagacagtaatgtaatttgtgagaaatgtctacacacaagctttcatatacctttattctgtctttagaatttggaatgatgggagatcatacaattaaaagtcagcgacctcgatctgttcatgaaaaaagggtccctcaggaacaagctgatgctgctaaatttatggcacaaactggtaatacgttagttacatttttctatttattgttgttaatttaatgaaaccactgcatgttttcataatcttttgctgcacatttgtcagtttttggagctgatattttttcgagccattttttttgtcaccagttaaagtccataaataaagtagctgtgaattgaaaagtgcacaaaaattatgtaagaattattttgctttcagtatgggacatttaggatttacatagtagcatttatgctaattaactacttaaaatgtatcattaaacttttaaagaaagacagccaaagttatttcttcaataattgattgacataagactttcaaaaattagaactttaaatgactctagacaatgaaatttattttaacaatattgaatatattgaattttttcaagtatgatcctacttgtattaattattgttaaaatgcacagaaaatataaacttttaaaaaatttaataatttttatttgaaaagagttttgttatataagctaaataataaaaagttgaaagtgttaagtaaggtgtaacacactccatctaattaaataccaacctaaactgactttctactttataaaatgtttaattctaaattaattagattacttttaaaaacctccctccaaatatatctgtaaatatttggagtatgtataatttatgcccattatttagttacagaatttgaactaatatatgtattcatattttttcttatcacaataaatggtctaatttcatctgagtacattgcatgtagtacatccttaaaaagtgtttcaactttgttatgtaaattttcaattgtcacctttattttgggaaattgaaagctaacagttttatctatgtcttaaaaaattgtatacatctcaatgttttgccattaatacagaagtttcaagtacatgaccagtttcctgacatgacatttagactgatagtgatgaaattcccccaagaaatgaatatttccttcagttcacatgttcttaagataatagtttttagaacagtagatctgaatctacagtataaaaatgcaaatattgttaatgagttttgctcttaataaggggtgagtagaagattttgatacattagttgagttgtaaggaggtcaaattttcagaacaagaagtttaaaataaattttacaaggattcacttttagtttttttgagatatatattgcaaccaaatacagaaatgtagaaacttgcttatctggatccctttttgtgcactttcttgtttaagaaaaattgatttttatttttactatttgtttgaacaagtctaaaagtgcattatcaggtttaggcaaatttccaaatttctaaatgtatttctctcctttacagggagcaaaaagtctcaaccactgagcagagattagagacattaagtcaaggcacacgggcatgggctgactactcatctttgtcggcaccatctaatgggggcatttctgcaagattaaaaaaggtgtattttatttgtgcaaaagagatggcaggcattggtttactgaagttcctaaaaattggagtcaataggaagtgaaatggaaaatgatagttttaaatttccaatagcgtaacatgattagtttatgtgtaaatattatgcaatttagccaaaagtttttgtacaagttttttttatttgtctgtgacatagttcaattcacagttttcagccaaaacccttttggtaaattcaaatttcaaggaacattgtgttttcctagtaaggaattactaatttcaaaatgatgaataataaatatttattcttttattttaaccaaatatagtatagacaaacataaatacatgtataagacttttaacagaagacaattataatgtgaaaaagagaagaatatttttccttaaatattttcctagattatacttttttaaggtgttaaggtagtctgaataaatacaggtaagtgtcacacaataaaattttacaaaaattaagctttacttataaaagtgttccctgtatttgtctttaagccagaaaaaagactgtaacatataaataatataaaatttgttaacagtaatttgagaacaaagaataaggcaaaaacatacatttaaataataataaaagacaatatatttttatattaatcatggagaaaaaagcaaaggctatcacactttaatatttaagaattacttctcaaaatgagtaaactggcctcttcaatcaatatgatcagtaaaagattgtaattaaaagcaatctttctacagagtgataaagtgagtgtgacttttttaaaaagagtaacatttgataaagtagcatagtttggatataaatgatggtgctctaatagcctatcatgcaatctttatttattattaaggaatataaaattaaatgatatcatataatatatatatttaatatagacatctaaattaaatgccaataagatggcttaagatatcctagttacattttcttatgcttaagcatcatagtcatcaattaatttataaacatgtttagaaaagcagtctttcattaccgtgaggaaaatagcctaaatttggactatgtagcattttatctaaaattttaaaaaataaaattaggctgggtgcagtggctcatgcctgcaatcctagcactttgtcatttacaaggcgggtgaattacctgaggtgggagttcaagaccagcctgaccatcatggtgaaaccccgtctctactaaaaatacgaaaaattagctgggtgtggtggcgcacacctgtaatctcagctactcaggaggctgaggcagtagaatctcttgaatcaaggaggcagaggttgcagtgagccaagatcacaccattgcacttcagcctggactatagagtgagacttcgtctcaataagtaaataaatgaataaataaataaaattaaaagtacatttctaatttcatgactttaagataatagcaaaagtttatattaatattttgttcataatttaaaatgcattctcacatattatctcactcaatcttcacagattttgaagtaaatataatattcattttatcgaagacattcaaagaaataaaatgactttctcaaggtcacagagctattattcagtagatttccatcaatcacaggtcttctgactttaattgcaatgcttttccagtttccttttgtgtttcatgctagactaaagagcttttagttcatactatctccaaagatacatatattaaaaacagtatactttgtcttatagtttactattttaatgtcattgaatatttttaacatctttcttataatgtatattagttattctcacaatggcctaatgtgcttgactagaatgttcttcatacttttataaataaggaagtggcagcagggaaaaaagaagtatttagtggaaatgtcactgaaactatgggatttgagttataacaagaacattttgataggtaggccactatttcactggcaaaattttaattcaaaatctgaaagccaatgttttatttatttacttagtttatttttgatcaatgaagagagaggaagagtgacaagaccaattctgagcattcattatcaaactctcatgatccagtcaccactgcttagcctgttcagcatcattgcagtatcatacattcagaagcaacccaaatgtttaaatacttgtacgaaagtaatttaaatatagggcttgatctgaattcactgctcagtttagttaaattatgttttctgtcattatgacagtgcaagaggaaaaggactgcttttatggtaaaatagaactaattttattcataacctttatcatttcacttatagaatccacattgttcataattttctgacttttaattaataacatgcaaccataatatttatacctcacttaatctcatcatagttcagaacatcattttaaaaagtgtattatattttccctaacttcagcttaaattttctattgctaaatttacatgcacatatacacatatatgtggattttttaactattatccttctatttggtttatagaataatgattttcaatcttgatagagtattctttaatgtaaaagaacaaattatgaagcatggctttaactgttattcaaatagtcatccaaggacatttttatgaaattagcaatatataaatttgtgaagaaaaaaattctgaattgatgaagggttatctatacattattttcaagtcacattgatcacaacactgaaaagcagtcccatttgatgtaatctgtcatcccagttactattgtctgtgcccttacaatatatgtccagttataaacagatggtcatctatgcctcttggtgcatgatgcagaacaatataagagcaaatgcgtcataatggtactactcaaagtgtggttagtggatcagtgtttgtccgcaaactggccgttatggtctctcaaaggaataagcagtttacatcagaatgtaaaaccaactacttcatcaagcacaggttttatttaagctgacatttcatttttagaacaaatttctcactgagaaaatctgtgtgttgaattacattctggcccaaactccttcttccctagagcactagtttgtggaccagctgccttgagtagcactgcaaataattttcaagtcatttactaactctctagaaaacgatggacaaatacatgatcatattctatcctttgaattctattccaaaggcaaattataaacagaaacataaaatattgttaaattgctctttgatctactaatcagtgatacaaagttttcagaaacatttcacctacaaattttttttcaatgactaaatggttaacttaagtagttaactgctagcagctaaatgatccagtgtgactttggagaaaacaactgcaaattttccaatcaatttttaaaattcatcctgaacatgatgccatgacagaagtgtatttcgttggtcatagaaatgtttgacttttgagtctccttgagacataataaaagaaattcgacatagttttattgagatgctaactccaagaaaattaatgaatttagacattcattagctttttagaactccattttaaataaattttaattccatatcaaattaatgaaaattatcaagaaatttttctttattttgagttaaaaaatcactactctagatcataggtgaaattgttagcagaaggatttaaataaattaccacaaaataaacagctatcatagtatgaaaaagtaggaactgcactagtaataaactataaatatcagtactcaatacaatataaattagatgcgtccaagctcccaggtttccacatcatctagcattagaaagggtgttatgcaataaaggactaaggaggaacacatcaatatattcctgccgccaaagccatagagtaagcttagaaatatattttgcttccttttccatcaaaatacaaagtcttagattaatttgaagagaatcacctcaacaaatagtcacattgaaaaatgctcattagttccttcatagtgtccatggtacagtgtaatttgtgaagagtattttgctaataaggttatggcaaaacttggtgtttgcatcagcattatatgcattcgtctttaaacttcattttctctgaaatgttttcatgtaccttttgatgtatggtcatatttttacatttaaattattcttgcatgtcataatgtcagtttggtataatgcttactagatgaatacttaagacagtatttcatgtttatttgttgtcttgcacgcaggtgaatctggtgtggaagagtggtcccagtggagcacatgttcggttacttgtggtcaagggtcgcaggtgcgaaccagaacttgtgtatcaccttacgggacacactgcagcggcccattaagagaatcaagggtttgcaataacactgccctctgtccaggtagtgttagcagcaactacaactgtggatgttattgaattgtgtcatgctacgcatttggaacgatttgttattttcatatgaaacgggtataggcattttgattagagtggataagtgtaattattattcaactgtaatattttaagatgtctgtgattatttctgcttttaaagcagtcagcaaattaggtaaatggctcctttcttcactgcaaatatcagtttctaatctgtgtgtatctacttctaataatatttaaggttcaattatctttctgtgttttagatggtgaaaatgttcaattgaatgcttgaggaaaaatgtaatctgcctacatactaaaaatataatgtatattcatggcttaaggcagtggttgacatagtctgtcaggcagtcagcagtttttctatcacttatctgaccctatcaaagaaaagagtgtccctgaccaaataacttcttggtattttatttcattaaagtaactttcatcatcagaggtatccgctgctttgtaaacttaaattaaacttaatgaagagagagagagagagagagagatctttaatgttaaatgaagcataacaatagcatgcccacttagtgtcagattttccatgttacatcacaattttgttcttcagttgatgcacgcatgcatattatagacatttctccctcccagactacagactttcatgtaaaaataagtaataataggactctgggctttgtttccagaagttcaaagcacatgatgttgtgaatctccagatttatctttttgtctaaccatttatgtggtggatgggtgactataaacatattgacagctgcagttgacagtggacttgcattcacagcctttccagggacctccaaaaggggatgggtgtaaagaaagtgacttgcactgcggcagcctttcatctgctagcttgtgcttagaagtttctcattaagttccatttctagagatggctgactccacagttgctaaaagcaagaatagagagtgggtggcacggagtaagaacaggaataatgtcagttttccagcagaatatgcaaaggggtccattaaaagacagtctgagagagttgttaatgggtgtagagtttcagatttgcaaaatgaaaaagtctgaatatctgtttcacaacattatgaatataggtaatactactaagctgtacactaaaaattgattagatggtaaattttacattatatgctttttatcacaataaaaaaggacagtgtggaggaaataaaaagtaaagagagtggtgggcagaaggtggaggaatgatgcaatgaggtgggcgatccctttagaatagaattgggaggttaacaaagcagtagatgaagtagaattaaaagctaagcagggcagaaaactgaaacctatgaggaaagaaaggcagaattaactggcaaagagtaataattgccactaagaacaagaaaaatcagtgaggctcagtggaaatcaaactagagcaagaaaaaagcatgaagtaaaaacaaaaaaagattcacaagaaaaaatgtttaaggagtttgtgaaagggggaagatgaaaaatatgattaaaaacagaattcatagagcagacagattctaggtacatttggcaacagaagaaaaacaagtagaagtaaggaccaggggattctattttattttattttttaaactggcaggtaacatgtatgtttttatcttgtataacatgatattttgaggtatatatatatatatatatatatatatatatgttgtgaaatggttaaatctaactaattaacaaatatattactgcatatagttatcatttttgtgctgagaacatttaacatccactctctctacattttttaagaatgcaatatatagtcattaaccatagtcaccatgcggtataatagatctcttgaatttattcctcctagataactgtgattacatatcatttgaccaacatgttttagaaatgaaatcttcataccacaagggtagatacttattttcatttgggtgtgggtacagtgggttttctgggaagaatacttaaaactgttccctacttacagtattgaaataaggagatccaggatcaagttttatgtccttgacaatgagaaaaatgtcaataaagaattatgctgtacttgaaatataaatttatctaatcagcctgtgtttgaatagccaagaccctttcaacatacagggatagtattatggcaaatggatctccaaatgtgagtctgagtggattggaaagtgttctcaaaaattttccattcagagtctacttcccagccactagttatgcacatttataaggatgacatatgaaagttgccttccttctaccagagaccactgattaatgccttcacagagaacatctgtggtgggatcagagcgcttctcccccacagaactgccaaatccacctttgcactgtgtccgatgtccagaaggctaatattccataacttaaagatttttaaattaaagtttttcgtccccatttatgcctgaggtagcaattttttgaatttgaaaaatcagatcttggtgatgaccttgagcagtagaatataaataactcccacatgcttagtgttccaataatggaacactaggcataagtgactcaaaccttttacccttacacctacagaactgcataccaattactagcccctcttcacctttatatgcatgaagtctttttccttctaaatttgattaagtagtaccattgagaagaagtttatcttttaatcattgttttagttcagaatgttgaagtaaagaaaatgagaaaagttttatttatttttaattttccaaacataaaggataatttagcaaactaaaaatatagaataagtgccccactataagaattggaattttttcatctggttatggtatttgttatgaaatattttgtgctcaaatattttatgttattatttgttgtgcaggtaaatatgtacttactttgcaatctaacatatcctgaaaatagtgacaaaaagtgactttttaaaatgtaatgttttaaacaatagaaatgtcttcctaaaataataaattcctaagaataaaattaactcagaaatcagtaactgatttgtcacattttggacactcaaatgtatttggcatttaattaatgaaaatgacacaataaatgaacaaattgaatattaaagtcactttccacaaaatgtgtggagttatagaattagaagttatatttatttgtactataaaatctaatcaatagtgttataaattagtgaccattcacccatattcaaatttcagaagtctgccttaattaaattatgcaatatgttacttcaatatggatcctaaggtatttgacatttagcagaatttttgctttgacattgtactctcttcaaaagcctttattactcaaagtaaaaaacaatggacataaacaaagaaaattgagaaaaatagagcgctactttcaatagcacaatttattgccctagttgaattttatggtttattccagggcttctcaacctcattactactgacattttgaccccaataagtctttgttgggggagtccatcctgtgtatttttttaatgtttaacagcatacctggcctttactcattagatgccagtagccccccgctttcccccaagttgtgacaaccaaatatgtctctagtcattgccaaatgtcacctggggaacaaaactgccactggctgagagccactggtgtactctttatgtactttaatcctgtagcagaagtttctgcaggctaaggaatgcttttgaactttttttttttttttttttttgctaaatgtatagttcttatattcatttatttcttaaaaaataaaacctagccgggtgcggtggctcacgcctgtaatcccagcactttgggaggcggaggcaggaggatcacctgaagtagagaccagcctggctaacatggtgaaaccccgtctccagtaaaaatacaaaaattagccagacgtggtgccgcgcgcctgtaatcccggctagtcaggaggctgaggcacgagaatcacttgaacctgagaggcagagattgcagtgagccgagatcgtgccactgcactccagcctgggcgagagtgagactccgtctcaaaataaaataaataaaatgaaacctttcacttattttatgtacagctcaatctaaatcacgagaaaatttatatatgtttgtttcaaaatatggttgaatatattttgtgtatggcatattcttcatttcgtctctagttatcacaaaaagacatataataatacagctaatgcctaagctaaggaggaaaactataaaaatgaaggaatttcatttaaatatattggttttattaggatcattttaaatgaactagaccatttatagattctcatgttttgctgcaaaattaaaaaatatataacaatttgccattaaaataaaaatgtctaatctttaacattggtcttatgaatagcatctataaacattatgtggaatgtgctataattttctactaactcaatagtatctaaaataacattgttagtgatttgtatccttgtcaaatgaaaaaaaatcttttttaaaatgatgtgaatgagccatgaacttttaccgtgtagccataaagactgttagaaagtattaagtaagattaattttctgaagattccagtttcataatttaactaagccatcaaggttaatcaacattttttgagattcatggaggaaaatatgccaatttagcatcttcctttttttctgggattgtgcaatatagaacagtatgatttgacagaaaaaaaaaatgagcggaagcagcaatatgaattttacatagcatcattaactttttatataggaggagaaaataggaggagaaaaggtttttaaaataggaggagaaaaggtttttaaaattggaggagaaaaggttgttttaggagaaatattggtaatttgaaataaatgcaatagtttataaaaatattcatttaatatgccaaaatatattaatgtaagtacttttaaactattttgccataattgatcatatatacatatatgaatatttatatatgtgggtagtatatgcatcttttatatatatttaattttattagagctaaatatagacttacttttatatatatatatatatcaatggatataaattggcttttgttttcccaaaattttatgggaaaaaagtaaaacatcatattttttgtcaccctctttttttttcctacatattattttaaaactatatttcccaacaaggttctcagaatcttaaagagatttacattgaatatttctattggctgttttttcaatatttaaacatcctatcacaactaacttaggcaaataaataacaccaatagaaagggatggggtatctcacaattaaggtatactatgtgtgtttctaaagtaacaacttgctaagcatacatatgaagaaaattctagatgtattatatttacttgcgtatttcatctgccactttttatgaacctgggcttacccttaccaatgttaaagaaaaaaatgaactttttggggagtcattttcctctataaatttctactctccttaatcatatctgtgggtgtcatatcaaacatctggccttttgaacttctaagagtatagcaagactagaggtccaacatcaagacaggagcttttgaacaaaaaagcacattttttctcattcctttttattgatgttgtctattagggtgctattatgtattgtctcaagtattaagaattaggatgagagtggtgatttgaccatgcagggaagggatcaaacactgaatatttttttttttggaagatggagtcttgctgtgttgcccaggctggagtgcagtggcatgatctcacttcactgcagcccccaccttccagattcaagggattctcctgcctcagcctcctgagcatctgggactacaggcacacaacaccatgcccagctaatttttgtagctttagtagagatggtgtttcactattttggccaggctggccttgaactcctgacctcaggtgatctgcccatcttggcctctgaaagcactgggattacatgcatgagccaccacgcccagcctaaatactgaatcttcatggtcttttgcaaaatataacaatacttattcacagtggttattctgaaagaacacaaattatgttatttaagatcaattgtgaattcattgtagtagtatgtttgaagaattgatatattcatatttatgttaagcataattattttctttagaaatttatataaattagttaaatttccagttctatcaagttgttagaggaggaaaagcatcttctggtttcatcgtcattagaaagagattatcgtattttccattcattttgaaacagggcaaagaggaatattttatttgagtagacactctgtttgaaattctttttattcaaaatatggtaactttaaacccacatttttaaatggcaaaaaatctattttctaaaatgtgatgttaaaagttaatatgcactctcaattttcagattttttaaaattttctaatataatagaagtcattaatcccaaaattttataaatgttaggagaattatgttgggccttggctatctaaataaaaactgaactctaggagattatctctgttataagagatttagttttctatattactagttgatattacttcaacttaaaaataatttgtgactgttttaccataagggagagaggtgcatttccattaaacacaaggaaaggtttaaaatttatgacatgaattactgttcaaatgtagaaaaaagcacatgcaatttttcattattttaacgaatttttaaattaataattgtattttataaaaaataagaatgttatctcaactgagttttaacatatctttacatttgtctatttaatgagttttgctttttaattataaagaaaatgatctttgattttactgctctgcttttgttgttgaagcttctttgctttattacagtacacggagtatgggaggaatggtcaccatggagtttatgttcatttacatgtggtcgaggccaaagaacaagaacaaggtcatgcacacctcctcagtatggaggaaggccgtgtgaaggacctgaaacacatcataagccttgtaatattgctctttgcccaggtgagcctattctgcatttggttatgtttgcattatgtgctttttatatgattcctagtgtacacaagaaatattaagagtacaaccttcattcagtcacgttgggaaatgtgtccttttcattgtatcttgcctaaaactgggtacttttcttgattctatcatatgtagtattgtagaatatgtcctttagtgtcaatcaacatttacctttattatatttctacaaatgtgtatattaatatttttcactaagacttttatctgcacttgctttttccttctgggaaaattacaaggaatcctaaagacttgagattaattattgccttcacactggaactagggagatctgatttagagccagttcttcctatgttattctcttacacttattcaattagggagtggcaatgtaccactgaccatgtgctagggaatcagactttctagatctcttgctggatgcataaaatggctaaattgtaaacaatttacaatctttatgggattatgaagtctatacagtctgttcttagagtgtatttatgttatcttaaatttttaattttaaatttaaattttaaaatttttctttcctttaaaatgtttctattctattttatctatccttgataattaatttcacccattatgctagagggaagccttcacaatgctgtcatttagtttattccaacatcaaacaaattcctccaaaataaataagaataatgtccagcttcaaaggacttacaagttatagaagaaaatacacacacatagatgatataatctctcagggttagcaaagacacattttaaagaaagagatagacatgaatggataattgcaaaggctaagatggcaaagatcagtataagtaatcgctctcttcttggggagattttctcattagcccatttagtcacatattctgcatgcaagcaacatagctgggatcccagtactgttgtcctccaaacatatcctgaaactcaccctcagtcccactgaccgtttaaatacccccaagttaatgtcctgaactatgaagcaatgcttcaaagtccttctggaagttttaaatatataaaacgtgaagaatatgaaaaacaatccaatgtgtagatatgcaaaagtcatctaacaaacttaattgttcccttcagagaaggactactaggttcctgtacttaatgactagaattaaagatgaaggcaaataattataattacattattttactgactaatataaatatttcctaaaattttattaattctgtgaattatgagtgtaacttatgagttaatattcatacaattatgaatattagatggtcaaaaccatgattacttatttgttaaccagtactagaaaatctatttatgagatcagtaacattctgtcttatttctctctctataaacacacaggcaggcagacacacacatatgtagtgatgccttgtgctttcaacaaagatttggaaaaatttatactttttaaatttttttcaatgctgagctgtaacatttacatagaatcaaatatagtttactcttatttgtccatgaagtgcaaagaaatagacaatatggagaaataaaagacaagaactaactatagaaactttttaaatacttttttgttacttcttttatgtcagctggacttcataaatacaaacataaaaatggcattgattggttaaaatattgtgaaccaagtttctcatagtctactttccattaacttttctaggagcaaaatccttagatatcagtagagaggctatgttacagttcagatgtgaaaacttattttcttaagttgatatggttgtggaactttatcactcaagtagtaacacaagtttttaagctacttggatattagtggtattatcttatcattggaagcactctaagtccaataaaatcagatggctttctttcatgtaggtcctttgtttttgtgcattatgactatattatttgtaaatgtagcctagctcatagtctctcataagtgaacatatgggcatatccttgagtacttaaacgtatcatgtgccatttctgacttccgttgttttcattcttgaatttagttgcatcataaaagatgtagaattcttatcacattgtatccctatgaacttagtatctgaaagtgaactctaataactaggatttttttaagtttccaggctgtgccaaaaaaatcgacgttatgattttaaaatatgtaggtttatttggtggaaacatttgaaattctctttagaactcatcatcttatagctgaactcaggcaccttcactgggtatgaaagcatcatcaactatcaatgagatgtaaggcactgctgagaagtatatatagtccctgatttcaaaagttttcctttccattcagaagattcagacataagcatatgcaaagttgaatgcacttctgaaaacctcatataaatacgctagcttcaatgaaagatggtaacttgaggattcagtggtttcaggcaacattttttctaaccatactacatgatatccctaagctatcatattaaagaataaagctatgataggtacatcagcagtgaagaatgtagatcaggacctgcactagagtgtggacaagaggaggacagaagaaacatgtaaaaccacaaactgtgtctcccactactcactacttttgcaggatttgacggggtgggctgtggtaataatgggcagtgacatttttgtgtgggataatgttaaagcattatagtcgtaaagcttcctgcttttaataaactgcatgaaaccactctagcgaaatagacactatgtaggaatgacatgcattgtttgtatcaaacaatgaaatacttttatgtattcagagtttgatatatacctataagtagataatatgctatcagattccttgctgagtcaatgcacaacttcctcccacttcttttgaggtgagagaaaaccattgcctgggatccatataaggaggaaggaaaatgaaggtatagtatttcctagtgtgagttgttagttactaatttgcatcccctgtctgagaacagggggctgatactaatgaagcaagacaggcaagaggcatagagcaacaaaaggaatttcctggctcataaacataacgtggtctattccttcttttgtaatctatactaataattaaaatattatggaaaggtgcatgtttgtgtgtgtatgtgtgtgttcagtggtctttgtggtctgttttacttatctcaccaaagttctggtggtccaaactatgttttctattttctctgaattttcattgtagtcattaattgataattgacttcttaatggtcaattctcaattaataatttacatatttgaggataaataaattttcttttatttcctgtttctctctccatgcaactctatatatacctggtggaaacaagaaaaattactattaagtggactttcttgacatgaacatatccaaatttctaatatcccaaaatttaaaggacattttctatgtctgtttcataatacattgatatgatggaggaaagtgatcttggacttttgcaagagaacacatatttaaatttagatttttaccttttaatataattgtgtcactcatctaatcttcagtttattcatctgtaaaatggggacaatagtaatacccacttcataggatgggtattactattgtaatgctattgtaatactattgtaatggggtggactttgtgagatgctgtaaagtagagaacctgatagggagcaaatactgtgaaagtattagaagtagtatgttaacgcccttcaaccaaagttcatcagaatcacacctgtagctgacctagctgaatttgttactcttgagagtgaggggaaactaacatagggaactgtggggatctcagcaatggagtgtttgaattacttaagggatttgagcttgtgttaagtgatttggcagagggtttaaggaagcgagcggcctttgttctgaaccggatgctgttcggaaggtgtgacaattctatggttggataataaaccttaataaatcatctaggtgaagggaagaccagccataattggtaaagaaatagcagtcactatattagctgagaaagaagaatatttggtactttgtgagttgcactgtgaccttgtttttgtcttttaagtgtcatcgtatgctactgatgttttctgatatggtttaggtctaactagagataacagtttttctgtgagcatcaggcaagctgctaattaggtctagctgtaagtgtctttttatggtgattccccctctacggtgatttgatcactttagaaccctctgtccttaatggtcttgatttttattaatatttaacaggagaaaagtgtcgcacataatggaaagttgcattttccagtatgactgccattaaaattatatagatatatatacccaaaataaaatttatataaccatttccaaaattaaacacttcggggaacataaaaagcttaagatcttagttaaaagcctgaagttttatgctaattttctttatagctttttactttatagtaatattttcccctagtcagtagttgaatattagaggagctaatgatttaagtttagttcttactgttttcagcgtggacacttctcaatctgatatgtttccatgcagtagagtataaataatataggggacaaggataaatagtaattgagtgacagattaaagactaaaataaatgaaagttctattggtaaataagtcttcatttgtatactgacatatatatataaatggatttaattatatgattcagtgggaaaaaaagtggtgtgttattcagaagatatggattaaagttcagtcacaatccttaattaaaatatttacttgggcaatttatatactctattttccaatttccttttttatgaaatggagtcagtattaattacccctctatattacaggattgacatattattataattaggtagaaatactttgaatagtaaaaaatcgatgtagaggattttttaatgatttatatgaatatattactttaaaattaagagattttggaagaaataggtcaaataaactaggagtattatgataattattgagctctactgtcttagtcatagactcaaagggattcttctcccaggtttttgctaggaagaaataccctcatacaagctgtgtcagtctgttgagctgagcagtgtcacacccgtcaagctgcatttgagaaatgctttcctgggagcccaaaccctgccagagggatgctgccatgttgcagattccagatatatttcctactcttacaaactctaagaagagagaaagaatcacctaagagtagggcctcataaacaggtagacccaaatatttctgttatatagagcgagaggcttcagtctgctatgaacctaaaattttggtctacagcatctatgggaggatgccctgccctcagtctctctgcagggtgcccttctggtgaagacagtgaatggaaagattctcaacatttgctggaacttggttcaaaggtccctgattgtgtttgcatgaggttgttataatttgtaactcaaatactgcctcattaacctgttctttaattgatatggattttatcttcttagccttctagcctgttgtatgacaattatatttgttttatgtcattttagattttgggcattattccagtgctttttcagttcttagcttaaaagatttttaaattaattgtgtctttattaattttggcttgctttcttttaccatttaatatttttttctcattcaaactttaacttatcaacttttttatccttcttagccttaccattatcatttgtttatattttaattctaatttttaaaaatgatgttgcatttttattttccttctatgtagtttagtataaaatggcaaatggaagacagatttttgcttctcaacatatgcccaaagcaagaggttgtactctgtttttttagagacagggtcttgctctgttacccaggctggagtgcagtggcatgattttatctcattgtacctgggaatcctgggctcaagcatcctcccacctcagcctcttgagtagctgagactacaggtgcgcaataccatacccaactaactttattttttatttttgtagcaacacggtcccactgtatttcccaagttgatcttaaacttatacctccaactgcaagtgcttctgatgagaaagaagagaaattgaaacagcctaagaaagtgttgattctgacctggctacatatgagagaagaaattatgtattctagttcattgtttattaaatggtgttctatgaattaaaaaagaagttaggtattacatttcaattaaatttgagaagtaaatttttaaacaaaggttatttattgcagtactcgctgctttgtgtctaaaatggcattccaaatttaacctcaaaaagatagaaattttgatttaagggctatagacacccagattgttgaacactagtctaacccagttcaataaaatgatcaaccctttacctatttgattaagccaaaatcctaaaagtcaaccttaattttctatttttctgcaccctaccacaaacctgccagctctacatccagaaaacattgtaaattcatccatgttttttctatgcccactgatgccaccataattcaagccaccatcagctctctctggactacatacagtatagtcctccaatatttcacagtacgcattcttgcccctgtaccatccgttctacacaaaaccacaatattaggttttaaaatgtaaattctatcttatcacttcttttctttaaaatcttttcatactttgcatcttccctggtcgcatggcctatagggccctataagatctggcttctgcacagcatctgaacccatctctttccacctctccttttccaggatccccacaagccccagtcttctctctgttcctgaacacagatcttcacatgccaacagatattttacatgtaaaagattttttattgccaaaaatgagacattgtttaatttttaatttttcttttcagtgttattctggattttaaaaaaaatattagtgaatttattttacagtcctcagccccataacatttctggaaacactaatgtcattttattgaataagaaaaaagtggaggtcagggaggctttggggaggtggaaattaagagttggctctgtccagtgattcagactcagctctaatatcgtcgtctcctgagactgcctgagcactccctatcacatcgccctctttatcacgttgtcttcataacacctctagtgaaacgctctggtttattcatttactcgtttatcatctgcccccactacagcccccagactacatgttcataagagcagagctcagccagtccttatcaccacagctcccccgtggcgcagttgagcaatgccaatcacagactaaattttctataaatctttactcctgtgtgtgttacgagactccaggagggattgtggagtgtttacgttttcccagcttaccagggaactcttttctgacagaatgctgagatgtgaatcagttttcaatagaaagacagtttcagaaagaaagctttgaggtatttttaaattcgtaggtttgcaatgaccctgagaggtccctcttacaaatattggaagtaagccatacacaaggagcaggcattgagtggggagagacattgattgtctctactacctcgctgctgagcccggtaaaaagtcaagcctgcctgcagggttgaaggagaagcagcttcctcaccactttagctccccagttaaacatcagataacaagaaaaaagctgttccttcacatcttggagaacctagatgagtgtttataaaaaaagaaatagagatatataatatgataaattgtttttatttttacatttctctacatttatccctaaaagataatgcacaaattctatctggaaatgcttaaatatccaaaacagaactcttaatttctacccccccaaagcctccctgttctctatttttttctcattcagtaaaatgacactagtgtttctagaagtgttatggggctgcggcccataaaacaaatccattaataattttttttaatccagaatatcactgaaaagaaaaacttaaaaataaaacaatgtctcatatttgacactaaaaattatatatatacataaaatgtctgttgtctgtatatatgtatgtgtgtgtatatattacatgtgtgtttatatatatatagtctgttgtctagttttttaagttaaatttatatattcatctcctacctgacttttcaattatctattttctcaatgatttggacttgacacactaaagaaatattaggcctttcctcttttgtttttcatatccaatgagttattttgtcaagccaattccttcataatagtgcaattacaccaacatggcacacatatacatatgtaacaaacctgcacgttgtgcacatgtactctagaacttaaagtataataaaaaaaaattaaaaagcttgcaaaaaaaagtgcaattaattttcaaaaaggatcttttggttctcagtgtaaaataaaatcgcaaaaaatgcccacttgatgtatcttcaatttcattattttctctgttactgactttgtgaacaaaactgaccccatctaaaatacatgttttgttgatgtttatggtagcgttgaacctcaaattgctcctcagatttctaatattaacactcttaagctttaacattaacacagaatatgtacatggttagaaaggattgaacaactataactacaaatatatgaatttaaagtctcaaaacattttattattattgatgcagtcttatttcagtaaaagcctgaggagcaaaacacttcacaaatagatgttctcattcttcctaatatcatctcagcaaggtccttcctaattcttcatagaaatacagtcccctgccaaattatcttctctctgatttcgacatttgacttgcacattctagatgccacactttgctagacactcttattctctctttgccagaaaacatataactattgcattcataataaatcatactcaaaatttaccttaaagcagaatacttaaggacatcacatagtcctttattctagtcactcagcactaagattagcttagcagcacctaattcacctttgttaatgtgctgctttctttctgaatgttctcaataatgtggataactgtacatccttttgccaaatagattgtaaggtgtagggcatgaatctctttttataaacccttctcagaatgcttaggatggtgaggcttcatactgcaagctcaataaatgttatctttgaatagaaaaattctgaaatgaaaaatgcactcatgtttaaagccaaaatagaggggaaatagataatttataatatcctattgcttcactagaattttctttttagtctggaaaatagactacataaccaatatgattgtatcaggcacttgtaataaagtgagatgctaaaattacattaatggaatgattaaattggcattttgtgatttttaatctcataaagggtttattaagtacagctggatgcctgttaaacaatctctttttaatacctacatgtaaggcttgaagttagattgaaagtacttattatattctgccaggctttcttgtttatttggatggattttcatagcaccattagcttattttgaaactttagatttgtggtgaattctctttcacctgtgatcaaattgactaagaacaatgaactgatcttggaaaaaagtagacatccacagactgatgcatttataacctttacatgctagtttgcacattctaatctagaaagtatttttggttaaatcctttgtttatttctattttgtggcatatgggattgtgcctttgtcaatgctgactttgtctaaattgtccataactcaccactctgtgtctattataattacatccccagtagatgcagtatgtcctctgaaagcctaaatacttcatgtttcatgttaagatggtattgtctttaaacatttatttatttatttattcatttgcatgcagaatgtcctaaattataaaatttttgaggttaggatttatattcttttatttctgtgtatcttgttaacacctatcacagtgtctgatgactaatagattctcaaaattatttgaatgaattaatacatgaatctcaatttgaatctcccaaagataaatcaagctgaacagtctatattacattccagtcatcagaaaacagccatctaagagtcacctggatcctctctttgcatcagctcccatggccagttcttcagtttcttcttaccacccgttcctagtaactttctaatctctccaagacactgcatctgcactgcctcatcatcacagctcagatccttcccaacttctgtaatttgttctcaatcctacactagatctgatcatagtattatggtattatgtattatttaaatcgttcaatggcttttttttttttttgagacggagtcttgctctgtcccccaggctggagtgcagtgacacaatcttggctcactgcaagctccacctcccgggttcacaccattctcctgcctcagcctcccggagtagctaggactacaggcgcccgccaccatacccggctaatttttttgtattttcagtagagacggggtttcaccgtgttagccagaatggtctcgatctcctgaccttttgatccgcctgcctcagcctcccaaagtgctgcgattacaggcgtgttcaatggcttcttaaacacctgagaataatatccaaaatccttaacacagctgatgaaagtttttcataatctagcctctctcttttttaaaacttctgcaatctctcctcactcagcactctagatgcctttcacaatgaccttcatccagttcctggaaatgcccatgattcttcttccaaagatctttgtatattcctctgcatggaacatacctttatcctaagtatgttctctttatccttcaaggcttgcctgaagcctcggtttgtcaagaaagactctctggaccttccaaagtcttatctcacaatgtcctgaaactatcctttgcaacactgccatgtaattgatttatctagcatgtaattcatggtttatttctaggggttctttctctaaaatatgagctcgataaggtcttgctcagtatttagtttgttcactatttcatgtaccccatctcctagcacaatgtattgcatctttgagtgatcaataaatatttttgaagaaataagtgaatcaaaagatatactggaggccaggcatagtggctcacgcctgtaatcccagcactttgggaggccaaggcaggtggatcacctaaggttaggagtttgagaccagcctgaccaacatggtaaaaccctgtctctactaaaaatacaaaaattattttggggtgtggtgacaggcacctgtaattccaactactcaggaggctgaggcaagagaactgcttgaacctgggaggcagaggttgtagtcagctgggatcatgccgttacactccagcctggacaacagagcaagactccatctccaaatgaaaaaaaaaaagatatgctggatatataaaataaaataaaagtgggaaaataaggtaataatatttggggagttaataaaatctcatgctggtgtgaccttccattgtattcattcatagtccattgattggggttcatcttcaagggtggttttaccaggtactttctgtacagcttgtcctattggaagatatcctcatgctgtctctttttctgctttggtagttgatggacagtggcaagagtggagttcgtggagccagtgctcagtaacgtgctcgaatgggactcagcagagaagccggcagtgcactgcagctgcccatggaggctccgaatgcagagggccatgggcagaaagcagagagtgctataaccctgaatgtacaggtagggcttgattcctgcatatcatgggcactcgtaccatgtaaagggcacattataaaatgtgtcagaactatgccagagggtcatgaaagaagataatcattatatatatatgtgtgtgtgtgtgtgtgtgtgtgtgtatacatgtatttattaatgaagccgattataccagaatttattctaatgtatgccatgctaataaagtaataaaattcaggagatgaactacgaatacatttgaggaagtttagcactgagcttgcactttttacacttttttacactgttcttcgcaatgctctatatttgacctgtaagttaaatatttgaataaggtttattcacagtagtagattaacaaaaatggaaggggtagtaacattctcagattttaaaatttttaaaggagtgtgtggtagatgactgacattgaccatgaaacatttctttcagccaatggtcaatggaatcagtggggtcattggagtggttgttccaagtcctgtgatggcggctgggaaaggcgaataaggacctgtcagggtgcagtgataacagggcagcaatgtgaaggaacgggcgaagaagtgagaagatgcaatgagcagcgatgccctggtgagaatgaacccaaattatcccaaaagaaacatttcataacgtgaaaaaaaaaagatttaaaaatattgtcattggttaagggtcatattcctcaactaaagaactactaatgataggtggcaatttacttgtttctgtactatgtggggcatcccctgtttatgtgtcatagaatcgttccatgtgaaatatttgtttgtggagattacaaaacaagttgccttaggatatatatactggaaatgtaaagacataagaaatgaatgagaagataaagaagtgtcgctgacattcagatgcttttaagttctgttgctaattactctgaccttgatgtgtgaccttgattatctacatttacttgcgtttgccccatttttcattggcaaaggaaattcctatgaggaatgcattttaaaatgaaagtataaagtcttaattgctaatgaaaaaatgaaagtcctgctacattaaaagattttacatataagcagagaaaataatgaaaggtcagaaactgcccagattatacagcacatattttacaggatcatttagaacaaaaactccttcctaatcatgtgtaccttccattaaaatattattgacacactgaggactcaataagtaagtgaaagtcaggattttagaatgagatcctaagaaaaatattataagtatactaaagatgtgataggacagaattttaaaatttgacaatatagtgccaacgtgctgaacctagagaatttgaagacccacttagaatcctgttgctgctagtaactctgtgagcaagctgactgatctctctggctgtctgattcctgggggtacagtgagtacagctggttgtgagatctttgaggttccttttcagttcagaatgctatgaatttctgcctttatctcacatgattgtttcaacttagaagaaccaaggtattctaagagctatccaggagtcaaagctttgtatttttccaaagttagtattataaagacttctcacagtacaacactaagaataacaacagaactggattttaagagtaacaatatgtcagttggagttttgtgggggcttaaaaaagatcgaaaattagggccaggcatgttggctcatacctgtaatcccagcactttgggaggctgaggcagataaatcacctgaggtcaggagttcgagaccagcctggccaacgtggcgaaaccccgtctctactaaaaatacaaaaattagccggccgtggtggcatgcacctgtaatcccagctacgcaggaggctgaggaaggagaatagcttgaacccaggaggtggaggttgcagttagccgagattgcaccactgcactgcagcctgcgtgacagagcaagactctgtctcgaaaaaaaaaaatctaaaattacttttgttaattcttaacaccatatgaattcaatatgataaaaagtaaccagcatgcagggttgttaagaggatgatacctattcagattaccactgtgaaattcttccagtgctgcgtaagaagaattaagatgtattaaacaaaaacatttattttgcctagggagaaatttcacagaatagtaagcataattaaatcaaccccttcaatatttgatgttatctaaaccagtctgggcataccacagttcttaactggtcttttaaaattgtctttcatctgcacatatagagccaagatagtactgctgcaatcaaatttacagagattgccacctgctgtttgaaaaacattttacagatctatttatgaaaaagatagtgtaccttatttgccgggcttgtttgctggctttcatgacttaaggcaggttaaaaaaatatcacataaaactaaaaaaaaaattatatacactacacatttttgttattattaacattttcattttactcttttcaattatatgagatgaaaataaccataaattacttacaagcatatagataccgttttcataattaaaaagaattcttgaatcagctaaataatttaaacatcactacttatacaggggcaaagaaaaatagtgtgtgtgtgtgtgtgtgtgtgtgtgtgtgtgtgtgtgtgtacatatacaccaagcttttgaatatatccttgtctggtgcatttatataaacaaaaattgcattgtccatcagaaattgtgtgtgactgttaatttcaaaaatacctctgctttcttagagaatttttttaatttacaaaaggggtttttctttcatattaattatttaactttttatgtgcagtcacatcatccccaaattattttatcaagtttttgataactgttttccatattgtacttgatttatatactggagttccaactctgttcaatgtcctctctgtagtcaatgtgtattactgttgtgattatgagtatagcgttcctaatttcagccattatattgcttcaaatttacacactgacaatataaattgagaaaactttcaaattaccataacatttttctaaggcatctttgtctttgtgttaacaacaaagcttcaacaatttttttaaacaatatgctttttctagtattatttttagtctattcattcttaatttttcttcaagttgctgaaaacaactactgtttattttatacttcacttaatttggagtcaaaacaaattaatcaagtttactaagaggccttttgttgtcaggaaggagaaatatatatgaacatctttgtttgaataattaatgaaaataatgattaatcatctggatctaatctaaagctgttatgatgtctactgaaaatgaaaaataaaactattttcccctcaagattaggatatttctttgctggtagatagattaaataaaagtattaaaagtgtcatcattgatgacaaaaaatgtatttcttttgttttcataaaaaataattgtagaaataagaaaacattttttaaaaataatgctagttgggctatagaatagctacagggaagataataagtggtccaatttttaaattggtcagactcaccagataatggtttcatttatctcaatctcattgtgtatcctcaggctttgaaggttaaaatggtaggatggtaatagctcccctaattttattaattgctacaatgtcatacataatattttttaggtttttagtttgattttcaccccaatattcccctggttaataatattcagaaagcaagtgttactgctggactgtcctaagtttacattctagcttcgtaggaaccactttgccctgctcccaggagaagggcttgctacttctataactccaattctaggatcattactctttagtcattaactgctaagttggaacctaccatttacaagtaaaaattacactttatttatacataaaatttcgttcttggaaccacagctgctttgtctgtaagtggtgggtgaggcctccaggttaaatgtgctgataaacacttgtgaagtaagtcagccatatcataaatgtatacaatattagcaacttagaccagaaatgtaggaattattgtgatgtttatctataaatattcatactaaaggagggcagccgtagtgttggtaatgcaaaatttgtcttgaacactgtaatacacttgtattaggatttggtgccctataatatagcgaatgtgatccccatccccaccctgcttacgaaaaatgtgattctggaagtgacggttccttatttgtataaggttgctctccaacaggattatgcctcctctggagaccaggagagtcttcctttggtctctaagtaattgtcttttaacttagcttcagtaggaaagaagaacaaagcttgcctactttgcactcctatcttcttttgagtgcctccctcattgtccaaagcagtgcttcccaaacttcagtgtacataggaatcatccagagagcttgttaaaacacagattcctgagccagaccccaccagccattctgactcagtaggtcttgaatgagcctgagaatctgcatttttatgaaggtctcaggtgatgctgaagatgctggtctgcaaatcatcctttcagttgcactaacttatagtaaaaataataatgataaggtgataaaattaacaaagaagtggaatacagtcctctacctctgttccactggagaaagttgaaatatcacctcaacaaaattgcaaaattttatttttttcatcctttttcataaacgatgagggattctttctggaattggttgataatgaaaacacaattcattttgaatgcctctagccaactcatgtttcagccaaaataagatctctttacagcagtcatttaaagaaaaataggactattaactagctgttgtgcacaaagaaagatggtttagtcattatccaactctcagttctccaatcctcatttttcctctaccacgaagagcaggagaaacaacttgggtatcatttgaacaagtctgatgtaaaaccaggcactgccaggacacagatctgcagtcctgatgttgtcagccccagcatctctcttcctgagcagtatattttccctgcctcttatcccccacaggtattagctaattagctaatatatacacatacacttataaaatacttggtgtggggatggtgtcatggaggaagatgaggtcttagctcactttgacttattttctcctcaggttccagttagtagaatagtgaactaatcactactgatacaaatatttttgtctttgagacaaatttaacaagttagattcttctaaactaaactcttgaaccactcaattttaagactgaatgtaatcattattagaaacccaaatatgtcagcataaaatttacatttcttttctaaagagaaaatacactactccataatgaaatatttgcatacaaattgacacctgctttaccttgttcatttcaaaccaagtttaattaagcacaaacagtactttttaaagctcctatttcattggaatttatattatttaattaagcacaaatagtactttttaaagctcctattcctttggaatttatattattttctgctttcagatattatctgtatactctttaaggaattatgttattacctgttgcattcttcaaaaggttaaagcaagttttgactgcatatttttgggaatagcaaattaggccctactcaagtgtccataccagttgttaacctaaaaccagccactgagtttaatggtgacagtaggtggcactaggtattgacttctttaatattaaatgttctatttgttcttgccaagtcacttcagataaatagtaaaaagcaggaaaatgaattagaacttgaagatatcccatagatgagagagaccacctgttgcttttaataaatacctaaaatagtatccaatcttctcaaaaaggatgagttttaccacctattttagtctacagttctgcagcaaatcaagctgagttgtatgggcagacttggggaagaaccgctgagatctaaaagaattaataacagatagtactactgtggctacagtatgtataccagatgcccattattcaaacctgttgctatggagataattattgtcataattcattttatcagattttcttcagatgagactttgatcagactcttacagtttctgccatgaattgcttaaaaagcaattttctgtaatcttatattaccctaccttgttcaatttagaaatatttagcaacatgctgatcattctcaaattgaaaagaaaaatttaagcaccaccttttactatttttttatttattcttttcatcccttattgtttttctgggaaaaaataaactttaggaactgtttaacaattattttaaattaagagatttaaaattacttttaaaccttttttgagcttaatgtttaccaagacactaaatctgaatattggtctttgatgtttctcatcaacacttatttttctcaccttgtgtatcctgacatatgaatgacctaagactgccccagcactcttctcttttgttgatctctctctcatcaactatagcctctgtgagcaacacccatgaatgtacctttatgtctaatcactcacaaaaacctgataaagctttcctacctgggactcaattcagactctgggtaactgggggaaacttttctttgatcaccagatcctctgtgtcatctggagtgattcctcattctagcaatccctgttccagatggagtccatcatggtatttctctcagtggccctgctttcacttcctcctgccaccagcttccagtaagggaggagcagtgcagcaggaagagcctgaactatggagtccaacaaagtaccgacttgggccttggtgtcctcatttataaaatagggataataatatgtgctgcagaagattatttcaaggatgaaatgctggagctaattaggatcatcaagtggcagttcatgtactctgttacccatattatgacaacacctgccttctctaatctcttccacacagatttatctgattattctctcttctttatagccttgttcttatgacttgctttctcaaaaacttctgtggcttttcattactggccaaatttcatcctactgggatccttgagattctaatatttctatcagcttcaatagctttccaatgttatctcatcctactcatttatgatatatattttaatatacatttgttcatatgtgatagaatcaagcagatgcagcctctggtttctgaatacaggggtgcatattctccccttatggtgctgtttgcactgttattcacttgggctcccctaatgtccctgtcccctctcttatcctcatctgttgataggggagaatttgggagcccatccattaagagatgtctgctctcctaataattctttctcccacaatctcataagtgttctttcttctttgaacccctataaatttgtttgatatttccttattatatagtattattattatatgattatatctgttgaaattccagcttattgcagatgaactatctgttctcagccttctgaatccctgattcttcactgagcctagttaaatataataggtcaagcccttttgaatgtttttatttcatatgataaaagctataactaatgaaaacatttatataaaagcatatgaataaaaagtttgcaatgactctgatgttagtgtcttacatttcatggcctttcagtgtttcaaaagtctgttcaatggactgatttactggaagaacatttctatcacatatatgattttttatattgtagttataaattgtggtatgattcatctttctttggaaataagtaattgagatatgggaggtaggaaaaatatatgtttctatagcgagttgttcagtttccccaaatctcagcccagcttattattttaagccagagcttctcaaggcagttctaccctgtcatgggaggatttgtcccagctgtgcccaaatagtggttcctaaagcctcagagcaactgacaaggcaggagactgtggctagtggtctccagtcttcagtagccttgcctacttctcccagtgtgcctccaaatactatcatttctacatatgctatgacctagagaaggctaagactcactgtcgtctttggctgttcctaaggtaatacagaaacttagtaaacgtaactttccagcaaaatgttgagcataccccagtataaaattcagtataactaaaagttagtaaatagctttttagagttattcctcaaagttagttagctaattttttaattaactttgttatcaggttgaaactagagtgaccttgtctgctaagtttaaatataaaattatgcaataataatacagaatttgcttatgagtaagtatatataacactgtccaccaggtacttaaacaatctgcaatatataccatttgctaataaattgaaagttcatggtttgctaacttccagacttaaaaacaaatatttgcaaaatgtataaataacttgtttaccaccataacaataaaaagactcctctgcttagagaagaggtaaacttctctgagaatggactcaactatttgattgaccataggtccatcatctcttagcttagtggcctcaggctaaacactaaacactttctgtcttgacttcctcatgtttaaaatgagaataacaattctgttcacaaggttataagaattctgtgaattaaaatatataacacagtaagaacaataactcataatgttatgtaaatattgctgatataattgtatgttgtttccatttgagacagattaaaaccatttcctatatgaggaatgctgttatgaaacacacttcataaacactcttctttttcccacagaccttagcagcagcatgaattcttcacatgagtaggtaccaccttggaaattagagctgtaagtcattgagcacagacactggatccgtcttattttcctctgcatcctccagcacagggaattccccaaacacaagaattcatgaattgccaacaagcgaattttgaaatgtgggttcttgagtagtacatgttttttttttgtgtgtgtgtatatcagctctatagtttagaatcaatttctttttaatgctgaaattctagcatatggggtaaaaactaattttccacacaaaattgatttaagccctgtatcatttctgctctttttaagagacagaaaatcagtttgaatagacagattaacagctaatcactaggtaattgctaccttactttaaggggcatgctaactacatacttgtgacttcaagtatagttgtatcttacaaatggatttttatatctttgcactagtaagagcaaacagtgagatctttgagctgatgaacaaagttactattccttttagctaaggcatacaaagagagaatccttcctattgctgcacaatcgtatgcttttatgttcagtctagagagcagcctcagctagtttattttctaatttacaaaacacacacaagtgccattaaacagaaaaaataattaaaacaaatctctatctctagcttgttttcttctggagcttggattccatcatatatatcaattaacttttttataatacctgtatgtgcctagatatgtcaaactcaaaactattttcggcatctcctctcccaagtcatctcttcctcacatgttgtagttcagggtctcgctagcacataagatatccttcctggaaacctgagttctgtgttttatttctttatcctcctcacctcttacatacaatcagccatagtgctgagcccattctacctcctaaataaattttgaattaatctacatcctatgattcttcatcccttccctaattacatcatttagattgtggtaggcctccctgtcttcagctctctttctttcaaccctttctccaaactgcaggcatagcaagcatttaaaacattgtcataaatttcccttgcccctaatataaagtcaagatccttgcttacctcatcatatattacccctcctcctgctgaatcacccacctctacttatccccaactttacactttaccctttctgaaacggtcaccttcttggttattcccagttctctttgctccctggattttcccacatgtggttcccaggacacactctccccttcttcattggtggaagtcctgcttctcctttacacctcaacctggacatccctctggaaatcttccactgacacactcttccctaaggtactcccagagcagccagggcttctcagcttagagtgggcatcctgtgtactgtaattcctcaaattatcatctttatgaccattttaggagtcaagagacatcgactattcttacttagccttttctatgtgtagtatttaacaaggtgactgggatatgctgggtgcccagtaaatatttgttgaatgaatgaattctataagtggcactgagaagtacctagaaagatcccactactggggaattcataaagatgagatggcagaaaatcaattgttattttaatgtctaaagctattttgcttttggtataagcataaatcgacctattttctgagatagactcttcaaagaatgccaagtcacctttgataaaatagttaaagcagctgtaccgtttgacattactactaaaaagctgaaaaccctggaccagtttgcacctgtgaatctatgatttcccctgccatcttcctttttaaaaataataataatttgtgtagtggatttctgtctccaagaagcacaatgaatccaaggcttcataaatttactgtggaacaaaacaaaaagttgttgacatctctaggtttaaaaaattattgacttttgcttttcattttgtttggctgtttgtaggcagaccaaactgatagtcattaagaagataaaattcagtaatagaaagatgtggttggtcaaaggaaaacaactatttaatcagcttcttcctgaaccagagtgaggatgtgtgtagggcacattgggggattctaaaaaatggtcctataggatcttagtaagtcagatatagccctccaaggccaaacttagtcattacatgataccctggaaacatcttttgactaatttttaaggtaactgtagtagctaacctccctatctttctgctcctaactggacacggctatctactgctagaggatccaccccccacctccacccccgccccacacacaacgtctacagtatttttgcaaaatcatcttcattctctgcgatcttaagaaatagggtaattcaaaaacagatctagccaaaagagaaaaataaatcagctaaaaacatgtatagatgttacaaggtgacaggaaagtgctttggagaaagataaaggagaggaaggggtgggagtgtttgaggggcagtcagtggggtctgagaatgtgaggtttgagaaaagattgaaggcgggaaagacatgagtcatgcagacatgtttgagggggaggaagcgggggatagtcaaagcagaaagaacctgcacacaagctctgaggttgcagtcggcctgtagtactgaagaagggtggagaaggcctgtgcagctggtgggaagctgtgacagtggagcaaggaagaggagaggtaagctgtaactgatgctagtttaatcattaaacattgtacttgcatgaagagaggacgttttatttttccccaactatttgccttaaaaaaaaaatgaagcattgacttatttcacatatttactcttactccccaccttgattttgaacccatcagattccgcagccggcccagtaaacatttcaccctactggctcactagtgccatctagtggctaaggtttgcaatgaccacattttctaactacacatttgaccgtgggggaggggcagggagcaacgaagtaccttttgccagaataatactaagtgtgaaaaactttctgataccccgacagggaaatgaagaagttcatgatacaaattgaatcttcgttttcttatgtcacgactgaatcaggaaatctagtattcaactatagcaacaggttttattaaatgtgtttcaaagttcaccaatggaactaaaggaaatttgaatttcaaagcattgaaaaccaaaaagatagtacaagtgaagcaaaagtgaaagattataaatgaagagataatgagggagataataaacagaagtgggatgtatggatggagcaaaaagaataatcaaatatgacagtcagattagattaactattgccatgtcattattaaaaacggacgagtcgttgtatctagaattcaattatgtaataacctattcatgatgtattttttgaactttaacatttgtcctaattctccttcttttagtattctataatagtttttggttggcatttatagaaacatgaatatcatttattacactactgtccaacatagttgttatttcaatttaaatgtacattaactaaaatcaaataaaatccaaaattcacttctcaattgcactagccacattttcctagcacctaccatactgaacagtgaaaatataaaacatttctatcattgaaaaaattttattggacagtgctggtatgttatttccccagtaaaagtgatttctttaatgaaagtgttttgaacacatactgtatactagataccactgtagttcattacaacagattaaaaagataaagtaaaacctggctagtctaaaaagcaacactggggaattggggaggttcacagatataaccaagtattttcaatctgttgtgagaagggctataatattcatatattcaataactgagatattaggaaagagttattggagaatacatcatttaagcagcattttaaggataaataggaattttacccctcaaaataagaatatccatgggtttcacatctgtggattgaaccaaccacagatcaaaaatattcaggaaaattaactgtgtggctgctgcataggagagtaaatatgagccgtgatgggaatggtaggctacagcccttatgagcagggcctttggatcacactaagcacagctatcttagttctttctgtgttatcctgtcagtactggagaagcatgggagggttttaagcagaaaattgtgggattaaactttatcttagagattactcttttgatgtggcatgaaaattggattaagggggcagatggaggagaacagtaccacttactacccagctcctcaactcagaaagcaagcatcatccttgacccctttgtcttcctaaattctcacatagttttgtctacctcttcaatttaccttgtatccaccaatttttctcatctttagtctaatcatcctacctaaagccatcaatgtttcagggttgaagcactgcactggtctcctccacggcattggccatctattctacccacagaaggcaaactatcttaaaatttaaaattgaatcatttcacttttttagaacccttcaatggctgcccatgtggccctataggctctaatcatggcctctctcaccagaccattactctatacttggtcttactcttctccttccagccctgctgaactcgatgccccaagctcttccttgcttcaaggcctttgcacaaattgtttcctctgcctggagcatttattgtaccgcacactgccagttttaattatatgtcactttctccaggaagccttccttgattcttcagtttttaggttaaaatagcaccctgtacttactatttgaagtgctcatcataattgtactcaagtaattttttgtttcaccttgcctcctccctttgactaaaagaatgtctaggcagactacttttcttttcttctttctttttttttttttaaatggaatcttgatctgtcacccaggctggagtgcagtgacacgatcttggctcactgcaaaccctgcctcccgggttcaagcaattcttctgcttcagcacctgtagctgggatcttcctccttctgcttcagcacctgtagcagggactacaggtgcacgccaccacacccagctaattgttgtatttttagtagagatggggtttcatcaggctggtcttgaactcctgacctcatgatctgcccgccttggcctcccaaagtgctgggattacaggcatgagccactgtgcctgtcccagactgcatttcttatgcaccattggttcttctaaagcagggcctagcaccatgttacattaacagggcctagctctagcacatattaggtaaaaatgtagcctagcacatgttagtgctagcacaggtcctaggacacaggcccaacacatgtgaggtaagtgcatgaaataaccaatgaggttgttcccctaatttaaccaggacagaatgaatgcctgggtgagtggtggaggtaaaatcatggaaggttaagagtaagataaggatgactagaagatggatccaatggttttagttacgggaacaagattgtagtaccattagcagagttaggaatttcaaggagaggaaacaagcagcattgtggagaataatactgggaattgaagtgtgagcagcttcacctgagatttctttggaatagccaagtaaaaaatgccactcagaaactggctacgccagcctaaacccaagaaagatacctgaaccaaagaaacacatatagttggccgtcagtattcatgggtttcatctctgtggattgaaccaaccacaaatcaaatattcagaaaaaaatgacgtctgtattgaacatgtacaaagttttttctagtcattatttcctaaacaatacagtatagcaactatttatatagcatttacattgagttaaatattataaatagtatatagatgatgtcttatggtacagtcataccttggttccaggaccctgtgtctactaaaatcctgtctactcaatgcctgcagaccaccctgcagaatctgtgtgttggaaaagtctgcccttcttagatgcaggtctcacatcttgccaatatcgtattttcaataagtgtttagttgaaaaaaatccacatataagtggacccatgcagctcaaacctgtgttgttcaaggattaactgtgtacaggaggaagagcgtaggtttcaaatactataccattttatatcagggagttgagcatcagtgaattttggtatctgcaggagatcctggtacaaatcccccatagatgacagggatgactgtatgtgttcctaatacatagtggaagtagaaggcatgtgtccaggcatgactgccatataacaagcgaagtgtgggatcagaaaccaactgattacatacttattgaggctccaacatttactaacttttcttcttttccaccgcttccccttcattggcattaatctgggcaccacgagtttcatagcagtaccttccctcaccactgtctggtctctgggctttgccttttcttcctgacgctgctgctgctctccctaggagacacttccaaggacctctgtggcccgctggtgggaggcaggatggggcagcagggccaggagcatgtgctctccaaagggtggggcacagatgcaacaggcagtgaagtagctctggcttactaacctttgggaccagtgtgggaatgtgtggttattggtgcttcactactggtggctgctgtatctcttagtttattttcctgttgtttctattcccaagatattgaaggagttagccctacctagtggctgcccctaccctcacttgagttgtagatttttttgtgattagttttattttattattttatatttttgatttatgataggtcctctcctactcatcaccaccattcccaagccaaactgtgacaaatccagttcttgtgtcctgggaaagggccttgccaacctcagcacagctctcctgccccatttaacagcccaggtgctttgatggagccaggagggcatggccaggctcccgaatggggagggtttggagcacctggcaaaatgactcctccccatccaacctccccctcctgcactcagtttctcctctggattcaatatgtaataaagtttggaatttgaagaagaaaagtagttcatttgcttctctgtgcttctgttttcccatgtgataaataaggatcatagtcacctctaactcataggtgctaactcgtaggtggttgggagagagcaaatgtgtccatgcatgtaaaactctccaaaagggcttaataaatactaatatgattatattactattattaatatgcttgaaattatccaagaaaaacacctaacgtaaggaagaagtaaggtatgaatgattctgagaaggacacaaagaatgagacaaagaaagaatgctctgaggggttggtggaggagtgttggagaatggcttaagatgctgaagaaagtatttccaagaaggtgagaaaagtcaaaatatagtggtacagacaaggcccagactgtgtgagactaagatgaggtttgttggtagatcattggtaaggttaggaggagacagcttatgaaagtggggctggtgaaggttgaattaactgctaaaccctccaccaagcaaagaggacacaaattgaaaacattgcctatgtgttttaatgggaacatggaataaataaatgaatatatatttacatatactcagagggagaggactatcttaaacaattcaaggtcatgaagagtatatgtgggaaaagaaaaggaagatgactgaggagtgtggattctaggatccagtcctgctgacacctccaccagctctgtctccttagacaagcttcctctttttgggccttggtgccttcatctgtaaagaggaaggagttggaatagttgatcttcagtgacactgtcagctttgtaatacccatgtgttcaaaccattcatcttatcttgggtaattattttttaaatattatttcaagatttaatttgtcaacttgtattcttcccctactgataactataaggtaatttaatgagttcgtaaattctgaaatggaattggtatcagtagaatgatgattatcatggattaaatattatattattctgcaaggaagatgtttctcccaagaaatcacactcctgtgtttatttaggtacttagtattttaagatcctcacttatttatcaaggtatttataaaacatatattcatttatttatttattcaattttgagcaacttcatgtggcaaacacaccattaggtacaagtgatacagaggtgagtagacccaaacaagatccctagcaaatagtgaagactgatatatgaacatgtaaatgacaattttgtatgaaaagcacaacagtgtgtgtgtctagagaagggactaatattctttcacatgggagcaagatgtcacttttaacacaatatagatagacctcattctttcactactattttgcatttcattatattacagttaaacatctgttatttttgaagttatttttaattttcttgctcaataattaaattgaaattttgaatataatatgacaaaaagatcaaattggtatatttttactgctatcattgcttttagttgaagaggtaaaaagttacgtatttttactctttatgcttatttatttttaacatttaatagttaataattttaatgtgcctttttgtttgttggaagtcacttttttgtataacatcctaaaatattataaatatttttattgatatgcctgaatatgttcaacttgtaggcaaatccaaatgacctctataaatagtctacacagtaagcagttcaaaaagaaattacaattctgtaaatactttgtagatactaaaaggaaatctgatgggtttttatgtatgtttatgccactaacatttcagtaaacaatatacattaaagcaaatgaaagagcctgtgcatggtggctcaattctataatcctggcactttgggagaagctcaagatgagcctggcaacataaggagaccctttctctacgtagaattaaaacaaaaaatcggccagatgtggcaacacacgtctgtagtcctagttactcaagagactaaggagggaggatggcttgagcccagtagtttgcggctgcacagtgagctaggatcatgccagtgcactccagcctgggcaacagagtgagaccccatctctaaaaaaaagaaagaaaaaaaaagaaaactaaagagctctgcagttagagaggtgcctttgacaattgtttattgccaaaattttttaaacactactgacattcaagtccctttgtttaaaattgcagcaccttatgaaatatgccctgaggattatctgatgtcgatggtgtggaaaagaactccagcaggcgacttggcattcaatcaatgtcccctgaatgccacaggtacagtaggatgacccacccaaaccctagtgataatccccatccaagaacagcatgcagtgttggtttatgaagtcatgtttttgtcttatatccataaataagtctgtccaataagcaaataatgaaacaattttagtaaagtgcttcataaatgaagccaatgaagagatatagaaaatattgctggtgtaattgtttctcagtgtgactaatatgcattataaaaataatcaaaatatcaatttcatgtgcatgttttttaaagaaaaaaagtacaaacttaatttttagcctgattcccagctaagtgtgatgccttcaaacatccctattataaagcttctctctgttctttgtgacacacaggcaccactagcagacgctgctctctcagtcttcatggagtggccttctgggaacagccgagctttgcaagatgcatatcaaatgagtacagacacttgcagcattcagtaggtgcaaagccagctttagtacttgctctgtttattttttgctaatgatcactgtgtgagaatttaaccttctgctgtacaatcaaatcagtaacatctctaaaaaagaaatgcctgaaggagaaagcaatgtgatagaaagctaatttttataggtcagtgctaaattgttttgttcctaggacttgggtttttatggatcctgctatttaaatgaaagaaccctttgtctagtgggggaaaggcctgagcaaaatctgttattcagttttacctataaaagttaaacatatgcattatggttggcttaagtctgtgttaaatacttattttaaaatatcatacattttaaaattaaattatttaaatttgcagtagttggacagtgataaagctgtgtcacttagctatcaaatttctcactgcagtttgagattaagacattaaaataaatgacagtgttattgcaccagagaaacttaattactcccaaaagattacatgggccaaattttccaaaaaatagctcttcttttcccacatatcattgacttattcacagagtatgatgcatgaatattttgagcatagttacattttgcttggtattttacaagtacaagtcattgtcattactgcagactgttgtcatttcatcctgacagtcaacagggcctccatacatgaataaacactgtagggtgtagaacaaaatatgaacatgagccaactgggaagtttaatcttggcaggagtgatgtttacttaaatgcctttatgttttgttgtgcttatattttcttttactgttcttactgtcactcaaaaatatacataacttttgtaagaatcctaaagagtattcttgcttgtggatggagaaatagcttatacaataacaacccctatcaactaatagaattagtatttgtttcattatcagaaaaagaaaagcatttttttaaaatctgaaagtcaaattctgtacagcatgtttccttatgaaacttggagttaaatttatcattatttaactatctggagaattatttctgtcattatatatacttatgtatatctatatacagttgacccttgaataatgtggccgttaggggcgccaacacccagggcagtcgaaaatccatatgtaacttttgactcccttcacatttactaatagcctgttcttgaccagtaaggaaggctcaccgataacaaaaacagtttattaacacatattccatatgttacatatattttgtactgtatttttacaataaagtaagctagagaaaagaaaatgttattaagaaagtcataaagaagataaattatatttgcttgaatagtggaagtggattattataaaagtcttcatcctcattatctttaggctgagaaggagaaagaggaggggttggtcttgcaggctcaggagtggcagaggcaatacaaaatctgcatgtaagtggactgcacagttcaaacctgtgttgttcaagggccattgctacagatatgtgtatagcagtaattgatgattatttggctatatacagccttatttctgttgtaaatatatacttacaatatagaaaaatatatatttttttatatttatcacataaacataaagttttatatttatatatcatataatatgcattatattgatataaattcaaaaatagaaatataaataagattttatatttatatattatatgcagatatataaatataaatatacacatgtattttttatagtctttttttgtttctatttagagacaaaaatatatataagtgagggaatataacatatagcttagcttcataatataaaatgtaagaatatgaaatataaagcttcttttattaatagctgtcaataactcagaccattatatttcaaaattaggtataagtaaaaatgtataaattaaattttaatggatttttttttctaattttagtcattagactttgtttaattatatccatattcagttcttgttcagtcgtggtgatgaatgggaataattacagggattaagtaaataacagagcaatctttacaaatttgctaagaattaatagtatcacttttgttgcagaaaattttcactttccaaatgtactgttttgtactgcaacatttaaatggggtttcattcttgagtgcaggccatctgataatggattaagatagatacactcagtgaaatagaagaaatgaaatctcaaagtgtgaatcctgttgaaattattcagtcaataattgacagcaaatatgaatatgcccttgttgacttgggtacaattatcaggtgcatgatcttgtatagtaaaaagctgcctctgtttattcggctcctacatagtactaggcactaggctggaaactttcataaatgaatcccagtcctcacaagaatctgcaagatgggtgtccatgccgcagtttacataaaaagaatctgaatatctgtcggggagcagtcacttcagtgaggtaaagagtgaaaagtatgccctaggcgcaattgttccaaaacctaatctcttttctttaggccattcaaccttctgaacttttgatatgaaatcatctgtcttatactctattgctgggagcagtattttctgcttacatgttcttaggaaaagtcatatgatcacactcaagtcttagcttgctatttacaaaatggaattggttccatcatcttagcacctgtggaagttttggaatggaacaaatgagatatgtggaataatcatacattgtgaaagagttgtgtaacaatgggcattaatatttctgggttcagaaaattgattttgagtttaaagtattgtttcaataagaataaaattttggaactcaacatattgttaatttgagctgtacctgtagaaaagtatagataaattagatatggatagatggttggataggtaggtaggtaggtagatagatacatagatagataggtaggtagatacacagatagatgatagagataagatagatgttgcatatattttggcatatgaattatgcttaaatacatgtatgaaatatacacacacatttgtacatgcatacatacacaaatctagggcttgcctaaagagcatgatctttttacatgttcagtaaagtatagaatgaatgaatgtatgctttcaataatgcttatgtcacacatcagcctcatcatccacactctgcatactcaattggaaacagaaatgagatcaacatttctgcataggcttactcattctgttgctttgctaagtcatgctttgtctaagtagcaaaactggatagtatttgtgatatagaacatttgagacttcctcaaattcttaaattagtttggagactgtgcatttttctcctctagtagagtttatcatttcaacatttaatccttgagagatttcatttccttacccttctatattctaaaagttcattcaataataattaattataatctactgtagaaaaatatttaaaatagggagctctatgttttccaactatttgaaacatagattacaatatatgtgtatacctactttataaatatatagcaatcacctaaatttgaaatgaaattttatcattaataaacattagttgtgtatgttctatgaactctcaattataaaccagttgaggtaaacaaaagggccatcaataagtttaagatataaaatcactaatctgtcatgttggacatttggtttttttctttttttgtaaatcttcattgctatagtcctaacataatactaagcatatactattaataaatatttcaaagatttttgagtaaagcacgactttgctacttttcttataagtagaaggatactagcagctggagagttctgagaaggtgatacaccagacttaatgtttatgcatgttaaccacatgaaaggaacaagtataagccttcatgtgcaatttctccagcccccaaatacctagaaatgtgtagtgattggtgacatcactttatgaaattattcggccattgtataacaatttcaattagttaatacttatgaagtttatttggaagccttataagatgcaaagttagacactatcatatcaatgttgttttttaaaaaagacacaaatacacttatccaattaaataaaattgagaatatgagaacaaagtgctaaacgttgtgagattcttggaaagtttaaatttttaatatgttaatgtttcatttgatactctggagtattttttgaattgtataccagaaaaagtaaacataattgcagaattcttgaaaaataggcacaggagtcaaataaattaacaatatcatttcttattacttataagctatttggagaacatgactaaatattgtagtccagtgggccagcctacacttgaacaaatagacttattttgtctttggtatatgtgaacaatcacaggcaacattctctttctctctctcttctctctcctcttcctcctcttcctctcttttacatacatacaaacacacacctggggagacaagctgtgtgtaattggcagaatgtatgcccctgtaggtagacaaatctaaagcaaagggagttgatccaagcataccaatgctttctcctaaatttattggacaggtatatcactcctccttccctggagatgagtgagtgatgaagatggagaaaggctaaagatactactctaatggaagctcttccatagggaaatatgaagagttaggtataaatatccccttttaggttattgttccttaaaactctgtttctatgattcaaatcttcattaaacaaacaaatacaaatgttggagtgattatttagtcatctttacctaacattttttacagatgttaaagaacttgaatcccatttaaggactttatttctcctactttcctctactcttatgggtagtttattagaacagatagctggagctacagacagagagaccaagagagacaaagaaactgagacaaagagaaagagacagaaagtaggagaatatttgctttccttttttctccctactttctctcaagttaatgcaacaaaactcctcacatatcacacttttttggtcaccatctgattgcacaaatgctcagcacattgcctaaaagacgataacacattttattacttcagcttatttgggggaagaaaacaaaacaataccatcataggtctcgtttacaacaaatatgtattgagctaaaaagtatgcctgtcttattgtttcttcaatgagcaattaagaaaccagtaaacaaatgccgaggttcagctggtcataggaactagcagatggatttaattttcaagtattcaccaattaggtgggagtgagtgagcctgtgagacaggagttacctgttctgcaaattctatgtaatataataaggctggaacgtgacaagtcatggaaaagcagggagcacctaaatcagtagttcttaatcctgacaacattattatcacatggaagttcttaaccctgaatcaataagaaagtcactccagaccaattaaacaggattgttaccagaccgtagtacacattcagtaactgttattattattactaattataacattgatttttgcatccatatacatgtatttctaactacatggtcctctcatgaaatcatgtggacaacttagtactcaagacatagcattttactgccttttaattcttgtcaccacgctccaaaatgttgtgagtactcacttacggaattcaaataatcattgcagaacccaacaataacaaggaaaagttagagtattgctctctctaaaatgggcagaagtctctttattttattcagaacctatctgttagaattttgagatctgagttcagctccacagttatggagtttttaacatgtggtcttgaataaaattatgtgttcactgtgtttacagcaaatagtaatagctcatatttattgaagctgatgggaaacaaacaaacttggaagggaggtgttacttaaatctttcttttctaagcaattcatatgtcagagtttacaacatatttcagaagttcctaatgagttttccattatgcctgtaaaactttcaattgtattgactttatgtattgtattataagtctagaacagggctggtgaactgcttctataagaacaagatagtaaatactttagactttacatgccatatggcttatgttgcaactattcaactctgctttgtagtacaagagcacagctacagacagtaaataacaaatgggcatggctgtgtttcagcaaaacttatacaaaaacaagcaatgggttggatttggcctgcaggctgtagtttactgactcctagtctagaatacactttgtttctgtttttaagatcacaacacttttggggttctccaaagaatggacaatacctattttgttatttatttatttatttatttatttatttatttatttatttatttattttagacagagtctcactctattgcccaggctagagtgcaatggtgcgatctcggctcactgcaacctctgcctcccaggttcaagcgatcaagcgattctcctgcctcagcctcctgagtagctgggattacaggcgcctgccaccacgccgggctaatttttgtattttcagtagaaacgggttttcatcatgttggccgggctggtcttgaactcctgacctcatgatctgcctgcctcagcctcccaaagtacatttataactctaagatctgcataatctgtgagtctactttgcttttctttttgtctgtcgtatctcctggccacttttcatatccggtaatattttattgaatgtcagacattgcataaaataaacatatgggtttcaaatcatactggctaatgtatcccaaaaagtatccttcctttccttagctattcaaatacagtgaggagttgatactttaattcattcggaaattgatctgggtcagggctgttttgcacttttaataagactatatctgcttaggctgcctttctccatgatgtttgtagagcctatatgtgcccatcctgtcagctctgagagacagagggagattcagctcagccttcagaagttgctagttccatgttctagctttctgcccaagcaacttcaaaatctatcaactgtcttgagggtgagaccagctgggtgcttaacactggactcttccctaagttcccaaagctcttaaaggaaagggaaaattgcaattctgcatttaagaagtcttcatcctatctcctcagctttttacacagggcagaagctcagcaaatgtttcacgagaaaaaaaatctcagcaggatttttagggcccctcaaattttcactatatttttccatctctggccaaccaaattatattcatttatctttctacccgagaggtgctctgcctcacccgtgcttgaccctcaattcttacccagaattaagaaactttcgcaggagaaaaagaaatgaattaaatatttggcttacctcagaaaagatctctactttctggaaatttagttcatctcattctcactacttacatagctctctgatgtccttgaaagtgtcatttttgtaatttatgtgagtttttctagttgcaatgacaaaatcattggtcttatataagtgagacattatcccaaaccagtaaatttaaattgtattataaaaaagaaaaataatctttagtcacatatgattgtgttcccttggaaattttaaggaagcctaatatgtatatgaaatatctctaataaatatactttttttctatttttaaccttataacttactactgattatatcactaaaagctgaggagatttttaagcttctcccaaagtatgcctttagtgtggcttggaggataaatgttagagtcagttttaggcattgaaactttttgaagtgtcttcacggccataccactctgaatgggcctgatcttgtctgaaagtttttgaagtgaaacttatttataggatagaatataattgtatagtatataacatatatatagtatatatataattgtatagtataattgtaattgaatataattgtatagaaaagtatatttagactaataccaaagggaaaaaaattacaaaagaaactatactgtgttattcaatcatttatgtatccattcatctacccattaattcattatacaaataatcattgacctttaactatgtgccaagtagagctcaaggacctggagaagcaacttgaatgtaacacacaataaattcaatgtaaatataaatagacaggagatgcgattaaaaataattacaaattcttatatgttaaaggaaattagcagggtgccaacatacagaataatgtttggaaacgacttcagattaaaataaaataaaataaaaaacagtgaggtctctctatttcttcttagaaataacatttaatactgtgacctgaaagatgagatgaatgcatgagataaacatgtaaacggtagagagaatgactatgtcaggaaatgacagcacattccatgtagcgaaaataacatatggaaataccttgaggtctttaagaaagcaaaaagatctactggccagaggtagtaagcaagaagagagtgtcatgacatgaggctggagagagctgtgccttaaggcctttgctaggagtttggatttaatactaagtgcaatgggaatgcattgagaagagggatggtttgattagatctaattaaagagggtcatatgaggtttctatggaggatagaccatagggtggcaggactggaaactttgaaacctgctgcagtaatccagacgagagatgatggtgtcttttattaaggttagtaatcacatttggctggttataatgtcatttttctgaggcagggaaggcagggccatgaggaataatttgggacagatgaggttttgggttgtcaaaggttgtttctattaaatctggagaatgtaattggatatgggagtcggaaactcagattctaatttctggacaggaaataattttggaagtcatcaacacaaagaacaggagattaggaagtaaaaaatggttgtgtatttatccctttctaaattttgataatgaatgagagcagaagaatagggtagtagttaggaggatgtgtaaggccaaaaaagggttttgtattattttgttttgttttaaatgagaaatattataacatttttatatgttaaaataaatgatccagtaaaaatttagaagagaaacatgaaaaattaaagaaaacccaagaaggcaaaaagaaatgttagccatagcaaaagtcaaaaaattcactttggtaggaaaaaagatactttctcctttataaccagaggaaagcagatgggaaagatgaatacagtgaaaagagcttagtgggttttgtgtgggagagattatggggttttcatctgatggattttttttttctccatttagtatgaggcaggatcattagctaagagtgaggatttaggaggaaatgtgtgtctttccaagagagatgaaaaggtataaaacagtaatttccagaaggttgaaaataagcctattagagaaatataataggattagcaggctgcattgtacaacctgaagtctgaaatacagaatttagagtatagctgtcagtttagttatgatttttctccaacaaagttgagctacttgtatgcaggtgcagggaaggtatttgttaaagccttgctattcagaatgttttctgaggaccagaagtgtccgcagcacctgagagcttgttagaaatgtagcatcttagactgccccagacttacgttatcagaatcagcaactttgaaaagtgctctttgtgattcactgcacattaaagtttgagaaacactgtggtagattttatccagcgttgatattttgatgaatcaatccattggcattagagagaggcaaagaagtaaaatgactgttagttagcatcataccatcacaaaacatattatattaggtgatatctgattttcctcttctgggcatatgggaggattgtacttcctcacccccttgatgttaggtacctatgtgactagttctggtcaattggttgtgcatggaggtgaccattgccatgtcaggcctgagagtgtcattcattgccattgcaaggtcttttatcctccatcatctcaagcccttgaaggactgtaataaacagagcctccctgatgatgtgggttgcatatgcggtgtgataaatattcctttgtggctttcaggtactgagattttgaagtagttagtacagcataatctatcctattctgactggtgtacaatccctagaaccagaaaagtcaagtaatggaaatagaattgagaaatctacagagaaacatcatgttacttagtgctctgcttctgattggggaggtttctaaaagcttgggcaccagtctgtggccactatactgttttgagctcacagagcatgctctagttccatctgctggctcaaaatatttatgagaacatctagatttgtttgatgtttagaaaagacgtctcacctacatatgtcctttgctcaggattgcagttttgtcaaattctagccaaaaactctgaaattaaagctattccttgtttatattggataggcaaatttactatgctctcattcttattttggaaatttcaggttttacagcaaaatatgcacagtttatacctgactcaattttctccatggctcagtttattcccaacaataattttcagttctcaaattcatgctgtccaatctctcacttcagatattcctcagacaagaaactgggatatctgaagcacttttggccaaatgctgttcaacacaccattctgagttctatgtgatacctacatgattcatgcagtgaaattctggaccaaatctgccctatcatatcgtctccagacaatgattttattttcagacttgatgtttccactttagggcaactctgagatgaacacaaactcttcgtatcaaacatagggaaaattaagaaatattcatttaccagaactaagggtataccttctttttcacatagaataatctctatatttcctggagacttcaggtagatttataaataatcaaatgccattgtccaatgagtgactttggtcttaggaaattacagattatgaactaaattaaaagatgtatatttagattgttgctttatgaaaaaagctctatgtataattatcttttaattgaagccacttagaactgtgaaagcctttaacataccttgcagatgggctgtaggagttgatgctgaaaataatatataaatatgtgatgtttaaaatgtatcatttgcacagagcaactatgataaacctttttttaatattcacacaatagcggcaactgtggctggcagtaggaggcttgaaatgaaaagaataaggttatttcagaaacacacctactctttaaaccatgaccctctccacatctctctataaaaagaacaaggaggcttaatccagaactctgaagagcaactatttttagactcatttttccccctttcactgttgatcttctcaatagtagtaaatatgaatgacacagaaacttttaagacttgtcctttggagcaataatgctcacagtgttgcaatgtgagcaagcataatcactgataattataattttaaaaggaaatatgaaaattacaaaaaacctttctgaattatttccatgattaaattacaataatcaaaacatgctacccaaaggaaatggagtccttaaggtaaccttgggttttattcaacctccacttgagtaaaactacctacaaaatcttctataggtattggtaaatggctttagaaacggttacacattatattccataaaaacaactactactcaaataattttcaatacctcaagagtccggtaagttgtttcatgtcttttgtttcttcatatgaaaaagattgaatttctccttaacgcaaacatggttgataatgatttttaaatattctggacagattaaacatacgaacacatttaaatattgtcaaaatgcttattttgacaatttctaatgaaagcaccatataaaacctgagtgaagcatatagtattagttaagcacatgaactaaggatcagactgcctgggctcaaatctccatagtcactacttaggagctatgcaatcctggagaatgcagttaaccttactaagtctccactccttcatctgtaaatgtgaatcattatggcacctccaaggattgttttaaagctcaagtgaggtaccccttataaaacatgtagtctcatgcttgcgatataatcagaatgataaatgattgttgttattattttctaaaggtagcaagtatataactgtagatgtctaaaatttctgaattcatttgcctacttatattaattggatatagtttacaaagcaattctgtcaggaagtgtaaaagttctccaattattacatatttctttgttttgaataattatggactactgcttttaccttgccaacatttgtggattatagttgaaagtaaaataaaatcctcctgtagttttagttcaattcagcaagccctttgaacaggtacttttgtgtgtcacatagcgttttagagattatagtggaaacaaagatgaagaagaaactacaggctctttaggagtttatggtctagtggaatggataagataacaacacaaacactatagtaatataagatacagcaagattacttctatgagcctgaaaatagagatcatatcatgattgcagttatccaaaaagaattcgtgaaggagaaaagagagagaacaatttaatgagaggattttgggagagcatttaaagtgacagaatagcatgagtcagggagcaaagacagaatccatgattattgcagggagaagtggtgagaaatttagacagattgttactagggtacttgtagtagtcgtaatagaacagtggggtgaaccaagctgaccattatagatcataatgacttctgcataaactataggaagtatatattttcaaatattgacttatagcttctctcaaaagaaagacctaggaatccttaggtattggaaattaacgcagggggatatcaaagccagaactgtaggaaaaagctattggagtgttagatcatacataagccttggctgctggaagctgaggtcctaaagcctttgtgaggatgctaacgacacctctcacacaagcagcgatgcccttccaagcctccagcaatgacccagcactgtattgctgctctagcctcatgaagtagaaaaaccctatgcattctcaggcctgcaatgtgtctaagaaatttgtaattcatacagagtttcttggagaagaggaaataaattgcctttcagaaatggaaactcctagtctgaaccaagaacagatggaattaacatcaaaagttgcataaattgattcaggaccagtgaactgcctgaaggctccacacccagagaaatgcactcaaaagcatctctaacaactgtttcacaaaccaggcacttggggctcccaaaagataaatatatcccattgaatataagtttacaataattataaatatcatgaagcaaaacattatgaagaagaatcagcaaatgcaggaatcaggagactcagcaaaacaagaaatttaaaagaataggaaatatttttaaaactataatatattgtttaaaatcgttaagacatgaaagaacagaaataattaaaatcattaagatgtgaaagaacagttaaataattaaagaatatgaaaaactttaaacagaacttctataagtaaaatattgtcattgaaattaatgaatagaataaatagccaattagattcagttgaagaaagattcaaccttctggaagttaagtactgaagacctataccaggatccatctcgtgtctataggaaaaggatggagatgagaaacactatatagctagcatttcgagaaattggatcttgaatttgggagaagaggaaacagtcactgaatgtccacttttaacctctatttttatattaacccatcataataacaacgtgattattttctcctttttacagataaatgaaataatcctaggagagagttaaataattttttccaatggttctttgtaataagtagtagaaccacaatttaaatctaggttttattattacaactgctacttagacatgacatactaacaagatttccagaaagcatactttgtaggtaactggaaattttaatttaaaacttaaaaagttgttgggctcaaaccaaattttgtacctctgatattgattttgaagagaaccagggagaaaacagtagttgaaaggaagtagcaataagagaagttgatatttaaataagatatatgatatcaggcaatttttttttgagagagaaatattgaagaagggattggatgggattcaaaaccttagaaataaccatagaattaaaccatagagatgacaacaaaggaggagaagtagaatgcaaataaaggacagtttgaaacaaggaagaggtaagatgagcaaacccatttattctcaacttcataatccagaaagaaaaaagggaaaacaatctagcagataaacctggacatgtcattctaggaaataggtagtgaaagggtagacataaggcaaaaaaaagagaactcttcacagtatgcatgtgttgtggatagaagatcaagaactgggaaattgtctttcaactaaatacgttctggacagaaacgtatgttattcaaacattctttataccctgtataaagacaacgaatagtctcaccagtgtgtaaaaatattacaaggtagttgtcccgagtgcttttcacctacaatgccaggaaggatgctaatcagtgccaattgttagagctggtgttgtcatctgggcacctgtttgctaagagctggactgacaacaactcattctacataagccttctaagcagctgtcagatggcaatgacgttaatttactactgacttgggccagatttgatgctgacccagacgtgacagactggctttcctattagttgagccatccagtgccttctgtaactatttttattgcaaacagaaagcatgtctaaatgttttatttctcaagattcaattctatgttgtgatgtttttgtttgaggatatctgtacaagttaaatccctcacaggcacaggtatgggttgccaaaataatagagaaagggctgatttgaggcagtcagacattaattatttaccgtggcaaccattgctacattccattcctaatggagaacaatttagtcttctgcagctttgagtatcacagctgtgatttgcattgccagcacaaaactgaggactgaatttcatgactttttttaggttagactctattaccttcatttctcttcaaaactttcctcacccttcatgcatatcctgagacacccctgtgcctaatgttattgaggaagagcaaaaggacaagtgcagctagagcaccagacgtttttcagctcagaagcagcactacctctttaagtcaggtagtgtgtttgtctcatgctatttgttaccagtgtttcctatggactatgttcatgagtaagttacatctttcaagtgtgcctaacttaatcctatgacctaacaacctaagcatagatggaagttgattcaataacccattcattcctttaactcattcattcagtatgttgaataaggttctagataatgggaataaaataataaacaaaacctcctccttcagaaggcttatattaatattttaatggcacaggcagaaaaatgaaaaaaacaagaaatagaaggcacaatggcaggtaaggttgagcctgataaagtctgggagatgactgagaatgacacggactccattttaggtaggaagtcaggtaagacctttctgagaaggcgacaaaaagcatgtgaatgcttgtggaaagactattcaaggcccccgccatcccctcgctcccacaaaaaaaaaaaaagcaagacaaaggccctgagatatgcattttcctaatgttattgaggaagagcaaaaagacaagtgccactagagcacagcaaatggcggggaacggggaagaactccgcagaaactagagcatgtagggcacacagaccttgggaaagcaagatgctttcgtgtatgctctagcttctgctaattatcttaggcttgtgtgggttgaattgtgttaagaaaattacttttaaaacatttttaatatatagatctatttttcaaatctcagaggaaacatggtaagctgagtgtccaatgaactcaattacataaataataagctgcaaagttgaaacacaaacctaggcacacctggctctaaagcccattccattatattgcaccacaaaggtgtacttagggcataacaactgaattcactgcaacaaaattttgctatgctgtttgctaagactgtgaataaggcagggagactaccctcaagtttcagaaagactattgggacagaaaaataagcagataatcaccattctctgtgataaaagtcatgtctgtataaaagataacaagagaaggctttgattaactctgtttagttatttagaagaacaagaactaaatatgagtggtttttaaagaagagaccatggaagaaaagagggtagaatatctattgtgaaaatctgaagtcatgaaacgcatgacctgaacagaaaattgcaaataattaccagtagtttagaagcagcactggagttcagcctggtggtacagcctggtacaaagtagaaaccagctggcttctactttgagggttcatgtccttcttattggccagtgccgtgtctctttcatgaataaatacgtaaatatcactccattaccagacaattagcactgacactacagagataggtaaaagccagattactgatgccgtgtcagtcatttgggttttagtccatggttgatggcagctaccaaagagagatgaaaaggaatgaaagaatagggagaagtacctaaatatgttatgacttttagcataacacaatggaaataaagtatgtctctaaagattttattttaccaaaattgttttagacatctttacagaaaaagaaaagtaaaatatatgagatttcaacactttctgaaatataatacttagaaaatttatacttttttgattagatcagattgattgccatactttaaaagatttgttggcacagttcttgatgggaaattggtaattgcaattaatgtactttaaccttcctatttcactatttctctggcctgttaattattgattatttcatttttttttagttaattttatacaaatttagcaaagaaaaggtacagattaaacttttagtaaacaagtaaaagtataatggattcctgctatttctttaccttctcttaccttactattctttcgcattataagatgtttttcctcccttgaactgtacaacaagcaaatataagaattggcagcacatttctctgaccatcaaactaatttaagctttgcattttaatagttcattctgttgctgaagacccagcagagagttttcaattgtttttgctgtttttttttaaaaaaaaagctaaagcaatctggttttcaatcatgtcatagtaaatctccaaagtttaaagatattttaagtaaatttgtgctgctaataactttctttgctgctctatagagatgtgttcattttaagaggtaaggcaaaagttaataagctcagcttgttggtaaaaatggctatttttgaagtgtttataatctcccatctctgatcacaccttactaaacagtcccccatgtttaccacatgctaaagtatttttgatttttactccaattaagaacctaaattaatacacattttcccaaatgtgttgaattgtgtgttctaactagaaatggcaagtttgtcaagcctgccgaaaagtatacactcattaattcttgcatgctggatgtttatccatctgagtatgggatacacacaatttacagttttcaaatcctcccaagcattgcaaggctattttaagttaattgagcaattttaaataaagttgtttgatgaagttattcagataaatggtaatgaagattctgatgtttgctctgttcttttgaccatcacagattaaagagcaccttgctaaggggcagcgaatgctggcaggtgatggaatgtcccaggtgaccaagacactgttggatttaactcagagaaaaaatttctatgcaggcgatcttctgatgtctgtggagatcctgagaaatgtgacagacacatttaaaagggcaagttacatccctgcatctgatggtgtccaggtaagggagacaagttcgtgaaggaaagggctagtgaagatgcaatcagtttttggtcccacgaagccagtgcagccgtcttggaggcggactggaggaagataatgctcatccaagttatgcttagtgtgagctctggaaatgacctcagttcccttagtcattctccacctcaatgtcctcgcccataaaatgcatatattacacctcaaggagatactgaatgagaacctgtatgaagtgctttgagcccccagataaaaggcactatagcaaattcaaggtggtatcatggatattttattcccacatttaatataccatcttgacataggagactattaaaaatgcattaagcataatgaaaacacattaactgtaacatgcaaaaaaacatagtttaaagtttgtttaggattttgctattagtgggggaaaaacatatttaattttatcaaactattccctgaaaatataaggcaaatagaaaattgttctagctaagaaaatacgaaattcaataacttctcacagcatatttttcttgttttggaagacttttagaacaacatcatttatttccataataaagtttaagtactcacccaatgtcagtattgcctttgccattaaaacaaagcttattgaatggcaaacaaagcatatttaatgcaactacagtttgcgtttcagattaactctttttatgctgtagattcaaaggtacttctacaaagactgctgagttcatttctgcattttcagcataatgttcttactgcatctctgcataaagttcattaaaataaagatttggcaaaactcccagattaggttttgtgttccttcagcctactctaaatttgtaagtttattggtatttcccttggaaaatacaggatttgttttgttttgttttgttttgttttgttttgttttaattagctattgaaggaaagaggaaaacaagactttttagaatcatggagtctttcataaataatactgacaccctaatttgtatagaggtacatatattgctaaaatcatatgcatatactgctgaaagaaactgctacgagaattattggtgctgaattctatattaaatcaccactgtccgtatttaaaattataattgtaaaagtacattgcctggagtggatggaagattattatcttttgaacatttcaaagatgcttttctcttacaaagatgaaacactttttttcctaagttttaaatgttaataaagtaaccaagtacttttccctgcagttctgaaatgcttctattaatatttacattaaaaatagcatttaaagtctttgacacaaaatataagttgtgatttcaaaaaaattctcataaactctgttcacagttgaaacattaggtaaagtactccatgaaataatctctaactctcaaaagtgtagggcttcaaaattcttatgtgtgcaagttcaagaaattaatgtgaccagtttatatttagaacatattttgactgagctacttatttgtgtgcataaattcaatgaaaaattccattaaccagttgcttagtcattgacattagctggtttgacttaaatagagcaatttggctaattatcttgtttcattttagtctagtcagaaataggtttctctctttccatcctacttcatcaaaggaagtatacacaaagtcctaagcacgttggtgtcctcgtcattgcctcacaaatggcagctgcattttcctatgtcattaactttactgttgtcttttggggcatctggaatgccctccttatctgaaattccttcctctcccatctctgcctgtcataattctagctcaactctggtaagtctttctgaactccagatgaccaacccccacctttatctgaaaatgatttttctcttatctgaaatttcaaagaatttttatctcttgtattctacttcccacaattttatacaaagaatttgcaaatatttactgtcttctttacttgattataaactctggtttataatcttcatcaatattctttgaacttcacgttactttagtttttgccatgtccaagggctctgggcatttctaattggctagcaactcaggattaatgtggcataaactaatcttaattccaagttttcttgcatttctccactttttaaaaatagaattagtagtccctagctagaattgaaatgccatcttgactttttccttttctcttttctcttgggtctgcctacttaatgcctctttcatccattctttcctctctctttccactactgtcatccaggtcagcctctaattacctcagcctacatgatttctgtggcctcttccttttgatcctccctcgcctgtttacctacatccctagcaatgttatatactgtggtactataatttatcatagaacagctctgattatgtcactgtctactcaaaaacctttggtagagcttcaagtcttcccgaatgacaacttgaagtcattatactgcctcctagtacactccacatatgtaggttacctacctttccagcctcatgtgtggattactctttctcctcacagaccagccacttgaggtaaatgaaccacttcctgattcctgaaagcactgtatgttcttggctctgggtctttgcttcctctgtgttttcagaccggcttcgtctatctcaatctgctgttgaagttctcaggtcttatgggcctgtgaactccaagagcatttcctcttctgcatctcatcatatcttgtagtatcagcactaattagcaaatcttcggaaaaaaagacatgtttctgatccatctttggaccctagccaagtgccagcccacctcctgcaaataagatttcacatagaatcctgtctatagaagatgttcaacaaatgtttgttgaatgtattaacaacaaaagtagtggtaataatcacagaggtatccatgaacttttttcatcctttttccagtagaaaatgatgagaaaagataaaagagaaattaagtaaaattaaagggaatatattcttttaaatgtagttatgtgcaaggtattttattaaaaatggctggtaatgttgtactcaattaaaaacttgattggatattttgatgaaagagacatagaattgtctactatatactaactactacagacagaatagcttatattagcaagatcataggaaaagtttggatatctggttagtaaattattggaatgtactccaataaacatacacaggcacatacaaatatgtgcatatgcatatacttttttctattgaaaatcaaatgaattaaaccatgaagaccttgaaaacttttgaaggcctttaatatggctgtgatgatattgtgaattaaaccaggcgcagtggctcatgtctgtaatcacagcactttgggaggtcaaggcaggctgatcccttgaggtcaggagtttgagaccagcctggacaacatggtgaaaccctgttgctactaaaaatacaaaaaaaaaaaaaaaaaaaaagcagtgcatggtagtgcatgcctgtaattctagctactcgggagcctgaggcggtatctcttgaacccgggaatcggaggtctcagtgagctgagatcacaccactgcactccggcctgggtgacagagtgacactctgtcttaaataaataaataaataaataaataaataaataaaattatgaattaggatcataagaattggcctgattcctcccaacacatgaggtccttaagttaaaatgactcctgtttttaattgtcattattatttctaaaaggtaacttattttttggcctatggaggaaactcattcatgaaaaatttaattcagcagggtttctaaataccactaagacactttgttcttgtatttgtatataaaaacatttattttttatattatctacctctgttcagtaatagtaattcagaatgtgagagatttatgtaagtattttaactaacaaatccatagaattgtatgaacccttaaaatttcaaattatataagttattattgttgtcatctcctaaatcaattcacaacaaacctatttttaaacgttagtacaatattcttctttcattgctttaacatgtagcttgacaacttcataaatcagaatattgtattcaccttaagaaattaataaaattgtgaagttaatctttccccagattattcaccttactgagggacagcattaaaatcacatgagccactgcagtttaagttcttggagttaatgtcctcttttactaagagcaataatttgctgccattgacaatggagaaaagaagaagcaacatctataacccctacatttttcttaaaccaaaaaagtgtatagcttttccttattccatcctgattatcctgtgaagataattagaacttatcaaagtaaaagagtatcacttctatttagttaaaaaaatatgcatggctgaatcccaaaagtatcacattactaaatcaacaccaaattccattaaaatgggcacagttacttcagtaaggaacatgggttaactaccagcaaagctgtttcccttcattcattactctgtctgtgtgtagccacttaactctttggcaactgttgcatactatgattaagtccatatcaaagcctatatatgatacccattgtttatttttgatgccaaaactgaaatagatcagtaaaaagagaaaaaacaaaggaaataatttatgacattatcaccattttcaactagccactcactagatctctaagaggagaagtgaatgcaacatatgcagctgtaccccgaagaggtggtgcagaggctttgtctggtcagctgtcgggtcataagatgaagctccctctaagatcctattctttcctaaaagtacccatctttggatacaactataaaactgtattttatcctggcttagacaatatcacctataatatacacctttatttgtgccctgtatgtaagaaaagctgctgtgtgtatacctgtgacaatactaagctgtctttcattttaagtcccaaccttgatttatgagatgttaaaattgtaaaaacctcatacaataaaaatgtgcttatatgttttggaatgataagccacagtaataattttattttggaaaactagtagaacatatttcaaaaacttttcccttcaagcatattcttttccaaacctttggactgtcataactccaagactattcattaaagccatgtggtatagctttcccttttcttttttttttttttttgagatggagtctcgcactgtcgcccaggctggagatcagtggcgagatcttcgctcactgcaagctctgcctcccgggttcacgccattctcctgcctcagcctcccgagtagctggggctacagacgcccgccaccacgccccgctaattttttgtatttttagtagagatggggtttcaccgtgttagccaggatggtctccatctcctgacctcgtgatctgcccgcctcaacctcccaaagttctgggattacaggcgtgagccactgcgcccagccagatttcccttttctcatctgacttatgtttctttaagatccagcttaaagatatcttttgttgttgttgttctcaaaagtctcaccaaatcccaggcagattaaatttttttctacttctgtgggcttttgaaatcttgtaaacatccgtactacagaactttcacacacaacatcataattattgttgctaggtctgccttcagcaatattttttaagctctttgagagattattttgtccctagggcttagcttggtacttgaagcatgtagacactcaaatatttgttgatataattaatgaataactaagggtaatataataatgtttgaggaacttacattgtttcacaaaatattagaaaactgctctgaatatctaattcagaggaaaaaaagaaaaaaaaatacttgttcatttacttttttttcaccactgaaataattcattctgaatcttattctatcagtagaggattgagttggcactgcttgctccagaaactttaagacttaataaaatttaatcagacatatttaaaatcaaatttcagcctgtccagctatcttagtatcttcaggcatgttacttaatctttgtctaccttatttcttagtttctgtaaaaaaaagaaacaaagaagggataatagtcaattcattgtttgtgataggtatagtctataacattacagcagacactgaattaacaaatactgaaccattgctccaaagggaaatacaggattaggtccctttgagaatctggtcacaacattttcatcaaccaatcaaaatgactttgttttatgtgcgtttcagttaaaatacaccttatttaatgtatgttgttgatgcactaacattgaactcatagccgacagcactttatctcatgcctaaacaaggtttatctaacatacttattttctatgtaaggtataggataactttgttgtgcttaagatcactagatactacttcagcaccattctgggctcattttaagcagtgaaatcaacaaaacaaaaagccccaaaagtatgaaacatgtggcaataaaaagatctgaaatgtatacttggttataatataagggttaaaacaaaaaggcagaacatcatcatgttagacctcagctagaaaagtgcacattggccaactcaaaatttttaccactttgtgcatgtccacagttggctatgatggtgctgtgcattttagtttcaatattacaaataaattttaacacataggtcgattcagaaatataaaatctgtgaatcatgaagattaactgttatccatttttcagggatatggtgaggctcagaaatatataacagtccatacataatatttgtttattacttggcacatagtaagtaccacataataccattattgctagtattttaattaccaacatagaagaaaaacatgagccttggcctcaagctgcttatgatatcattgaagaaaaaaaaataacttgaatgaggctatactggagtgatataagtatagcatgttccacttctatgaattttcgaaagaggtctgaacaacagcagtaagtaaagatgtcatggtagaattagaacttaagatagaatctggagaagcaagttaggtacagaaatactcaataattaaactatgcagtcaaaagtacagaaatagtgtaagaatggcatgtccattagaaaaaccttcctgtctttatgatctgcattttccaccattcatcctactttggaaaatattttggaaaatagggtgcatggtggaaaatgcagatcataaaggcaggaaagttgaggccacataaaagagtttgaacttgattctctataaacagatttactaaatataaagattatttttagaaagatggtctgaaaaggtaaataacatggattggtgagtagagaaagagtggggaaggagggggaataagcccatggaggtgctatggcagtgacctagatatgagaaaagaagagagcgtgtcttagtgacagtgggtcagaaaagaggaaagaaacatcttcatggaaggaaagaaaggcccttgaaacagtttagatttgggggacaaagaaagaaaatattggaaaaaatacacacatagaaatgtccacaggtcctcacagtgtactgtgttcctgaaactcatctgaatgcaaggaccagtctctacccaggcatgttcctactcattgatcacacttctgtggacctaacagaagatcagtgttttcccaatgtttttgactgtgacttgctgtaaaacacacagttacattaacatgcagttgaaaactagagttttccaaaataatatttacctcactctgtgtaataatacactctggtattctccattattttttatttcattaagaaaaattaatcatgaccttgaaacaggtcattactcaacattggaaagctacttgtttatctgatacatccgctaggtttaagaaatttgtttctcaatagctgagattaaataggaagctctaaccttagttttctgatttcttttttaagttcagactatattctaaacgaatgatcagaggtaggtgatcaaggaattaaattgaaagcagaagtagtaatttcaacaaaaccaagcatcttttatctttttttttttttttttgatggagttttgctctgtcgccaggctggagtacagtggcatgatctcggctcactgcaacctccgcctccctggttcaagcgattctcctgcctcagccttttgaatagctgggactacaggtgcataccaccacgcctggctaatttttgtatttttaatagacaagggatttcgccatgttggccacgatggtcttgatctcctgacctcatgatccacccaccttggcctcccaaagtgctgggattataggcatgaaccactgcgcccagccaaatcttttatcttaaaacacttgatgagcaagcagatatgttgcaccatggattactcccatgctgattatcaatagattaagtcacttggtgaagaccttggagtatggtttctccattggttttaatgccagacactattggcttttttatattaaaaattgggttgataaatttggaagcaactattaatatgataatataataccctcatataatgataggcctcatctgtagaggtagtataattttgttgactaaataagatctgggaaggcttttctgggttggaattacagtacaactctagccttcaagacacaacctgataccttgagatcctctgctcaagaggcattgtgtaaccagaaaggctaataattttctcaaacatcagtaagggagatagggaatggaagcaggggagtagggtgtgatgagtaagagtacttgctctgaccttcaagatgtggctttaacacttgttagctctgtgatccaagacaagttattcaaccactctatgcctcaattttctattcaacaatatgggataatagtacttaccttataggattcatgtgagggttaaactttctatgtcaagtacttactcagtacctgacacctggtaggtctcaagaaatgtggctattattatcatccaacaagacaaaaatggaacaaaaatttacagtccttagagcacaggtagctactgccaatgcagatatgtaattggtatctctcctgccaagaaagaaaggttgaatgtttctcatggaaccacctaagggagtgtgggcactgctttttttattttttatttttttcacttattatggaagaaaagggcagggaatgtatcagggaaaatggaaacaaaaaaaagcagcactcatctttaaggtcagcactgaagggccattttgtagttagagagcaaggggataagaaaaattgcttcaatcaatagccaggatgcctggctcagtagaaaataagccaggtacaggacagtagctcccagccaacaatcactccaagtcatctaaatggctgctgttttcaatgcttaacagcctgagaagatttcctattgtttctctgtggtatagaaagcctaacataactagcatcacttcctagataatatttaaaccccgcccttattgtaaacatgacaataagaaatttaatggcaaataactttcttaagtgggtgaaatatgaagcaatagatcttgcttcacaacccaacatggttaaatcctaccgtgaacgaatctggaagataactggtaactgaggggaactaacaagctccatagaagagcccggagtatgcaacacaaccacgtaggaagaggaagagaggtaaagtagttttaagaatgtatgaagtgcaatgtatcagctggtaaatgccatgtgcagtaaataaattagtttggtcgagtttttaaaaaatacaataaaacatgagactgctagttttaccttttccgaagctcctattattttcttcagagtcaagaaaatattgagatttgcattagtaaaagttacagatggttttatgttgtgattccatttattatcaaatattctactgttttaaaaagtttttattgaagaatgttttggtttattagggctaccataacaaataccacaaactgagtgacttaaacaacaaacatttattttctcacagttctggaggctagatctccaagatcgaggtcacgacaggtttggtttctcatgaggcctctctctttggcttgtagatggctgccttctctctctgtcttttacacatggtctttttctctacacacttgcatccctggtgtctctctgtgtgttctaatatcctcttcttttttttttttctttatcttttattatactttaagttctagggtacatgtgcacaacgtgcaggtttgttacgtatgtatacatgtgccatgttggtgtgctgcacccattaactagtcatttacattaggtgtttctcctaatgctatccctcccccctcccccgaccccatgacaggccctggtgtgtgatgttccccaccctgtgtccaagtgttctcattgttcagttcccacctatgagtgagaacatgcggtgttaaggacaccagtcagattagattagggcccaccctgattcactctttctaacttaatttcctttttaacagccctatgtccaaagacaatcacatctgagctactgggtactaggactttaacataacgattttggggttggggggtgctgagatatagtgagcctataacaaggaatcttgaaggactatgagaattttcttttattgaaggggtctgtgtcagtcatctttcttcaggactggacctgctgtgactactgcctgtagtcttgtaagggtctaaacttgtgatgtgtgcaggcttctctcacatggtggcccttaagtgtatcagccaggcctaccaaacttgagggatcactcattaccttattcctcacttaagaaacatctcctttctgaacatgatgatgattttgtcacactgagttatgatatttttataacattgggtgttctcccaggctgtctctggggaaaaaatcatatttaatggtgttagtatcattaactatttttacctttcatttttaaaaggggactgtaggcaatactgagctcatgccccaaagcactaaagattggatgacttattctttccacttagcttcatcccatctagtatacctcacagcagaattactctgttgcctcttgttggagtccttgatcctaaaggtaactcagaggtactgagagcgttgtataaaaaattccccatctgagctattctgagactccacaagttaaactctcttacatcatggcaaagcaatgagattagtatgaaagacaatgattcctggaacaatgttcttacgcagttttcacaatgagtcagagctataagaagtcttttttaaaatgtgttcttaaagacttttttcacatggtcttttgtgaccacgtgactattacaggcgtacgccaccattcccggccgacctagtgagtattaggatatattagtttcaattatctgttctcacattccttttggtctggcaggttgcagtgggaaagcaaggacagaccagccctgccatcagaagccctctgaataccactgtcaggtcaggtcatctggcctgctgcagaccccactattgaccttgatatccttgtccttcagatgtcgccctatcttttgtcttccagttttccagtggctcagatttttgactctagatcatattcttcttatgccttggtttctgaaacctgctagatggcatcctgtattataatattctgcctttctgaatccttgttagttttcagttgccagtgctcaattgatgtgctgcttggataaacattctggataaaaggtctcaaccatggtattgggcctcttggtcttgcttgattaggagttattttgcttattcacctattaccaaaaaagtacctagagcactctttagagattacttactatttttttttaagagcaaactcaagatgatttccataataatgttgttcttacttaatttcatttcagtatactttcttgactagaataggatactatgaggtagagttgaagccatacacagggaatctgtgatccctactttaatctataatatggatgtattcatggttttatgtatcatgcatgcaaatgttatcagccaagtgcatcaggggaaaaaaaaacgagatctactattaggttgatgcaaaagtaattgcagtttttaatggaaaaaaaacccgcatttacttttgcaccaacctatacactgtattttgaacactctttggatttttacctagttaaaagaatggtctgtctcctctggattaatctcagcagtggagagtctttttttttttcttttttttttaagatggagtctcgctctgtcacccaggctggagtgcagtggcatgatcttggctcactgtaacctatgcttcctgagttcacgcaattctcctgccttagcctcctaagtagctgggattataggtgtgcaccaccatgcctagctaatttttttttatttttagtagagaccgagtttcaccatgttggccaggctggtcttgaactcctgacctcaggagatccacccacctaggctttccaaagtgctgggatgtaaaatttatattattctgttacctgtctttcctgctttctttcttacttcgtcatcttttttttatttatttctcttcttatgaatttaccttcaatgttttaaccatgacttcatcccactcagctctagtcatgataatcttaaatttttttttgactgaaaagcctccagtttaattattcacaaatttttacctcttgagctataggcttgtagttaaacctgcccactgggtctcttttcttagctatgttgttgatccctcgtactcaatttgaacaaaacaaagttcactttcttttctcaacactgctgcttcttatgtggtagcatggctaactcatcattctcagctacctgggctaagaacgaaaggctgacttttgattctgtgcttctcctcccatgcaatctgtcgtcatgtcatttctctaaaccaagctgccatcatctttggcctcaataattaagacaaactgaattctaaccttcctgtttttactcttactctcctatactttattttccactcagtggccaaaactagactttgatttttaatacaactcatgtaatagaaccactgtgggatcaaagcctcactttacctgacccctgtgtatcattttcaccctctattaatattttcatcccttcacctcacccagccccctcttcaactctagttacgttatctttctttctgtttctcaaacttgttcagactgtcatttacccagggaatttgaacattctcttcccttttcttctggaactctcttcctcaggtctttgtgtggctgtctctttattattctggtctcagttcaaatgtgaccttcttagaaagttctttcctgatgactatctaatctaaagtaatctctctctctctctctctctctctctcacacacacacacacacacacacacacacacacaccctgctgacctattcagtctattcctataacctattttgttttcgtgtcactgtctcagtccatttgtgatgctataacaaaatacctgagactggttaattggtaacgaataaaaatatatttcccacagttctggaggctggaaagtccaacatcaaggcactggtggcaggttcagttgtctagtgatagctgctctctgctttcaagctggtcccttgttgctgcatcctctaagaggtgaggaaccctgcgtcctaacatagtggaaaacagaagggtgtgttagccaaacaccgcaggaagcttcttttataagggcagtaattccatttgcaagagaggagccctcaatggcataattacattttaaaggccccaactcttaataacattacattgtcaacagctgaattttggaggcatcatattcaaactgctgcaatcactgtctgaaatcatccttttaaatgtatttgcttactttttcttctctttacccactagagcataaattcaacgagggaagtaaccctcatatgtcttgttcactatcatattcacagcacttagaacagaacagccaaatatagagaaggcattcaatgactactacttgaataaagaaatacatttctgcttaagtatttagtatacctttcctcgttttttcatttgcacatccactgttctcctttaggccttaataatcactattttggactattgataatgatttctagtgatgccctttcttcattcttttttcttgccaaagctccctgactttactgtctggctgatatttttataactttctttataccattcctttgctgaacaaagcagcacttgtactaccaaatgcatcttgccaggagcagggtaagggtagtgatgcatagggagagttccttgtgtttggcataggatgaactgggtttttgaagttcgtgggtttatggaagaagaggcccattccttgcttgttgctgcatgtgagtttaaggaccagggttgaatatccacagctgcttcctgtagtcctacaacttctcaaaagtatgtatttgtgctcaaggatgatgttgagtcttcaaatgctgttgaaaataagaagagttcgatcccatatttactcaagataactagttttcttatctgtaaaaataagtgtcatctcttattccctggacataaggagagccctggtaacattaaaatcatcactggaagaggagggtgttgaatcaaaaaagaggcaggaaattaggtataaactatttattgttttctattaaaaaaaatccatgaatgcttagcccatttccttacacacagtgggcatgtaattcatcagttttaaatagttgagtatttacatgctgctgtgcctgatgttgtacactgggggcacaagagtgaacaaaatagaaataacttgattataaactagtagaggaaaaaaccctaaaccaatcatcatacaaataaaccataaccttaaaatcctatatacttccaaaaaaggtcacacagtaccacgagaaaaagaaaatatcagactgtataactggggaggggggagtgatgatctcataaggccttttgaggaaattgcatgtaaatctggacataaaggataataaaaggttgtctgagtatagaacagaaagaatagcagtccaagaaagcaaacagcatgtaaacagttctacaggcagggcagaaaagagtgtgggatgcatgaagaagtctaatgaacttggagtacaaatagagtatggggcaggatagcataagataaagttggagagacaggaagtggctggatcacatatggccttgcagccatcaactagttgatctctaggttggggatcaatgatctatcctatgttatgcatccttatcctaatggcttatccctgcttccttgtttgttaagcctttctgtagttcaccctatatttctagtcagagtcactgtaattcttttaaaccttcagatctaccttactaaatctgactcttagggcttgtctttgtcccttgatgtccaaccactttgctactggttaagatggaggagagcacatttcctgtggctgaaattgctagcctaatctacaactctatttccatggaaataggaattcagcaaaagcaaaatgctaagacatattttagtatatttataaaaaattgtatataatccatgagaaatctgccaagtggatgccagtcaaaagtaaaaacagaattttttattgctttccataaaataaagtgtcctttttgtctcgtatagccaaatctagggcctctactttgaatgccacagaaggatttatgcttatttttatagcatacatttattgccctgatttttgtaatacttccggcaaagaaagaatgatcatgcctctttgacctttgtgtaccacaaccattcaccataatgcctctcacatagtaggtatctaatactaacttccctgaaaccctctcccaccagagcacattcttagaaagaagagacttctgctgaacaaattatgttccccagagttagtagtgaatcagttctgttctgtacatattgttgagagaggaagagacattaaagaggatagaggagaatgctactggttgtgaaaggctgtatcagaattataggtgcgtatttgccataatgcggcaatgaatacaaatcatgcagccagtcataaaaaaatatataacataaagggaataaaatcataaagttgccatatatcaagcacttgccatgcatcagatactgtgttaagaattaactccaagcttcacgatagctctgctaggtagctattattactcttgtattacagattcaagatataaagcataggtgggcaacatctgcccataaccatacagttaataattgatggggaaaatgttaaactgggtctgcctcgttcaaactccaaacagttcagattctgccaaggacactcaatttttcaaatcagtctaggtcatggagatcaaggctgactaaaaaaaaaaaaaaaaatcaaaaaacaaaaaaaagcaaaaaaatgagacaaaaacttactgtaaggtgttgacctttttattttagggattgacataagtgacctaatccataaatcatcaaaagagaactattatcaccattaatggagttttaaaagaacactggcaagtagtggctctgctaccacagaagcagcttcatactttgaaaaattcaatcatgcggcctgaaatgtcatgagtctcctcttcaaagtgctgttctgttaggtttggttctatttatcagtctgatagtttagtaaatgtcaaagtgaatatatattcagtatgtattagtatgtgtatatatacatatatatgtgtgtgtgtgtgtgtgtgtgtgtgtgtgtgtatatatatattctatatgtgtgagacaagttagagcaaggccagctgaaagaaatggtgctaaatctttttaggaaagctgaggcgcaaaatgtggcacatgtacgctatggaatattatgcagccattaaaaagaatgaaatcatgccctgtgctgcaacatggatgcagctggaggccattatcctaagcaaattaatgcaggaacagaaaaccaaatactgcatgttctcacttataagtgggagctaaatattgggtactcatgcacataaaaatggcaaaaatagacactggggactaatagagtggggagggagggaaggagaggggaaggagctacaaacctaactactggctactgtgcttagtacctaggtgatggaatcattcatactccaaacctcagcatcacacaataaacccaggtaacacacctgcacatgtatcccctgaatctaaaattaaagttggaaaaataaagaaaaaagaaagagaagctgagatatactgactttgcaacttaaattttgttttaaatttaggactttattaaatatctgctatgagcaagtcattatatacactgaggatacactgatgaacaagaaagacttagtctcaccataaatgctgccccactgcttgagacattcagacttagctcactgtgcccctacatggatttcattagtcagggcgctactactgattattccaaagtctaatcaatagtgagaacaaataactttattctgtactgccttcccactccgatttagtaaagccacatttgttggccttgaagaagagtacagaatgcttgaagaatagtacaaaatgctatgtttggttggcccaacatgtattttaataatttgtgttttttatgtgtgccctttggtgatttaaaaaaagaactgaactctgaatttattgtcttcatcaaggaattttgtgtatgcagtggccttcatgtacagcaaggagtcaccgacccactgtcagcaaaacatgctttgtgaaatgtttttttttgtttttgttttgttttgttttgttttcagaaatggagatgcagttgcacaaattgcttcctgttctcttggtgtctcttgttagcagcagcatgcattttgtatgaaagctggcaggggttagaatgcagaccgaggtcatggacctcagcacagctaactggcatgtacagggataaaacctgcaacttttgcctcattagcaccatgtcccctactgagttaaccagtcacaggcaattggagaactctgaaggttaattctttctgaccataggtagagttagagctcaatggactaagcccttcaaatgttaacacttcaagcaggaaattttaagtggaaaaaaatggctggtagtacaaaaaggctgaaagaattgaaaaacgggtctaaaacagacttgcaggttttttaagagttgcataaaatattctgtaacttttatagaggttatgactcaaaccgtgtttcaaccatgtgattgccaggtactattaaaacaaatagcacaaatagggcaattaaatatagatactaacagcttcaaaccacaagagaagaggaaattaagcagctttgtttttcatttaatagcacccaggtgagcttctttgaaattagtgcaaatgcctgttttgagaagctggatagggaggaagactgatgagactaacaagttatgattatttctgccctcaagggagtcctggtccaagttaatgtatcagtatgaagtagtgctactgctgacctacacacagacagtcagacgagatgggttctgagaacacagccaagccaccactgcctatgcaacttaagataaacgtcatgccttccctttacacttctcaggtctcctgtgacccccaagtcacagctcgccttcaaaggcacgctggttgttctctcctggttcctgtgtcttgatggcacagtgtagtgtgaagggaaagaaaagtctctctctggtaaaaatccttcatgtgtgaaatgagcacttgcaaaataggactgaacagagccctgctctctgtcaatgtgtccattgtgaatggaatatgaacatcaaaatgaccttcctgcatgaaagaaaaaccagaaaccaatgggcactgctaggcgaagataaagccaataggtctttaacagttagagacaagaatgatggcaaggatgttatatgtctattcattctcccatgttggcttgctggcaaaaggcagaggagtaaagagtaataatttgaaaacctgctcttagcatgtgtgatatgtcaggaacttagaaacttttatttaatatttgcaattggtagttgtaaaagtataatggccaggaagggcagagtcaagatttcaactgagggagcctgtcttgcctccactttgcctatagtcttactagggtgttctttgaaacaacattgcaataacaaccacaactcacaatttaacaggacaacttgtaatgaaacaaatacagatgactttcattacagacgggatcaaacttacttgtatggaataattacacaatgacattacagagtggaatatagatactataatggaacaaataattttgagtgaaagtgttttccctattctgacctcctctgagagtacaaaaatgaaggtatatgaaaatcctagaattacggttctgtaaaaggatcctcagtgatcttctagaatactatgttagggtcataaagcaatattgcaaagtgcttatacctttaccacgtagtcaacccaaatgggtgttattaaaaagtataattctctcatgtaatattaaatcttttatctaatttaatttacagaacttctttcaaatagttagcaaccttctagatgaagaaaacaaggaaaaatgggaagatgcacaacaggtaaggttagggttatttcagaacttgaagttggcaaaacaaagtgtaaaaaatatgtgactaaattaatggcttgctatttcaggaaaacaagatatttttaagtcagtctaggttatatcctagtaatttttgaggaaacaaatgatcgttaccataccagtctggaaggaatatttatacatgtgaaaaaaagctgtgcaagtttaagcaacttaaaaccttaaggatttaatgtgtaataattatatacctaaccaataagttccttttttttttctgtagaccatgggaaaaacagcacatctaaaagtacatatttcaaatgaaagtatggagctttgactagtaaaaccatttgcatttactacaatgctacatataatatggatcacagagacagtgattttgattcaaagccaagaattgtaaaaatcaggcctcaccaaaaattatgttatgattttttaaaaatctttttgttatgctttatcagtgtagcaagtaaccttgttggtttagatattgtttataaatgctttgcatagccatttgtggtatcctaactgataagacagtgactaatttgttttcctctgaattacaggaaaagtgggttagaagtctagaaagagagaaaaattatggtttaaaaaattaaatgtaaatttagtttaactggatgtcaaacttctttaggttttctatttgactcttgttaaaaataagacaatcttgaaaaaaaaagaatgaacatttactgaggttcgggttttccctttataatcatattctgggtcttcaggagtaaagcatgccttttatcctattgtgacaggagctctaaaaatagtccagtgtggggctgcctcattattagatataaatttcatgcatctggacatagccagaaaaaaaaacccttattttaatactttaaatctatttttttctaccaatttgagttacatatttgtccttggctttcttctagaggacagcctcattcactcactgtaagaagatggtgtctttccttagaatacagctgcagaggctaagtacatctttctaggctgctagagactattaattatggatatattaagaagaaatatgtaatatcctatctaaaacaagactgcaatttatcagatgctgttatttactgtgaggtcccaactttaacaaataatgaatggtggcagaacttcttgtcaatgaaaaatcctgaattcataatccatctatttccttgagattttgagttagctatattcttatatttaaaatattttttccaataataatgatccttaatgctgtttttgaaataacgatttgaagctgaaaaaacaaaaacaaccctgttctgcagcttttactaaaaggcggtgtcataaatgcagccgtgtggtgaatgggtctcttgagtttgtggcacaaacggtgaactttgtggaaatagatgctgtttaaaatctatcaaagataatccttgtgagtctccttatttttgagtaatagcctcaacaaaagtaaatgtagaacagacctctgtgtacgtttggaaaatgagctgagtaaaatggtggctattgacattggaagttttttgcaaacaaaatttactctttcgaatagtcatttcagaatttgttacccatcagttccagttatgaaggataaaactatgtttagataaagcatcctactaaaaatgtagtctactaaagttaaaaaaaaaaactacattctatagagcaccactttacaccctacccatatggctggagttaacaagtccggtttagtcaagacaagtcattttagtcatgtattatgtttgatatttcgtcattacattgaaaattcatatgtctctagagcaagagtgagcaaactgcagccagtgagccaaatccagcttgaggcttattttgttaatcatattttggaatatagccacacccattcatttacctataatctatatacggtcgttttggtgcgacaaggaaagagttgcatttacaatagagacttcatgtcctgcaaagcctaaaatgtttactatatgcaaacagaaaaagtttgccaaccttttataacctgctctatagcatttgactacacttggagaaatataattaaaaacaaaatctttagccaacctaaaaaatctctccaccaaggtagaagggaaaaaaaacacattcattatttaataatcagtaaaccagaatgtaatgtgcatcatagccaatccactgcgattacaaagaccctattacatagccaaacagtgtcctcaaggtaaacggtaactagttctgaagagaacttaagagcaccctttgtcacgcataattcatcctaaattcacttggtaattggcagtgaccatcttgttacttaattggccttattcaaagaaaaaataacctccttatatctttatgactggaagtaattttgccacttgaagcaaaattcaagaggcctctgaagttaggcttctacctttcacagaaactgagaaagaggagcactatctttttgtatatttacctctcaaagagagacattcctggatctttaagcttgtaggagactatttagcttttaaataaattgacatgcattgcaaagagaaaaagtgcttacaattactagttttccaaaagtaaatgttcttagaaaagggagaagagagtggggttgagggagggagagactcttcccttattttcaacacaaaaaaataagcctcttattttactttgtatttattacactacacatactcatatacatatgcacctacacaaagataaggggaaaatacagtagtagcaggaagccttggtgataacaaaaatcttaggcacattcttgaaagtgggatgatgggctttcgaaattcatgtttaatgactgaaaatgaagctaagagacaggttttatctcccaaatctttctaaagttaaaaattggaactatctcagttatacatgtctaagtctaatatccatcattcatgtcttcaagtatatgtgagtaaatatactgtagatactgcctgatttttagacgggcacaaccgcaagcccctttgaaatacacatgtgcctgctatccctttcagctctgactatatgcttttctattattcagaatgccttttcgtcttctgcactagtctttgcgattacaaagcagctagaactctctaatccacttaatttttcatggctagaaaatgcagtggtgctgaatggccacaagaaattaacctgacttcaaaagattttctgctctaaagtggttatataatgcaggatgactttataagctttatgggttatacacatgaaaattcatgtgacattttcaatagcctttatgttccaaacactatgaactattgacacaatcaggttgccaaataaaaaaacactcgtccatttgtactgtatgaggtgccatgatgttgaaaaaatcacttggaccatggaggcagatggtcctctaggtaggcaggtagataagtaggtagatggatagatggatagatgcatagatggacagttaggtagatactgcttagccactattaaagatacaatatggccttaggtatgctgtttaaccttcttgaggtcttgcttcttcttgcctaaaatatggacaataatcccataagtgtgttttgtatttgtacatgtaaagcacatgcactagggctattaatattattgtaatcctaaaattattaccattattcttacagtgggcattataattattaaacaataaatgtttctctgaagatatttattattatgcaataacttaatagtttgtaaatatcttcatggtggcaatattaactctttttcctcttgtgttcctcatatagatgccaagctaaacatgtaaagagcccaatttcagtgttctatgttttgttaagtgatgaaaagagttcatcaaaagaaaagtcgtctattttttgaggagacaatctgttagatattttgagtttccttagatttatgagggattaatcactacatcatattacttccaaagttcctccaatgtgacacctgatgtcattctcaactattaatttaaaaaatacagctattggcagctgtagatttttttgaagtgaaacaaagctcatttgtgatttcatgtagtttaaaaaaattcagttatatatgccattgtatgtatagattttttattccttctaacctttgcttatttttctagatttatccagggtcaatagagttaatgcaggtgattgaagattttatacacattgttggaatggggatgatggactttcagaattcatacttaatgactggaaatgtaggtaagaaataggattttcccccaaaatctttctgaaataaaaaaaaattgcaagtatctacaccatacgtttccaagtataatattcattattcatatgtttaactgcatgtgagcaaatatatttctaacacttggtatctgacttttagatgggcctaaacacattgcattatatatatgtacgcgtatatttgtatttatcttcatgcatttgtatgattgcttgtaggcctatttttgtgtatctttacatgtatatgtaggataatatgtatttattttttcattctgccaaatgctcattgctatctaatctagttatgaatgtgtgtgtgtgtatacacactagtaattttgaaaaacaacatattagtctttatgatcttccgtacattgttcttgaggatgccgagttactttctcactgattgtcccaggcaggagctgaatctgtgtgtggtagaacacttgagaataacttccagggttaagatgatggtgcaactgctgccaatgcagtttttctgaatatgttccagtacacagtggatctctcaggtccctctgtagtggattctgtaatgcaacaaccattatattaaccaaatgacacacttctctttgtggttaaaaattaacaagcacaaagaaatagccttcttagtgatacacattgaattgatgtaggcttacagttttctcatttctttaaagcttcttctgataatgttactgtgattcagaattattttctttcatttgtcatactttaatactcttaacataaaaaccactgaaccatagatagaaatgtgtttaaataaagatattttgccctatattcgtattcacagatatttatgctttagtttctggattaggaagagacctactttggtgggagaattaactagggaagttcagctggtagagaacataatttttttttatgattaaggctgttggtggttcattttatacttaatttcttctgaaggtccctaagtcctgcagagactgattttatcctaggatatcttccaccagggtgacctcagattacaataggttatagttaactactggtaatattcttcacttgaggaaagtctatgtaatggatagttcaaacgtctggagacattttggagcccatatatcctcttcatccagcacaggccttaatcagagagtttaacatcttaatgcatcttctgagcctattggagggcccacacttttctccagagtgggtgtccagcagcttgtgccagttcagtaatggaggaagctgtaccttcttatggacaattagagtaaaaagagacaaaagatggtatctttgttgaacgatgaattcagaaatcagagaaattcccaattaaatgtccattataaaagtggctgggcagataaaggaaagaaagtccataggaacggtataacatgtctgtggaaaaggtttagcaatcacagctatgagttttaaggcacgtggaaggaatctagcaagattccagggatgctagtcacccaagccggaaccactttcctaagggaaggaaatgagttatgaagggtcttggggcagattggacaattggtaaagtaatttatgagttaaaatgagatagaaaaacagagaactattgttttcttcttcttgttgtaaatgttaacatctaatcctaaaaggtattgctaattaaaagaatgctcagatcaatacatggcatttgtgcagaatgtgtttggaataaaaactataacaaacaaagccaatctcagagtctagcaaacttaaattggatttaaacttaaatttggatttgtgtttcagaatcacagcgtatcacattctctatagctgtattatttgctgtaaaaatttcataaatgtccataaattacaatcatttattcatctttacctttctttgactcaccaagcttgtatatttgaaaatattgtgtatttttttgcaataagattatgttatctaggtttaccttcttcccttaaatgttattaaactgtaagaggtatattaagcataactcaaagcagtcgaatgctgcaaataaagtcaatatcatcctatatcattgtccatcttgcctgaggatagtgtgattgttctgccttctgattgtttatatagcaacaattatccatattaaaagttatgttctgtgagtaaaaattctaaacattatttatactgactacccaaaagacatctgatttgttgttgatttcctcaaatgctagctcagggactgactgacactgtagtttggtgactagaactgagggttatgcgccatagtattcaggagttttccaaattgtatacactagtatcaaattaagtaatatgaataatgatctcttactattaatactttttatgttatccaatttgatactatatatgtaaaacattataatgttttgtctgatatttccaatgtttttgagcatggacataaatagagactattttatagtagaaagttgtgaaacatgtgaattggccctcattctgtcttacattctaagtccaaatattaattatccaacagtctgctcattatattgagcagacatatatgcacaaacacaggcatgcactcagcatgtgagaaatgaatagagactgagtaactaagaaagtttgttccttatggccattttctttagaatgtgttggattaagactacttaaagaacttcaaaaatcataatgtattttagagagattataaattattttttcataaagtctatatgtatagctgcctcacttttctgactatagatagtacactcctgaaggaagaaggagttgaacagtcaaatatgaatgccaaaatgaccatgcaatttaataaaagactctcagaactaatagattattttatttcaactttaaatatagtttcagcatttctgttttctagttactggattagatagaatgggttggaagcagaagcagtgctattagaggcacatgtatagcaaatagaatagatgaaatgctggaacaataataacaaagaaatactttttccttactgtcatttcctaaagaaatgacacctcatgtctcacctttgagagcattagttctaagacttaggacgataatttatatttaaaagcatggccttaattcatcaagataagagttcctagaatctgattaaaatctcagaaaaggagtgacatattttagaaagactttcttcaaaaatagttcaaatgaaaaagttcgaagcttctttttttctgaaaaatctccctgtctatattggcttttgataaatgaaatgctcttatatgataaaaaattctatgaacattttggtatatatgtgtgcatgtacatttttatagggagcatgttcatagctttgatctttttcttaaaagatttatgatctcaaaacgtttagcagaggtttggaaaaaaacagtctacaaacaaagatttcaaaccaatgaatttataaaataatcaagcttcaatataatatttagttttcatttttaaatatgtatatgacatctaaaataaacacatgaaagttataatgcatgagttaatgagcatttactaaagactaaatgctctgctaaatagtttaattactatataaatgtatgaatgaatgtgtatgaaagatttcaattttcaatatgcctctttttaaaaaaaattatatttgaaatgttttaactatctgcataggtaagtggtttttgttttaggaaaagcatgtgactttttcaatatatcaataattttaaaaatgtattagtatcaattaggtctggagggccatatctttatattatttaatatgagatatttttaaaaagttattttttcaacaagacagaaagttatttttcaatgaaaatattatttgaagatttatttcaacttgttttctatacttttcctctaaacatttttccttaaggaccttgcaatcctatttctcttattatctttctgaagctcctatttgaaaagccttccagaaactctaattgccaaataaatctactcccatttttcatccttcacatcctttgtgctttgctaaccactctttcttgatactgttcattcctttaaaaattttacattaactacagtgtaaaatatactcaaaggataaatctaaactcatggcttgaaagtatttggatttcttttgcggtaatagcataaaacaaataacatgaagccctgaaaaggataaaagtacattattttgaggtccagctgtttgcagttccaaatacaaaatggagtgtatgagatctgacatgactagaatgacaaggcaagggaatgggactatattgttctaacgatttgtccaaagttacagtgatgatttatagttttggttatattttcagttatatatttttatatatttttcacaatagcttcatatagcatattacatttgcttttattgataagaatatcctattctttagaaattaattgtattagtttagaacctagaactagaattgcattcattgaactgaattcaaggaagatcagtgatgtgtcacatgttactctcccattgactatgttcaagcaaaaacaaaaataatttttctcttactgtaagcaaagcctttgctgaatgactcaggtcattaaaataaatgtctaatcttctagcctgcaagaaaattgcggtctagttgtagacagaaaagaattacataaataaataaacatcaaatacactttgatatgtgtcacataagccaaatgttagtgctttattccaggagatgttgttctgtataaggatcaagaaaaacttcttagagaaggaagcatttaatgtagactttgaagaatggctggattattgataagtcaacataaagaagagtgaatagcaaatagatggttacagtccagaacattcttttagcaaagatgatatagagatgtcaaagttgaaattgtgcttggggaaaaaaatggcctattttaatagaagcacatatgtatagaagtgaaggaagtaaaatcaaattggaaaggcatgttgattcatggttctgaattctaaagataatagggagtcactgaatctttacctgacaagagttgtgctttggtagaacatatgtaagatgagaaaatagaattgattgaagttgggaaacaccatcaacacagtgagtccaaatgtagatagaaggcttttaatagtaattcatgcaggagacaatgaagacaggaattgctggtggtaagaataggaactgacatgtgggtatgaatttgagagtctgtctgaggctagaattgataggattccataactgactggggtgtgagagatagtggagggattgatattatgtttattcaacataaatttgtgagtatttttgacatattaatatttagacaagtatagcccccaagtgaaaaaaataaaatgagaacttggattttattagaggagtcaaatctataaatacacatttggtaatcaactacataaaagtgatagttgaagtcataaaagtttttttcaattatcaatacaataataaaatagaagagacgtaaggtgatatctacgttaaaaacaaagaatcaaagttggtgtcagagtaataatgattagaggtagtaggtataaggagttccaggacaagacagtataaaatcagtgtcttataataaaatggagagaacgtttcaaattgatcgctctacttaatatcaactgctaataaagttcagtgtcttaagttaagataaactttatgggattctcaattctgtaacatgaaaattctcaaggaaaagtgcagacacagtgaacaggacctaaatgttcaagctctttatgtggtttcaatggattacacccataaaattttgatacagtaatctttatgaatttactttagatagatgaatgttgctacacccacttacagctatttcacaactgttccttaggaattatttgatgctgaaaatatcaaataagaagggaatggttttaggctaaataagatcttcaaatacagaatgctataattattagttgttaggaatttcaaaagttctgctgatatataaaccctaacagatacaagaatctaaaacatatcaatttagttatccagtaatccaataaggctagtgccttgaaagcattaaagtaagatatttttctttgaaaaggtaaatattactgtgtcttcttggtttagaaaatattaaatattaaggcgaccgggcacggtggctcacgcctgtaatcccagcactttgggaggccgaggcaggcggatcatgaggtcaggagatcgagaccatcctggctaacatggcgaaacaccgtctctactaaaaatacaaaaaattagccgggcgtggtggcgggcacctgtagtcccagctacttgggaggctgaggtaggagaatagcgtgaacccggcaggctgagcttgcagtgagccgagatcgcgccactgcactccagcctgggcgacagagcgagactccgtctcaaaaaaaaaaaaaaaaaataaaaaataataaaataaaataaatattaagtttgtcaggatgaaaattcatagttgatgttttctgaaattgaatccaaattcaacctgaaaaatggtgtgatacaatgttgacatctcctttctctgtgcaatgccttttcatcagcaccaaacctatgttctttcttatattcactggcaaacttgataatttcattggtagaatatcttgttctttaatagagaaaccaactttcagtctgacaatattattctaaaatatagtggcttctctttctaggctttattttcctttgtgtcgctgcttagttttgtgattcacacatccccatctcttgtttgacttcctttcattaaaaatgagacacttgtagtctgttgacatcacgcctgaaaaatacacaatttaacttttttttttttttttggtatgtttatttgtggcacctgacgtcagttcagtcagctagatttgagtctgaatgtgctaagttctatctctgccttctggctctttaccacccttgctaaacacctgaagctagtgggtatttttctgtaggtcaggaaaaaaaatacaacaaaaaatatctgtttctttattgtgctaacatactggtttcctgagaaaacaagtagttcaaacatagttttaaactttgatatgcagctgtagagttctttgattgcttctcatttcatagaaattatctcatggtatttactaggatcctctaattccacatggttggggtggaagcactggggagggtgacattgtgaaaggctatatcagaccctgttaggagcaaacaagacaaactgcccaggtgtgtaatgggctttcttgcacacaactgaaccccaggttgaggtgcttcctagtgctagtataatagattggtaatgattcatggatttaaccagctttaagaggtctcagacaattattcagtaaatatctgccatgttttgtcctagaagatgtctcagtgaatgaattagacaaacctcttgctctcatggaatttatgttttgtggtagagatacagatgtcaaaccatgccatcaaacatgcccagtggttataatcgttaaaagaggaatgaagcagtcgacagggtgagtggttaacgagtcaagagagcagtgtcatttcagggaggatgaccagggagggcctttcatctgcaaagcggtatttgaatatagaactgaacctttagagcatgagatgcagtgatatgtaggggcagaacacttcagacagaagaaacaataagtaagcagaaaggccatgattcacccatgtgcttcatatattagaggaactggggaaaaccactagtgctggaatagctgagggaggagcagtgggaggaaatgaagtcagaaagggagagggaagtgaagctaaaaggtatttgtctgaggtctgaaaggaatgcaaaatgcttaacaagtatttgtcacttacctaaggggatacatcctaagaaatgcatccttagactattttgttttgcgaacatcatagaatgtacttccacaaacctagatggtatagcctattacacgtctaggctacagggtatagcctattgctcctaggctacaaacctacacaacatgttactgtattgaatactgtaggcaactgtaacacaagggtaaatacttgtgtgcctaaacgtagataagctgtagtacaaatttggtataaaatattaaaaatggtacacccgcatagagcacttacaatgaatggagcgtacaggacttaaagttgctctgcatgagtcagtgagtgagtggtgagtgagtgtgagggtgtaggaaattactattcactgttgtagactttataaacactgtactcataagctacactaaatttattaaaaaaatatttttctccaaaaataaattaacttcagctaactgcaactcttttactttataaacttttttttaacttttggactcttgtaataatacattgcctaaagcacaaacatattgtacagctgtaaaaatattttctttctttatgtatttattctataaaacttttttctatttttaatttttaaattttagatttttagttttttttttggtaaacccaagacatgaattcacacattagcctaggccgtacccagggtcaggatcatcaatgtcactgtcttccccttcagatcatgtccacctgaaaggtcctcaggggaaataacatgcatggagctggcatctcctatgataacactattttcttccagaatacctcctgagggacttgcctgaggctgttttacagttaacttttttcttaaataggagtacaccctaaaataatggtaaaatgtacagtatagtaaatactaagcaatagaaatttttcagctgcattataattttatgtgactaccatcatataaagggtccacaggtgaccaaaacatcatgtggcgcatgattatcatctgatgtaggtactaaaaggatcattctgactatgaggtggagatattataatagactatttggcgcttgagtgaaaacaggaagagcagtgctgtgcttactcaggtgggagaacagaggtttgggtcaagtgacagtggaaatagtgaaaaggggtcagatgctgaagatattttagttgttgatctgaaagagcttaccagtaggtagaaatagagtgtggaagaaggagagcactcaaggaaatatatccactgcatctccaagaatccaactacagaagcaagacagatttatatcaaaaatttactttggcagctattcgaatgcctgtaaagtttagaattcaaagcagtcttattttggctttttaaaaatatgttatccttcctaactccaacccaaatccttgctcctgtggtttgagcccatttgatttttactattctcaaggagactgagcaattttatcctcagaagccatcagcattctgtcatcatcccaccatacaaatccttgggcaaaagccagaatgaaattgttcattaaaatgactttgtaactcatattgagttgccagctaacaaatgaaataattcctactttccctaccacttttgtgtgacttttttaattggaaggtccaggagcctttagaatagaactcttaaggctcaaccaagtccagcaagaaactagtcagctccattcttttgaaagctgttttcggtttttttgtttgtttgtttttgtttttaataaaaacgtaaaaataagaataccatagaagtttcttatctaagttggaaatatatttgcaaaacatcttcatctctacagctttacaaatgttatgtgtaatagaactagtctcatagttataaccctggactttaatgtcgaaaacactgatcatgttatgatgtttcaatttattagtagggctgcattcttttagaagttaactgctgtgaaaaaaagagtaatataatatttctaaatttatcttatctgttttatacacccatgctaagacacaactattcatggtgtcactattaaataatgcttcttgtccctgagaaacttgaaaacgttgtcaatactctttcttgttgtgagtaacccaaatgctctaaactttctatattatcacatattatgccaatttctagccttaaacttctgaacttccttcacaagtaccatttgagtacaacataaagaaagatatttttatttgttttttccccttttattcctcaagctttctaagaaaagttttgttacagcatcattaatatttcatagcatgccccaaattaatgttttcacaaatattcatgatactatttactcctcacaacctttctgcctgggtgagaggggtacccacataatttgtcctacatcagtgcctcccattcagagtgggtgcatttttttcccctttacatcttggtaattgaaagtcaaagatttgtttcattttcttgctcagccaaccacattctaacctacttctgttatataatgaacttcagtgtaatttttttattatgtgactctagggaaatcatactcatctgttctatatttctacatcaaggtaaaatgactcctgaccatttgttttcttttgtgctaatattcttcatatgtatccactttatttgaaaatttgaaactttttttggctaattacacaagttatgctttcataaatcttttataccatatcttagatcatgaaaaagtgaacttatttgttactccttcagtctccatcccttcagcaactgtttaggagagagggcataaatagagggccaaacctttcattctaaggcacataatttcttttgaattttttatttactaagaaaatactcatagtctaaagaaacctaaggaggtcacatagaattaggttgcaaacgtatgatatatagaatgcacattaatgtggagcagcattgggaaaatcaataggaaaagtggaggaaaagctgacttctgctgtagctgtacaatgtatgagaaaagagcttaaggactgaagaatgaaatgactataacagagatagtgatggtgaaggagtgtgcttgagtagtatatctttctatactggacatgaattgtgaaagctgtcctcaaatagaaaaccataacttcaaaaattaagatttcctataataatacaggccaagaattctagtttcttacatgttaacacatagaacttaaacaaatttacaagaaaagaacaaacaaccccatcaaaaagtgggcaaaggatatgaacagacacttctcaagagaaaaaatttatgaagccaacaaacatatatatatatatatgatatatagaatgcacacacacacacacacacacacacacatatatatatagctcatcatcactggtcataagagaggtgcaaatcaaaaccacaatgagataccatcccatgccagttagaatggcaatcattaaaaagtcaggaaacaacagatgctggagaggatgtggagaaataggaacacttttacactgttcgtgggagtgtaaattagttcaaccattgtggaagacagtgtggtgattcctcaaggacctagaaccagaaataccacttgacccagcaatcccattgctaggtatatacccaaaggattataaatcattttactataaagacacatgcacacatatgtttattgcagcactattcacaatagcaaagacttggaaccaacccaaatgcccatcagtgatagactggataaagaaaatgtggcatatatacaaccatggaatactgtgcagccataaaaaaggatgagttcatgttctttgcagggacatggatgaagctggaaaccatcattcttagcaaactaacacaagaacagaaaatcaaacaccgcatgttctcactcataggtaggagttgaacaatgagaacacatggacacagggaggggaacatcacacaccagggcctgtcaggggagtggggggctaggggagggaataacattaggagaaatacctaatgtagatgatgggttgatgggtgcagcaaaccaccatggcacatgtatacctatgtaacaaacctgcacgtcctgcacatgtattgcagaacttaaagtataataaagcaaaacaaaacaaaacacatagacatagccacaaacattttgggtttgagttttcttttctttttcctcttctcttctcttctcttctctctctgtctctctctcaagaattctagagtttcttacgagttaacacgtagacttagccacaaacattttgggttttaattttcttttcttttctttttttcttttcttttcttttcttttcttttcttttctttcttttcctttcttttcttttcttttttttttcctcttctcttctctcttctcttctcttctcttctcttctcttctcttctcttctcttctcttctcttctcttctcttctcttctcttctctctcttctctctgtctctctctctcaagaattctagagtttcagccaggcttggtggcttatggctgtaatcccagcactttgggaggccgaggcgggcggatcatgaggtcaggagatcgagaccatcctggctaacacggtgaaacccagtctctactaaaaatacaaaaatttaaccgggcgcagtggttgggggcctgtagtcccagctactcgggaggctgaggcaggagaatgatgtgaacccgggatgcagagcttgcagtgagccgagatcatgccactgcactccagcctgggcgacagagcaagactccatctcaaaaaaaaaaaaaaaattctagagtttcttacatgttaacatgtagacctagccacaaacattttgaatttgagttgtctctttctttctttctttctttctttctttctttttctttctttcttttcttcctctgtctctgtctctctttctttcttctctttcctttctttcctttttttcttttcctttctttctttttttatttttttgagacaggttcttaatttgtcactcaggctggagtgcagtggcatgacttcagctcactacaacctccacctcctgggctcaagtgatactcctgcctcagctttttgagtagctgggactacagtcatgcgccaccacgccaggctaattttggtatttttggtagagactgggttgccatgttgcccaggttagtctcgaactcctggactcaagagatctcccaccttggcctccaaaagtgttgggattacagatgtgagcgactgttctggcagttttctttattctctatgaagagcttgaatttctacaaaaaaagtttttgatgacctgtgtgccctagggaaggtataaagagaagtgttgcgtaaaggggttggtggtttgcctcagttcaagagatcttcagaggactttaactaggaaaattttcttaaaaataggattgagcaaaaagactgtttgggaaactaggtggcaagtggctttctatttccctggagaccttgtatatgaaagatcttggaattataggtcttccccagttgacttcattgttatttccgagataaactccttcaaaatctggtagagtcacaccaataacataaatgggaaggtgaaatctaaagtcaattgaaaacaaattttgaattttataaaatattacttctgatttttattggttttgtattgcaatgatttgaaattagtaaagttatcacgctatatgccttcttttcaattttgctctacaaatgaactagaaggatgctgctgtgagtttgtgtaaatataaaaaacaatcccagtttaactgtttctatggcaataattgctcatctctatggaaatagtggtctgcctatttaacaataacccgtgaagagaaaagaggtattgactccctttaacaaattttcattctttttctatttcatttcaccttttcaaaaatcttattttgtttggttataccaagaaatctggactaaattattcctttcctcctttgcttccttcactgaattccaaataaataagtattcatgtgaatttgaaaactaaaaattctggctcagattgaagactgtgcttttatgtcagtgcaaatagggatgcccttttgtatcttttaaaacatgctagctttggagttagacatctggctgcaaaccttgactataccatgactaactagccttctggaagttatctctcctgtatagttgtcaagattaaaggtaacatatatttagcacatacaaacacaaggccaaatatgggctgtgctactgatttgatatgtgactttggttactgagtagccactcagtcccttgcagccacagtccactcctctagggaacttgcagagttcctacttaagtttagtatcctacattttaaaaaatatataaatattatacttattgtgtactttacaaagaagacccagatctcagacttctaggcagatattatgaccaatctagaaaacaatatgtgctgtctagctgttttatggttgtcttctgtggtgtaatggcagttagggcccatgaagatttcaatggcatttggcattttgctatcttaaaaagctattcttctttgtagttatttgtcattagtcagatcctagctctcttgaatgattcatacaaataaatagtttctgctttaattttgtatttttttccttaacatatactccatcaactatcatctgcaaaatttcgccaattatctctataaatgcatcaaataattatgtagtattgctacattctctgaaatttataaatgaattagttcatttttatccttaactgaagtcttttgaatagtcaaaaatattttcattcttttgcaatgcaattaaattttccatatgaacagctttaactttagaaatataaataatttcttatatggctagtttagcatatttttttaatttggtcttttgttttgacatgtggcatatgtacatgagagagcaggtacaaatgtgtttttgtgtgtttatcttctaaaatatttatcagtgtttgaaccagatatgcagttgttttagatatcgttaaaattcatactacaggcttaaggaaaagttaggtggcttttttcaaagttacattaaagaatgaagatacgttttaatgaaagttaaactgaattgagaatcctacaataacaagatttaaggggtttataattgtctatactggacagtactgtattgaaggcatagctgatgactacaaagtagaagcgaactgttcacaagggagtgatttatattggataataggttatattcccaaatatatattctgaattcagacaaaacctgactcattgaatttattaacagggttctcaaatgaagtgggaatacataattgagactaagatactaaagcattttctttattactataaaatgtttagtaagcatcttcaatatccatttagctatagttttcctctttgaaatatgaaccttcctccttttgaagaatctgtactttttattacagagtctgaccttcctctctactttctacatagtcaccttttgctttttccaaattaattccctgattgtttgtcttttaattttccctaactccaaatacttaccttattgcccccaaataacatctatagtatttaaaatgtattctgaaaatctaaaatatctttaaaatcacagaattttagaaatatggaatatttatttttaaataatttcttaacagagaagcaaatgtattattttgtaatataatttagactacataggtgaaacaaaattataattggttgatatgctctttttagctatataaaatttatatagctataaatttattttatactacatataattatataaattatatagctatatattttataaattatagctatatataaattataactatatatttatatagctataaatatataactatatggtgagagacagagagagagacagagaggaagacagagagagagtgagagagagaacaacagtacattaacttagaaagggatagtttaataatgagaggatggttttaaaaggagtcaaaaccatcactcatttagtgttagtggaactcaattagtgttcactggtaaattttatatagttaaaaagagcataactatataaagtgaaatagaacactcaatttgatcatagagtgtgtgtttgtggggttggagagtaagctattgtttgtttgaggatttgtttgtttaataatccaaagaccaaaattattttctgaactttagtgtccttaatagtctattgcttcatatgggaaagacatgatgttttcaaatatagagttgatgtgttaattttattagtcatcatcctttgtttataattccaatgataaactcatgaatttctactataataccattaagatatgtttttgcttctttatgatccaaaattagtctataaaatataattaattgtgcctggttcagagtgtgttgtggcatcaaatgaggtaattcgctggtatgaggatttaaatgcttagtaaatggtgtcttctattgctgctattgccccttttctctcttcaaaaaattacatttggttaggcacacatacttcagttctccctattttgaaaaaggtataggacctatgggttttttgctttttttgtttgtttttgttttattttagtaagatgaagtaagtatctacagatccataaacaagccaggacctgatataataattagtcaagagaggagttggttgaaatgaaagactgaaagtatgactgaagagtaattgttaatgtaaaaggtcaagagctaacatagaggaagaagttagagaccaggatggggagaccctgaaaaggatttcttattttatacaagtataacgggaaacctgggagtaacatgattcaatttatacttaaaacctatgctgactgcattgtggagaatgaataggaaaggcacaacaatggaagcagggaacatagtgagttgttttaatttagatagggtctgatggcctaatgtgtgacagtcaaggtgggcatgagaagacaactttaagctatgttttagaagtgaaactgtaagtacaatgatgaattggattcaagaagtgaggacatagatatgtcaagggtaacactgatttctggcttgagtaaagtcgatagaggtgctatttatggaaatgggaaagattacacagggaatgcatattttgatgaagagtgggtggaaatccagagttaagctttggatacatcacatttgagatgcctgaagaaattcaatgaaaaagtccaagtagacagtttagtattaggtctggagttaagaagaaaatgtcttatccctattatggccatacttaagatactgtgtgaagtatgtctttcactacattgtaatctctttaaatgcaaggactctttctttctcaatttcggatcttccacagcattttatacaaggcagagaatggttaaagtgaagaataaaaaagagttggcatgaattgaatctgtgtacaaggagtgagttaactgcctccaacttaatcctaatgaaaggttactgatttttacagatggtcaaagtgaacagcaattaaatgacttgccaaagttcacaaagtaaatggaaaactagtcctggttgactccagggcacaaattgatcatattaaactcactgcctctaattaagcccttgttaaacctcatctattaaaaaaaatgtggacagttattgcaccaaactcactatatgctaagatcttagcacgtaacaatatacagaaaaatgcctatccttttggaatttaaagtctagcgtgggaggcagaaaatgagtaagtctatgtaaaaaaaaaattacataatagagagaaatgggggcttggatatctttatatggggtagttaggacagaccaagctaaggaaaaaataatttagcggagacccatggataagtacaaggaaagaatgttctagttagaaagaaaaagccctgtggtagaaaagatctgtgcatcttagtcatggtcaccaaacaagacagccatgcataatgtgaccgcagagacgtacagagccaagccatgcagagctttgtaggtcaaggcataaaatttggatttttttctaggagcgctggccagccattgaattatttcaagtaagaaaaagtcataatctgctttatatttaagaatggtttatgagagaaagaatttaggggcaggagtagaataaagaaagccagtcagacagctcttaaattaattcagttgagagattctggtggcttttggcaggttatggtatggagacagagggaaatgcagtgattggagacatgttccagaaatgacagcaagaagacatgttgatgggtgggttgtagggggcgaaaatatcaatagtaaagaatgacccccagatgtgtggtttgaatgtctgagtacatggtggcaccttctagtaagatgggaaagactgcagaagaaagtgctttggtagtggaaaataaaggattctaattagtaaacgtttgttgaattaaagaatctcaatattggctttgcttatatgattaaataccatatttccttgcatgatcatttatttatgaattgtctgtggctgccttcacatcataattgcagagttaggtagttgcaacagaagcctgatagcccacaaaactgaaaatatttctgttttagctcattgtagaaaggagtttgtcaactcatgctatagagcatgatttaaacctaaaactaattttagagtgtgtttttcattttttgaatccaatggctgttcttcattctatataatccttataaagcctttgacttcttataaaaccatcctctcattattaaactatccctttctaagttaatgtggtgttgttgttctctctctctctctctctctgcctgtctctctttctgtctctcaccatttattttggtggtatctttccctatttatttccctttatcctctaaaagtgggtctttcctaagttcttgctctattgtgtcattttctcaatatcttcatagcttcccacctgacttcttttaggtgtcggcacaaatgtcagcttacatgaaaagctttctctatttagtatagcttcccaagccaaatccatcattgtctttcatttatcattactgaccttctatctcattttgtttatttgttccttgtctgtgtctccccaaatactatgccagtccatgaggatggagacttttttcacaggtgtatttgttcatttgttaaattcttaattgctaggatagcccaaggaatactgtaggggctcaatagaggtttgttggataaatacatgtatagaatgaattcttctgtctacaatgatctcttttcctttgttaagttataacagttttcattgccactgctcttctgggaatgagtgatttgctgtcttgggaagcccttgtatttttgcctcctgttgttttttgcctgcattggtgcctaactcctcttagattcctgatttatttctctaataaggtttgaacaaccttgagtatcaaatatgatatcatgaatacacagacacacacacacacacacacaccacagtgagttaataatgctgtatatacacaagctctttgttttgtacttggtttattatcatctaatgctctttcctctgcaggaatgctgttcttagtcttactttctgaggaaagagggggaatttatttcctaaggcatttcccatattgatttgtttttaatcttcagagaaacatacaaaaatgaattctaccacattttattttgtgttcatgtttggattgaaatcatgaattacttgtgtaaagaagatgaacatttacaaggatctgtttctaaaagaccataaaacttactcttcttgaaaactaaaaggaaggtgctataatcaccttacatttccccattatattatgtgtagcataaaaagaataagcattcaatagataacaaaataagtgacaaaactaagaagtcttaaatgatatttctctttaaagaataattatcatcttcaaaaatagcctgttcaaggttcagtagttccttcttatgtaaggttttgctttacctggtttcaattacccactatcaactgtaatctgaaaatattaaatgaaaatattccagaaataaacaatttataagttttaagttgtgtgccattgagtagcatgatgaaatttcatgccatctcactctatcctgccccaaatgtgaatcatccctttgattggcatgcccacactgtctattctatgcccccattagtcacttagtagccagcatgtttatcagattgactgtcaaggtatagcagtacttgtgtaaaacccttattttacttaataatggctccaaagagtagtgatactggcaattggatatgccaaagagaaagaacaaagtacttattttaaggaaaaaagttaaagtttccaaggtaataaggaaagaaaaaaaaaaaaacatatgtttagtttgctaagatctatgataagaatgaatcttttatccttgaagttgtgaagaagaaaaaagaaattttatatatatagtttggtactatccatggttttggagatccactgaagatcttggaacatatcctctgtggataaggggagggctaccgtatgtctaagatgatgtaggcaagctttttctgtaaagggatagatagtaaatatcttaggatttatgggccacatagtctccattgcaattactcaactctgccattgtagcatgaaagtagacaggaacaacattgtcaatctaaataacaaaaagagagaggctctctacaataaaaatatttattcatgaatgggcattgcaatgagaattagcatgccatagtaaactatgtgcatattcagaataggaaaggaagataatggtttttaaaggaaaaatgaggaagattacataattgtttttttctttttttttttttttttgagacggagtcttgctctgttgcccaggctggagtgcagtggtgcaatctcggctcactgcaagctctgcctcccaggtttacaccattctcctgccttagcctcccgagtagctgggactacaggcgcgtgccaccacacccagctaatttttgtatttttaataaagatggggtttcactgtgtcagccaggatggtctcgatctcctgacatcgtgatccgcccgcctcggcctcccaaagtgctgggattacaggtgtgagccaccatgcccggccctacataatcgttttgagataattatatttatatatgaggatcaataatgagagtggtgccagtctgaggttagacagacagttgctgggtagctattgttgcagcagcatatttttgtgtaaagtcttagtgacctttgtgtaaggttgtgggttttgtaggcttttgtgattcttcttcttatcaggcatttatgcatcagaatcctgtcttcatcgctttcccccactctattgtcaggtttttgccttccttcctttctctgtctctttctttctttctttctttctttctttctttctttctttctttctttctttctttctttctttctttccttctctctctttctttccttcacgcaggtgactccatttcgatttagacaactttcacaatatgtaagtgaataggtgtggctgcatgccaataaaacttacaagagttgggtatatggctctggattcaccctgtataccaacattattaaatgctgagaaagtaggagtggcctgagaggaagccgagggagtcctcaatggagagcactgaagtctagcaaagagcccttgagcaaaaggcaaaaatgtgccccactacccagagatgcccaggctttgaaatgactgatggacaaaaaaaaaaaaaaaaaaaaaaaaaaaaaaaaaacaaacaagaatttgaagttgatgagtcacaaataatttacaagtttatttaccatttctatgctaaaaggaatatgcaaaatagctaagtaaagtttctatatacatattacattattaaaaactaacaagttcaaaaatgaacacataaaatgctacatagttactttcttgactggccttttagtctgtgtacttttgagtatcaaagaatctttctctttaaaaattaagtataaactcctaaggtgaagaatgtttcccatctaaagctctgtgtgaggatacttctggaacttggagatcttaacctatgtaatggtgatggtggagatcgagctgttagaactctctcgggcactgtggtccttggagatgccctcctaagctgctttgtttccagggaagtgatggctacatgttactctccagcaatcctattctttttctctgtcctgaacatttcaatcccagccttttgggaaagagataataatagatgaggagagtagggtgcagaggactagtagaaatgtctgtgtagataactgaatgtttcttatagatcactgttgcaaaatcctaaaatacgatttttcatagacataaagattgtgctaggcaaattaaactgagcatatatatatttccccttttgataaccaccactctttactggtatagttatgatctcctgattgataagtgagaattttatttctcagatgaaatcattatgtctgtcttttatacatagtagaaaatgttacgaggcaaaataaatttgctgtcaatttgatacataaaatcacattgcaccacacagtgcaaaatcacagtgtgcctcctcatttgtaaaatgagcatcttgataataatgataaagatgttgctaataaagatagctcgtaggaattttttttttgagagtctcactctgtagcccaggctggagagcagtagtacaatcacagcagccttgacctccagggctcaagggatccacccgcctcagcctccctagtaggctgtgtgtgctgtgtgtgcaaagctatgcctgacaaatatatatggggtctcactatgttgcccaggctggacttgaactcctgggctcaagggatcctcctgccttggcctcccaacatgtgaggattacagatgtgagccaccatgcctggccatgatgttttaaatgttaactaagtgatataatttggccatgttcccacccaaatctcattttgaactgtagttctcataatccccatgtgtcctgggaggggccaggtggagataattgtagcatgggagtggttcaccccatcttgttctcgtgataattaattggttctcatgagatctgatgattttataaaggacttccccattcactgggcattcatttctctctctgctgccacgtgaagaaggacatgcatgtttgcttccctttctgccatgattgtaagtttcctgaagcttccatggccctgcagaactgacagtcaattaaacctcttttctttataaattacccagtgtcaggcagttctttattgcaacacgagaacagcctaatacactaagatatcgtgtgtaaagcatttggccaaatgctgtgctaggaacagtgcctagcacagaggaggcatttggtaaatactgttgaatgaagtaagaaatgaatgaagattaccagactcatacaagcgttcaatagatgttagctatccttcccttcccttccagatgcctttagtattttacaaggtacttagcattgctatgtaaatatataagtcatgttttaaaaagaaattgttaatgccaagggggtaatgctacatgtagattcagttcagtccctgtgtgcttggtatggatacactaacaaaacaaatagatgcttttctaacacactgaggcaatgcatcgttctctcctgaccctatatttttcttacagaatttcaaaacagtacaggtgaccatctagtgatattgagtcatgttttccacaagcaattccattttgataactgggcaattttctactattgatgagacaaggttccatttgtaagttgttccctctgtatcaacatgaaaaatgatgcaaacttcaaatatattgaaaacatcagtataaggccacaataaaaaggacagtttttaagacagcctttaaagttattttgtatccccttcaacatttgtttatggtgatgaggtgccattgcgtgagtgtttcctttaatcaactgagtgctgtggaacttgagttactgcgtttaccacttagtctgatgcttaaatgcaatccttttgaaatgctctttgcagtttatggtcttggctgcagtggaaatactgaatttgacattcttgatgcagtgattctctcactctattgaggcaagatatttttttaacctggctgatcttgtgttcccaaataaggcagccccttccctctggcagattctataagaaagaaaaaagaagagacaagaaaagaaggaaggagaaagaaagaagaaagagagaaagaaagggaaagaaaaggaaaggaagaaagagagaaagaaagaaagaaagaaagaaagaaagaaagaaagaaagagaaagaaaagaagattaagtaaaaaggaacccttatgtaactcccaggtggtacatttcagtactaaaggagaagctctatttatttttagtgcagttcctgccttttgttatatgaatataatcaacataagttttgaatatataatctcatgcctaggatcactgaaggacaaccaaaaaataatgtatgctacatagtcaaatatgttataatgatgtggacatactgtggggtagttctcttggatttgataactggaaaacctgctccagtaataatagacaacagtgacatgggaccattcaagcaccaaacactgttctaggtgaactattctcagctcttgatagtaacatttttactctccaacagctcagtgaggtagatagataatattgttctcatgttacagaaaaagacattgagacacagagagtttaggcaatttgctcagtcgcacaacttataagatgaacatggaatttatctttcaagctgaaacttttgagactgatagaggatgctataaataagtatacaaagcagcaggagtaattagccgggcgtggtggcgggcgcctgtagtcccagctactccggagactgggggaggagaatggcgtgaacccggaaggcggagcttgcagtgaggtgagatggcgccagtgcattccagcctgggcgacagagcgagactccgtctcaaaaaaacaaaaacaaaaacaaaaacaaagcagcaggagtaaaccagaacagatctgtaaaatctaggataaatgcttaccctaaaaaatcagggatttgaatattggatccagatcataagtctgtgtgagctactctagtgaccactgttcttatattttggtctttgtccaatttgctcatccctacagccttcatccctccacccttacattctcgctcctagactttttctttcacatgccttccattcttctctgtaatgcaactgatgcatcaaattacctccagtttgtatgtgaaccactcacaaccaggatgaataagacagactcctcatcctccaggacctcaatacagccaaagggccaaaatttcattatttccctcagggaaaaggttagaattattatcctgctttgatgtatcaaagaagtgctcattggttaccaagaaaaacagctcatgtgcttttaaacctatctgcaaaaattccctatgctttctgatgaacaaaaatctatactgaacctgaatcgtttgaaagtttggccaataaaagacatgatgctcttaaaggaattttatgctgcctatccaaattcaaaatgaaagtattaaaattgcaaaatggaagtgcagctggtttttctctaaggtttatcagtgatgagtcacctatttttattgcataagaaatcaaatcaagtgttgtaatgaaaacacgatacagtgaatttaggataattcttgtagcactcaagatgtgcgtatttgttcagggacactgagtcctttgagatttattttaagtactttaatattctgtaagaaaggctttttttcaatgtttgaagaaagctgccccatcttctaaacacccacaatgactggttttaattcaggaattgttacagaagcaggatatatagattatgcacttatgctttttatttatgtccctttatcagcatgaggcacatatttacttacatgtagtttaaggcattacgtttttaaatcttacctcttttgtattcacttaacatatgagcttcctatttccctaaagatgttaacagcatcaaaattttacctgagtgttttgacagttaaactctgaagaaggaaagggattgaaggtcggattgttctagtgtcttgtacaagaactggaaaaagaagtaaaagtcatctataaattacctttgctacatggaaataggttttctcatctattactaagggatcataaagaaccacattgctattttagacatctgcctatctagcgtagaggtaaatatgtataactttaaatttcatatttgtaaaaacatgtatattgataatttcacagatataatttgaatctcatcagtgtatgaaagtatatacttttcataatggatttattgaaagattcatactactttaagaactattttgctaagagagtagattttaagtgttctcaccacacaaaaaatgaaaagtatgtgaggtagtgcttatgctattagctcaaattagctataccacaatgtatacatattttaaaacaacatgctttacatgataattatacactattttgattttctaattaaaaataaaatgaaataaaataccttaagaaacagacatatttcaggatcttagttaccatccatgcagacatctcaaaccacttagaatgtgtacatacttataatagtaaaaacctccattacattcctactgtagttaataaatacgtgtttatttttgtgcacttctcacactgaaaactatgcaatttaagggacttattgcataaattagtgaccctaattgatttttccattcctttaatctagactatgttcaaaagtacagtctaatttatataatcataatttaacagctaacgtacctctaattgaagaatgagtgtatttcataaagtaagacccatgcatgtacaactatatcaatttatggatttatgaatatggtattagacgagcatttattatgagtaaagtgatgtatggttcatacagaatatcatccactggttatgcctttctgtttgttttttgttttccatctaatgtgtatagagacagagaaattattagacctcagggtcgaataatgtatcttttattctcttttataatagaaactaattgtatggcagtcagaaaatctttatttcttttcagcagtttttggagcaaagaagtgaaataactttcctctaaaccccaagacatcaaaagttagagttaaggcatataacagtagatacacgtgattctacacattgaataatgcttagaggactcaagaaagaatgtcctactaacttgctgacctgctcatctatatacagcagggatttggaccctgcaggagagatgaactggattatttatggacagcaaaaagtatattgttttaaaatttaaagaaactatgttagagctggtatcccgaaacagcatttaacatctataatttatttatgtgttacccagtatcttctttcttttaacattacttacaaagtactttttaaagcttagtatgtcatattagaggataaatgaaataccatcctatgctgataatggaatgactaatcacctgaaagaactttaataaagtacaatttcactaatgtgatatactaatacataaccaatttaatttgaaactaagtagtgcagtaatatatttatacaactaatattgttaaattcttaattttcatcctcctgatttaaattacaaatttttaaatgaaattcacttatgaggagtgtaatgaattatttatttattttgagacgcagtcttgctctgttgcccaggctggagtgcactggcctgatctcagctcactgcaagctccacctcccgggttcacaccattcttctgcctcagcctcccgagtagctgggactacagatgcccaccaccacgcccggctaaaattttttgtatttttagtagagatggggtttcaccatgttagccaggatggtctcgatctcctgacctcgtgatccacccacctcagcctcccaaagtgctgggattacaggcgtgagccaccgcacccagccaatgaatttttactttagcttttcaattgcaatagcttttacaattgtctgcatcatgtttccatataagttctccaagggacacttgaaaatatgatatagaacaagtgtggacctatccaaaagttttacaaattacacttcattattgaaaatgcttataatctagacatgctggagtatttatcatcatagttttattacacattataaatttatatgtaatataaatttgtatataactattaaatataataaaatatattaaagtattactaaacttatcattcatacattttctgatatgtattataatatttattggtattaaggacacaattctctgtttatataatatatatttatacacacacatttttactttcaattttagagagaagttttaagaattattattaatctatttgatcactatttctacatattattttggttttgcaactctgacattattggtacctttattatatagattctgacagttctatctcccaaagtaatatggctttgttctccatttcttcagagtaccctatctaatccatgaaaagtttgttccaaagacaatgttcaaatgaaaatgcagaaaatttcttcttaagacaaaattcaggtttaaatgcaaatttcaatccattagttcaagtctgttaatcagaatgtttttaaaaaatacagtatgagtttctaacaattaaaatggagaccaaccatgaacaatcaatatagcagtgcctgttaatactctcagaatatccactccattattgaccaccattgtatgatacccactgaaagcaacaaaaactaagactgataagtaaaattcagcaactttaatgagaaattttgtctaataagacataagttattttgttgctctgataaatacaattttgacttgaaattttattttgaatatactgcaagatttaccttgatcaacactgattacactaaaatgtaaagcaagtttaattgaaattattatttcttttttaatagtggctagtattcagaagcttcctgcagcctctgttctaacagacatcaactttccaatgaaaggacggaagggaatggttgactgggcaagaaactcagaagatagggtagtaattccaaaaagcattttcactccggtgtcatcaaaaggtaaatatctgaaataatatgagcttgaacaagacatttttgataaggtcatttaattagaaattaggtataaatcttcatacattaaacagtttagaaatagtctgtaatcattattttaaactaattttctaaatatggacaacttattctcggtttcagagtctctgaaaatttactgaagaaaacagtctattacagtatgaaaaatatacaagtgcaaattatcgacctgagtttgacatggtcaagtttcaatattcatggttttatacccgtataaagcatgtggactaatattttacctttagctattgaaatgtgttgtattttccatgcaatgtcatttttatttctgcctcattaaaatttgcttcggtttgaagatattattttggcatacaaaaacaaatttaatacctggatgataaaataatcagtacaacaagcccccacgacacaagtttacctgtgtaacaaaccggcacatgtactcctgaacttaaagtttaaaagaaaacaaatttgagaaaaaattaagtttttagaacatttttaatagcctttaaaattaatggctcctttcaaaagtgacatcgtactcacttttgcagatgtcgaccttaaaaggtaaaaatccaaaagagaattggctctcttttctgatatcgttgggaaattaaactcttaaatggagactaaggcagcttcttgtctcaacctggtaaaggaagtttccttcgtgatgcaaaactatagaaaacacatctttgagagctaccattaatgtgcatggttaggaatgcatttctttttaccaggctttatctttgcctaaggaagtactggaattatcttgtaattagcagattaaagttttataagacatagtattttcttgctgtttgctaatacttcaaaatttattctttctagaattagatgaatcatctgtatttgttcttggcgcagtcctatacaaaaacttagatctaattttgcccactttgaggtaagctacaaagtaataaactgttgtaattttgtaaattattccaaaatgtgattatagctcattctataaaaatagtcaaacaagctgtggtaatatgaagggatttttcttaaatgaaatagaaaatacaaatttaatgaacaggctattagcaattatgcatttcaaaacaactagaaaagataattttggtgtctgactgtagccctgcaaattcttttgtaactgataatgccttgccttgatactgaaagaaaaaagaaaagaaaagaaaaatcacaagtgtctataatagaatgggtcattgtaaaattgatctgtcttctccctttagttgtacttaatggtactgttcatcaacatgacgtgaaattaaaggagtgtcatgatgactgggaaaacatggtattgtttatttgcacaagatcttagtttgctttgaaataaattttcaattacagttacatttttttaaaaaatgctgctgtttatttagaggactatttctggaagaaatctattaatttctttcctcccagatattaaaagcaattacaaatagtaattctaccaaaactaacttatttgctttactgtcttatctactataccaaatctcacagaaaacatcattcacatctacttggattgtgatgttatcactcatagtgacctgtttctccacatcacctcgttttggaagatagagataaagttgttttagttaaatacgatcacagttggacttctttgttataccctcataaataaagctttacatttttggagaggaaagaatataaatgatgtgtgcagttatactgcggacaaaacaaatagtctaataaataaaaacaattagagttcagtgcagatgaaaaaaaaatcacccaaggaagcagcagtgattaggcttgaatctttagagaaaatctttctacgtgaagcacgttattaatataggtggagagtcatccagagcccctgtggttgtcatgcagggtctccttcaaccatagagacagccatgggaagctgaaatttatttacctcccttctcctctgaatagaatttagacttcctcaatttggatctatttgtgtttgtgttttgctaagaaaaaagtttgaaaacaaaaaagtctactctcagcttttccagtggttttattaaaactcattggtatttacagttactcacagataaaatttagtcatagttacactgcctatatctttgtgtttgatgttgaggagaggtatgctaaagttaaaaatgttcagataatcaaagttagtcacttatttcaacagggaattcgtttatataaagcttatattttaagaactctagacactaacttaaaatcaggtgacttgtgttttcatttcaattaaacatgttgagaattttataaacttgtccagtcactcagtaattgtgtgccttcagttcaactttaaaatagaaatgtatttatgtgctacattctccctatttgctcttgagatacatagtgaatacaaatgaaatattcaacataaattttttagattagtttccctcctagatgtccagcaatgttgcattatgataatcttgttccatataatctcatagcactcactcacctacacaaatgaagtcaggttattccaagttttataaatgtatgcagtcaatataattggaaatttcctcaggaaatttcccaagggatcccagccttttttgtaaaatgaaaaagaaacatttaattagtgtttcaacttaaaaaaaatttcatgacagaggcagtttgtctcttacagcttctggatagattaatggatacattatggatgatttaatggatatagtagagactagtcttatggactggctcccctgatgccacgtgtaacataaagggattcagatagaccactgggcaagtcactgactttttttaataagtaaaatgtggtaattgaacttaaaatttttttcaccttcagaaattatattttcattgcagaaagtttctacatattctttagattgaagtccttaataacctctgtataagaattacaaatttgtttacctgtacattctttgtatccataaagtaatttagtaaatgtctataggacaactaaatagtgcttagatcattgaccagatataaggacaatagaatgctcaggatgaaatatttgttaagtactcttagaaaggtgaagtactagtgtttacttctcattttcttttatctcttaaagtaacataatgtgaccactaagtaccctcgagcttgtttttctccttttcaaaacattcttccagaaagtctaatgagtaactgcaccaattataggtctgctaaatgaaaatatacttcttaatgaacaagggtgattcttttttctacagtcactcagcaaatatttactgagcagcgtccctgctaacagtactgtattaattcttttaaacttcccctgctatcgcaactctcagaacagttcttaataaatggtcaaggatttttttctgtaataattaattttctttttttttgagacggagtctcgctctgttgcccaggctggagtgcagtggcgcgatctccgctcactgcaagatctcccgggttcacaccattctcctgcctcagcctcctgaatagctgggacttcaggcgcccaccaccacgccgggctaattttgtatttttagtagggatggggtttcaccatgttagccaggatggccttgattttctgacctcgtgatctgcccgcctcggcctcccaaagtgctgagattgcaggcatgagccaccgcagtaataattaatttttctatctgataaaatatcgtatataagacatctttaaaaataaggcacacagaagtttaatgtttgtactatgaaaatattttaggaccagaggattaaaagatgtgtattttgtaattttactatatgtttgtgtgaattgaactcaataggaaagatcttcttattcaacataaaaagtacaaattcattctatgtgttcagttatttacaaagttttataaaatatattccttgttgaggattttactaattatctgttgaaatatgtgaagccacgtttgttatacacagaaataataagagtagttttgctgttaggtttccagaaatggtatattttggtataataattttcataatttttctcatagagactatgaaggaggacttgctgtaatgctttgaataaatatagtttagaaattgtccttcatacaaagacaaaaataattttgcatgttgactctctcttttattgagatatttctcttcttctcttagccctaatatacattcaactgtcccttgagctgcaatttttattttactattcaattgtcttcccttttaaagttaagtaggttcagattgttacttcaactgaaggaaatatgcttcagatgaagtccatactaaatatgtgttattctcagcctctcaacttccttcttcagaataatttcttatagatagaaaatatggatgggccaggcatggtggctcacgcctgtaatcccagcactttgggaggccgaggcgggtggatgacttgaggtcatgcattcaagaccagcctggccaacatggtgaaaccccgtctttactaaaaatacaaaaattagccgtgcatggtggtgtgtgcctgtagtcccagatacttgggaggcttaggtggtagaatcactcgaatctcagaggtggaggttgcagtgagcagagatcccaccattgccctccagcactgggtgacagagcaagattccataaaaaaaaatgtatagaaccataggatattaatgctgtaaggtcttttagggtttagtgtgagctagaactctcattttatagataagagaactgagatccttatcgcttaggtgacctgcctaagattatatgtccattaggtaactgagttataatacaacttatcttgtttgctaaaaccaggactcttctactatatctcattccctctattctgttactatttattattttaagcaatacaaaccatagacttccatgatagcacatgagtatatctgtatccattgcagaaaatcttgtaagagccagagtgggtggctatgtgtgggcagtttcagggagcactggggctggcctggtggccccagcccaggctgtcaataccaaggcttgagtttgtcacacctcccattcccccttgaccacttatgtgcatgtccagcccagttcagagggtcctttgagagagtgagatattgacacacagaccacattcacattaaggaattagaaaacatccatatcttggcaagctcgtaaactgctctgagaattttaacttacttttatagcatttttggaggccaatttggcaataccaagagccttaaaagtgctttgtcattgatatagcaattctacttctaagaatttattttaaggaaataatctctaaggaaatagaaaagtatatccaagtataccctcaagccaagaaatcaataaatggttataaacaatcatttgtctgattcatttaataagttcagcttccaattttgtgggaaagccatgaaagttctgagtatgtgagcagtatgtcgttatcctgttaagacatgaaaaatgtagtcccttaaaaaatgcatcttatgtaatgattaacattaaagacattataaaagaactaataaaattatatgtaaattccactatagtggaataaaggaaaatacagatgaatgaaaactaaagtgtcttcataaaccaaaagttattacaaaattatttttaaagaaaggaacaaatttcaataatgcaaaaatcaaatgaatttcttgtcaagtacactaacctaattaagataaatgaggctgaaatttttatatattcaggaaattgaactcatttgaattcctaatgctatagaaattaaaaatgaatagaaaaataatattggaaataatagaaaattgaagacataatcacttttacacaaatgcacgctgaaagcaatcaacctgaagcagtcagctctctccagagctcatgtccttaggtttaggacctaaactttgaatcttcctttttaattctcactttgcaatggaatattctagttttgtgacgttctgtacctttttagaatgtcttctcatgaaaacattagaaatttaaattatctatggaaataacaaattggcgtagcttatagtataaaatattgtggtgttacttagtgcgttattttttaaaatctcggtttagtttggtcagatattttaaaagtgaatgtaaatctctgatcacttggcatttttaaaattctagattctacatatcttagcaacctacagtgaaattctaactcctttcaagctttaagtaaacccaatcctactttgtagcagctgtcaactgattttagttttaaaaacaaagatattcagctttaaaattttgataaagtacccaaattcccatactatatgaaatcatctgttttattttggtcttatttaaattggtctattcacttaaaacatttatgaaagtttcatttttgaagctacatgaactataaatctaaaaatggaaaaggactatagtaactttactaacttccattaaacccataacatctttttgttgtatcttatctggcaatactgtatgtgtgctattagttctgccatctcctccattggtgatttttctataactgcattacattttttattgtgttaaaaaaacataaaatttaccataataactatttttagtgtacagtacaatgttaactatatgcacttgtgtaacatctctagaaacttttcatcttgcaaaattaagactatacacattaaagcacaactccccttttcccactccctctgacccttagcaactatcattctattttctgattctgagtgtgactgctttaaatacctcatgtaagtggaatcatgcagtattcatctttttgtgattgatttatttcaattagcacaatatcctttgggttcatttgtcttgtagcatatgataagttttttttctttttatacggctgaagaatatttcattgtttatgtatataccacattttcttcatccattcttccattgatggacaatcagcttgcttccacctcttggcaattgtcaattacacatgatgaacatgggtgttcaaatatttctttgagatctttctttcaattcttttggacatatactcagaagagagatcattggattattttttgttttttcagaaactgcctaccgtattccaaagcagctgcaccatttcacattcccaccaacattgcatcagggttccaattttcccacatccttgtcaacatttgttatgttgtttttttgtttttgtttttttttgttttgctttgttttgttttgttttgttttgtgcacacagtctcgctctgttgcacaggctagagtgcagtggtacagatctcagctcactgcaacctctacctctccagttcaagcaattctcctacctcagcctcccaagtagcagagattacagatgtgtactatcacgcctggctaatttttgtatttttaatagagatgagatttccccatgttggccaggctggtctcaaactcctggcctcatgagatcgccaccctcggcctctcaaagtgctgagattacagacatgagccaccccgcccagcctgtcttttgttttttaataatggttatcctagtgggtgtgaggtgataacccattgtagttttgatttgcatttctcttatgattagtgatgtagagcatctttttatatccttgttgtccatttgcgtaccttctttggaaaaaatgtctattcaagtcttttgcccatattttaatttgataatttggtttgggtttttgttgtcaagtttaggagttatttatatattctggatgttaacctcttatcagatacatagtttgcaaatattttctcccttttcataggtggccttttcattctactcactgttttctttcctgcacaaaagttactttgttttgttttttaatttgatgaagtcctatttgctcattttagcttttcttccctgtacttttggtgtcatctccaagttcaatgatttgaatgtatttctctatgttttcttttaaaagttttatagtttctagtcttatgtttacatcttaatccattttatgttgttttttatatggtgtaggcacatggatatccagtttttccaacactgtttgttgaagagattatccttttctcattgtgtagccttagcacccttgtcgaggatcatttgaccatatacatgaggatttatttctgtgtactctattctgttctgttggtctatatgtctgtcttgacaccagtaccatactttaaaaataatcattactgtagctttgtaatatagcttgaaaatagagaatacctttctttcttaagactgctccagctgtcaagaattctttgagattttatgtgaattttatatttttttccatttctgcaaaaataccatttggatagattgctttgggtaatatggacattttaaccatattaagtcatctaattcatggacacaggatttccttccatttatctgtctcttccttcatttttttcagaaatgttttatagttttcaatgtataactctttcctccttaagtttactcatattttatttattttgatgctttttaaatgggattcttttattaatttccttttagattgttcattgataatgtatggaaacaattgatttttgtgcgttaattttcttgcattctgcaacttcactgaatttgttctttaattataacaagatttttaatgtgtgtctgtgtgtaatctttagggtttactacatataaagtcatgtcatctatgaacagaggtaattttacctcttcctttcccatttggatgccttttatttctttttcttacctaattgctgtttgtaggacttctagtactatgttgaataaaactggcaagagagggcatttttgtcttatttctgatcttaggggaaaaactttcagggtttttttgttttgttttgttttgtttgttttaccataaagtgtgatattagatgtgggttttgcatataagacctttgctatgttgagataatttcttcatattcctggttcattaagcgattttatcatgaaagggtgtcgaattttgtcacatgctttttaaaaatcaattgagacagtcatgcagtttttgatcttcattctgtaaatgtgatgtattacactgattgattctcatttgtggaaacatctttgcatttcagaaataaatctctcttggtcatgatatataaactttttaacatgctgctgaatttggtttgctagcattttgttgaggatttttgcatcaatatttattaaggatatttgtctgtagttttccttttttttatatatagtatctttgtctgatttcagtatccaggtaatactggcctcctataatgggtttaaaagtgctctctgctttaattttttggaagactttgagaatgagttgtgtttattcttctttaaatgtatcatagaattctctagtgaagacttctggtcctctagacttttgttgagaggtttttgattattgattcaatcgctttactagttatgggtctattcagaaataaaatttctgcatgcttcagtcttggtgtgttatattttttcttaaaatctgtctatttcttttaggttatcttgtatgttgacatataattaattgttcatagctgtctcttatgatactatttacttcagtgccatcagttgtgatgtctcctcctttttttctggtttttgttatttgagtcttctctctttcttttcacttactctttttaaaaagggtttgtcaattttgtatattttttctccaaaaatcaactcttagttttgttgatttttacatgggtttgctattttctattctgtatatttcagctctaatctttattattatctttcttcattaactttgggtttagtttatgcctctttttcaagttctctgaagtataaagtcaggttttgatttgagatctttcttcttttttaatgtaggtgtttactgctataaacttccctcttagtacctttttgctgcctcacatatgttatgtggtatgttgtattttcattttcacttgtctcatgatattttccaatatttcttgtgatttcttctttgatccgctggttgttcaaaagtgtgctgtttgatttctacatatttctcaatttttcagtgtttttcttagtattgagttctagttttattccattgtagtcggaaaagatacttggtaagatttcactcttcttcaatttgttaaggtttgttttgtggcttaacatgtggtctatcctggaaaattttctgtctgcccttgagaagaatgtgtattctgctgttgttgtatggagtgttctgcatgtgcctgttaggtccaattcatctataatgttattcatgtcatctgttttcttattaattttctgtctaggtaatctatctagttaatctgtctagttattaaaaatgggatattaaaatatcccattatattgttactatttatttctttcctcaattatttcaatgtttgcttcacatgtttgggtgctatgacattaggtgcacatatatttataattgttatacctccccagagaatcaaccattttatcattacattgtgtctttttttgtctcttgaaacagtttttgacttgaagtctattttgtttgatataagtgtagccaacctcattctcttttggttatcttttacataggatgttttatccatacttttactttcagtctatggatgcccttatatacaaagtgagtctgttgtagacaactgaattgtatttttaatcactttttatactctctttaagatatggttcatgtgcctttaacttcttaagactctgcaaaaaaatgtgaagattaagttgggttacctttgaatgattaattctatatattttgaaatgttttatatatcaacgagcataaatctcaaggacagaaaataattttattatttgagtcatgaaatccatttggctgtcagatctgcttttctagcagtgaatgcaaatgtgcagccagccagggagcattagcagatcacaaagcctgacatggcatatcagaagccagctattcacttgtgcaaattagaataaattgatggaataaattaaagacaattttgtacactatacactttttgaaaaggaagccattgcataatgtaaatttgcttatttattttcctttattaggcatttaataccatgatattggcattacattttaaatcaacttgttaaaattttgacatttttgtttagtatttgcttattaaacaaaacactcaaacatgttttaagtattaaaatgttccaaagaataatacgaatgaggacatataaatgatagataaaaatcttgctctcattgagcttattatcatatggaaaaagacatgcgtagaattgatggatgctttcgtagaggtaggtgcacgttactgtattggggcacaaggtgtcagggattcacatgaatggtattagcacactgatatgcatgaataaattgacacatatctcttctcaaatatattctaaatatattaaaacatacacacattttctttctctctctctctttctctgtctctctctctctttctctctctctctctctctctctctctctcctcctctgtctctccttctctctcagcaaaagccatagggttgattctgtcctctagggaacttctccaccaggccagatgagcagctgatgaacctaacacagtgtaatataccctgcagaaggcaacttattgtagctactttgctccttacagaccagccattcagggccaaagtctccacattcccaaacacacagggagcttcataaatatcttgacaaaattgcaatcttctttataggatacccacatctgtgtttgttttccagtaatgtatccattcatggaacttaaacataatagagatacctttctaatataataatttaataataattaaaattggtaatcattgggttttattaaaagccggtaactaggattataaagagaaccagaataaagagacaaatggaatttgagtgaagcatcaatatttttgttttgcaaaaccaaaccagaacttaaacatattcaggctaatccaaaaaaggaacttacatctgtctgttcaggactgattcttctctgggagaaatgttcataatttctctggtaatgacaggtggatatttcccctaactctaagctgtatacaccattctctgggaggcctgccagctgtgctaatatgatcaaccacccaggatcacctctcaactttgtcaatttctctattctcacttggttccctgatcacttttactcacagaaaaacatggaagaataatttggcaaaagaagcttgacatttagagcttagttttctgtccttcaaaatgtactgtaccttcaattgactcatttatcatttaatgaaaaaaaaaaaagactgttaaccagctctctctgtctgcaacaatcttcctcttaacaaaaacaaaatagacttatgctttgttgtttttaactctttactcttaggctgaatagcttcctgagtgtttaaaaaagtgtcatttgacattactgcatacatgagaaatgcacttaaaaatgttaacccatgcgaaacaggtgtatagttcctctgctactagatatagtaaattcctccaaccacggaataactccgcatttttttctgatgaaatcttgtgccaaaaaccacctcattagagaaaaacaaatctcaaaaaaagctaggttcagcatggttccaccgtatcagaactatatgacttaaatggtacaatcactttagaaaacaatatgggagtaacataaaattaagtatgcctttacagcataatcaaggaattccactctcagatattcaccttagacatatgaaaatatatatccatacataaaatgtgtatggtaattatttataatagccaaatatcattagctattatttctaaaggctaaaaatcagaaataacctaaaggttttaacctaattgataaatacatcaataaattgtgctgtatttgtaccatacaatattactcaactgtaaaaggaaacaaaatagatgaatctcaaaaatgttatgctaaatgaattaagttaaaattaaaacagcagcatgtccgtggttgcctgggagcatggaagggtaggggatgaaatacaaagggacttgagaaaactgtttagggtaagggattgtttgtctatgttaaatgtggtggtacttacatggtagtatattatccaaagaattaaactatgtacttaaaattgtgagttttatctgtaaatactacctcaaaaaacaaaaaaggagaaaaaaattaaatgattttgtcattgatacctaatgtgaattctccagaatagtacatgaccgatggaagagcatgtggtttattatttcacaattccaaacaggaatatattcacacataaacacacactcaagtgtgttatgagtaaaattaaatcatctttaaatctctaaatactagatgatctgcagcattttacatattttgtgtgaaaacctacatatactagaaaaagttggttcagttttatgtttatattggtagataatttcttgtaaactatagatatgattttcttaaaataacttaaacttctttgtaaatgaaatatcttggtaagatatttcaggcaaaatgtctttcttagattgagagtattgagatcaagcagtggcctgtcaatctctattgtcgaaataaattatggtcaataattagcaacagcatttatttctatttaaactctgtttgctctaatgttactccacattgcaattatttattgtaatgtgttttgggataatccataaaacaccaagacagcacattgcaataagagtatttgatctccgagagaacaaaactcttaggtcctccttgatataaatgaattatattcatttaaatattgtctgaaggtttgaattcacaatccatatctcttgtaggtgaatcagatttaagtaatcaaaagcttatcagtgctgttgctttctcatattttctgcatctaaaatggtaaaatggccttttctccctaagttttctgttccacataaggtttctttacagcagtaaaatgtgtctttccatgaataatactacgatttatgtttttgctttggatgcatttatttgaaaccatcccaaaatgtattgagcagtaggaatttatacttttcagcactcatttctccttttaattataattactctgttgcagaaattatactgtcattaattccaaaatcatcgtggtcacaataaggcctgaacccaaaacaaccgattcgtttctggagatagaactagctcatttggctaatgtaagtaccatccactgggcactgacttgcttatggaattacctttctaacagtcattctttcaactgataacaccagaatacattttctagacttttatagttgcaaatatattaacttgttatgagtatgtgtattataaagaaacagaatgattattctatgcttttttcatgataaaattctcttcaatttatccaaatgagtatatgtattataaagaaacaaagaatggttattctatgcttttttcatgataaaattctcttcaatttatccaaataatagttaataaatcatttatcagtgcacacatctttaccaagctttgtgctaggcactggagaagatgaggtgagtaaaagcctgttaactgtagtggtgcttacatggtagtatacaattatccaaagcattaaactatatacttaaaattggtgagttttatctttaaataaaacttgatctcactatgtggtaggaaagaaaaaatttaagttgcatgccacagtaaaagttataaacagtgcagaggggaatgattaattcagaggaagggggtgctgggtggagtgggtagcgtgtagaaatactaagtcaaggatcagggaaggcttattataactacctaggtgatcgcattgtctaaatcaaaatctttcatctcagaatgaaaagaacccattcttaaatctatccaactgcagctgaaatgcttcagattttgttcagtcctctgtacaaattttcaatgtctacttattatttaaatattcacttcaaatacttaaatcattgaagtggaggagcaaggaaagtgatccctatgaaagtcttccttattgtactttcatagttcctgtattaaaataagtcagtttcatgatttacttgtacatatttttatccttgcaaagtttttatgaagttgacctttctttacattgaaaaaaaaataaaggaaaaagtgattaagtcattatcccaagcccatatagttagtgaatgacatagcataatttaaactcacattcttttggctgtaaaatttgtgtattttctactattgtgtagtttctgatttcctgaaaaaaatcagccttagttttatagaaaaatgataatcaccttttctgtgaatcactttttctaagatgagccaggcttcctggattatttaataaaaatttcaaatctctctgcaataactttcaaagatcatttgatatttaaactatttaactttaaactattctaaatagtttaactatttaaactatttaactttaaactattctaaatagtttaactatttaaactatttaaactattagttaatatttaaactattaggtgttttcctgcttttgtcaaaatgtgaccatactagttctatctaaccttaagaacgtgttttagttctacaatatctacctcctcataccttagtatagccctcatctcttcactgcactgagaactgggagacatttttaacttctgaacatttgcttttgaataaagaatttgtgtattcaaaattttttacaaaaatatatgtttttattgtttttctacagttacaagtattgggagaatgtagtaagagattaattctctgtatcagattatagaattactgaagaagcacccagtatcagaatgtgtactctgtttcttatgcagagaacagttgtgcaaatgaatcacgagactttgataaagatgaaatcattatttagaacttaaaggacatgttaaaggaagcttttttaataaattaaaaaagagtagtctcaaaaatagtgttgaaatagtctcactatttgagtataataaaactatttgaaatgaacgtatttaagctttgagtctgtcttttatgttctggaaatgtgttttgtcagctgatttacagaagatataaaccatgtactaaaaatattttctacatatggaaaacaaagaacatagtcaacaaattttattaagcaccagctagtactggaatgacaatgaaagtcagcatgtaagaatgatgagataattatcagaagtcacttagaattaattgtgtctttcagtattttgagtaagtgaattgaccaggttcccacgagaatatatctccactctagaaagcccatgtttaaaatgtatgtatacatgtagaaatctgttacaaaaaagtggatggggagaggagaatagaaagaggaacaattttatgctagagaagaaaaagtctctaggcgctcttgtttggaatctgcccgccgtgcacatcgtgcctcttctcagaggctcctccagttactgaccacacaactgagcctctctgggctgctctggactcttttatttaaaatatccatctcactgttgtctgtacaatatatacagcccttctactttagtgttttgaatttctaaagcttattgtatttacatttattttattgctaaaattagattttgtgaaatactttgggaagtattactgttcactaagggagggaatatgtggtttatttattgaatatcataatattattaccagtcttataaagatatattctatgtactgagattagtttatttccattgaagagaagacaaaaaagatctattttgaaatataatgttagctgaaatgtgaagaaaaaatatatcttaaatatgcagactgaaatttattagaacaagcctgaacttcatgtatatatatacacacacacacacacacacacacacacacacacatatgtacatatattcagttggccctcagtatctgcatccgtggattcaaccaaccacagatcaaaaatatttggaaaaaaatgaaaaataacagtataacaataaaaatacaaatgtaaaaatatagtataaaaactatttacatagtatttacactgtattatggtattaggtcttgtaagcaatttagagatgatttcaagtatacaacagaatgtgcataggttatatgcaaatatatataagatacttgagcatccatggattttggtatctgcaaggggttctggaaccaaccccctgtggatgacaagagacaactaatacaaacacacccatccccccacctccaaccttcacacatatacatccacatatatatattaatatatagttatatatatgcatgtatacacatatacatgcccatatttgttgccttcaaatttttttagaaatgacacatctctaatatcaaatctgtctactttcacttattttcttatatcaaaaatatccgttatactttcaggaaagaataacttcaaaattacattttattaaaatgccatgtgaaaaaaaaaaggaagaatgggaattaatagttacagtgagttatagtgagttaacaggaaaagcctgttaacattttcttttaaaaatgtgtctcagaaagctttttaacaaatagcatttacaatatgttaaatataataaggctcttgggaactgataggaataggtaataaaatatggaacctagcaattccaaattctgtttagcaaagccaattgcagctttaaccagattagtcattaattagtaagacactattcttagttcagtttttcaggctgatggcttcattgtcatgacctataaagttagggtatatggtctttagtgcttaagcataacaattaattgctttaaagaaatatcaaatttttttctccctccaaaaatttgttttttatatcacttaagagtgacatttatactcatcaaatttttagatcctataatgcataaggaaagttaatcatcttattgaaaataattcttgagggccaatgagtgcaatgagtagatccctatgtagacaaacacatatgctattaggatcccttgtgtctgacaggtctgggcctactgtgactttccaaggtgaataacatctttatctttaaagatgagtcagaagaaaaagaaggtaaaatgcattttagttatctcatgctctatcaactttgcaagcctgaaaatgcatactttttccaaatgaagtcttcatgtagttccatttcaaatggaaagatagagtggaccataccagcctgcagtctcatcttggcttttaaattttttttcctctgggcatcaactccaaatggtataggtagggtactgctgctttcagggttgagataaatgcgttatgtttgtagttctcaaattgatctaatgaaaatttgggcttgtaggttttgttttctttgccatatttgcgtgcattctaatagcatgaagctaacaaattaagaaatttgttttatgtgtataaaccaattttaaatgaaaattaaccatgaccctatgacctttgtaaatcatagtggaaaacacagtgacaactgtaacgaatatgcttgttatcattagataagcatgagaaacaatgaaaagaaattccaacattcatcagtgggtattttcatgaatataaaggttaataacctaaggatttaaaaatcacttggcaaaactttgaaaagttcagtgtgtgcatccgtaattttcacaaagggctgtttgatatgcctttactttttgaattacttttctgccctagctttatccatttggaagtggtttctgatattttgtctgtttacagttcttggtaacttttatggagagtcttgaaatgctactagacaaggagattaaaggctcttccaacaactgaaattgagatagaaattgctctctggctacatttttggttatagcctaaatttcttcagtagacatccttctcatgtttcaaatttagtttattgttaattataatacataattgatattctttaaaaacactttagtatgattgtgctattgttggagcagggggtcagcaaacttttttagataagagtcagatcgtaaagaatttcagacatgagagccataatggcttctgtcacatccactgaaatatggtgttataatctgaaagcagccattgacaatatgaaccgataggtgtggctgtatttcaataaaaagtaacttacaacagatggcaggtcagatttggctcatgggctattgtcaacccctgtgtgatacgcagaatagtgactcctccaaagacgtccacatcctaatccccagaatctatgactgtgctgtgttacaagccaaaagggatgtttgtgtgagtacatgtcaaaacgcatatgtgtgttacatgtctctgctataaccccatataattagtattaggacatatcattatattgcttttggacgtaaaagaaaaagacataggctatatattgtacctatataaaatctagttatttaattaatctatttctttattaaagttatttgctactttaattaatattaaatacttgcacagttttaactctagaagacccatttgcttgctgagaggtacaccagactttgtgcagccattattggaaatgatgtgatcacatgcaggtaggacactctgagacatatatgtggaggcaatgattttctttgaagcatatacatgtaaaaacgtcctgatgatggttctgctttttactgcttcccatatgacaagtggaaagtattcctctggaaataatgcaggttagtgatatatctcagaaattagagaagcaagctgtcatcacatctataaaaatagtgtcatgtggttaatgtgggctactaactgtatagcagaagtgatattaaatatgtgccctctccttgtattccaatcaaatagctgccaactttctgtgaatagctatgtaacatagatgggactcattctaattaaaacagtattctacatttctcacttcagtggccttcatgtaattctgctttagctaaagccaatttttttttcattccatcttagtttgtctagttttcaatgtgatgagaatcctcataaaatccatccaaattatctacatctccagcttcctaacaaataagagtacagtattgtattctcaatgtgtcttttaaggctttaggtacacagcagctgtcccttaaaaactgaacataagacccagacttagctccttctaagtatcatttaaaatactaaaatatggaacagtacttatcataactttgagaacatattggagaagaacatccaggagattacttcctgttgagttttatattgtattttttcactgcctcatccccttgcatggtgttttactctttaagggactgtagaactgttcatatgttaaaagacatgacactgaaatgggtccctctcactgatcaactattagcggactgtgatggatttgactgtggaaaaatttacgtctactaatgtcttgcttcccttagcaattcctgagatgtttttaatgtgtccttctgaagtatcattaaaattatggggaggctgaggcgggtggatcatgaggtcaggagttcaagaccagcctggccaagagggtgaaaccccgtctctactaaaaatacaaaaaaaaaaaaaaaaaaaaaaaaaaaattatccggacgcagtggcagattactgtaatcccagctattcagaaggctgaggcaggagaatcgcttgaactcagaggacagaggttgcagtgagccaagattgtgccactgcactccaggctgggtgacagagtgagactctctcattaaaaaaaaaaaaaaaaaaagaaagaaagaaaagaaaaaaatttatgaacaaaatatgaattagtcttttgcagatccagttaggcaaattggaaatattcttgaggaatctccaaaatctatttgggtagttatatacaataataacaatctttagtagggaaagagagagaggataaacttagcaaaatccaggtcattttaaagtaatgccttgccatctaaaatttaggaaattaaagagagacaatacagtgtcagttgaagagtctttctcccattcactcaacagatcaaatgtccaactcactgaacgatgtgacagaaaaattcattctgtaacatctgactcagagcactggaaatgttcaaataattatgatgaagtcactgcccttcttcatgcccttagctgccttgcctatttacttgctgtgcctccactgaaaagagattattttgtttcaaggaggctgtgaaaggtacaaaaaagttctgaagtttgaagattagtagtttattatggcatataaccaccaagcattcaaaaatctgaataaaaaatagagtaaccactttatttctttttttaagcaattgtatttgtagtttacaaataataattgtattgatctgtggggtacaatgagaggttttgatatatgtttacaatataggattcttaaatcagggtaatgaacaaatccatcgcctcacaaagtttcagtagatgcatgggaggaatatgctttaatgatctattgcacagaatggtgactaaaataaataataatgcattgtgtatttcaaaattactgagtaggtttaaatgttttcagcatgttatttctgccatgtgtatcatgagcagtgattctctaaatttgatgtgaaaaaaaattatggagaggcaagagtgccattattaaaatgcagatttctaggtttagcctcaaccttaacattcctatagccaatgaatctacattttcagtatgcatcccagtttattctgaagtaggtctagagaaaacactgtgaaaacatcattaatatatcaagagtgtgattaaggtagcatatgcattgaatgtattgaaaatttaaaacaccaaggaaagtttaaagaaacttggtcatttgtattgtgacattattgttatcttttctgtaaccaacttgtttcagatctctgctcaaagataatcttgctgatgaagctttcttaatagacaaaagtactatccactctattttcctagttgtacctagtcgtacctctctctctctgcccttcactatggtgaaatacatgaggcagggacttagttttgctcatccttgtatcacagtgccttgaatggttcttggaatgtaatagatgtttagtaaatgaatgcagaatggttgcagaatggttagacttgttgtgatcatctgcctgctctctcttctgacttctgcactttgtgagggtaatataacatagttgagtatttccttaaaaagacttagaagagagttttgaaagaataaaatgaatttctagaatcattaaaagtgagggctagaaaagatgtccaaataacctattttataaataagaaaacaaaagttatgcagttcaacaaaagagaactatccattggaatgctttggcaaagctagtgatatattctactgtcaagtaaatatatttgtttggttgacgttggaacagaggagagaagtaaaagaaaatagtgaagtcactcaagagtggtatgtagaacatctatggcaattagaaatttgagcagtggtgcattttttaaatgcttaaaagtgagtaaatagaaacatgtagagttcagctagagttttgaatggagccaagagtggcagtttttgtttgtttgttttgccaaaaacatgtttgtcaagaatataatttccttttctttagtttccaaatatgtgcagtattaccattttgtatgtcaacaaatactatttattgatagtttggtaaattaatcttctttaacccatctgtcttgtttacctgagaatttttgttttcttagtttactgcatttgttaaaactacttctacagattagtacttagcttctctcttttcctctcaccgtgtcattacattttgttatattgggctacttctcattattgattttctgtaaattcttcataacagatcttgtagcagagtccctttgagaaaagtaactgaaaattataacaaatattttacaggtacttactcagcaaaaccttttagccagctttgttttttttaatatttagaatccattcatcattggttgctttgttttccgtgtcacattcttattatttaagtgactagtctatttaggtactaagttttctctcatttgtttgttcagcttatttttctaaacttcaaatgttcgaactattgaccttagctcacagtctcacatattggtgactatactagaataaatgtttattgtatacatcccagaatgtgtagtgaaacttaagattgaatgatgcattttggaacctataataatgctcacatgtatggtgtttaaattttcataaccacaaaaagaaagagaagcatgcagcaggatctaagaagtaaggggtgaagaacatggagaataaaactgaatgttgacaaagtcatggaaaaagattagaagaagcatttctcgttttgaaaccttttttgaagaataaatcagtttcttcagggtgataaaaaggaaagaagtatccaaacaattaagtttatgtgttcttttctaattttttttttgttgtggcttactgtgaacaatcattgtgaaatattaagcctatagtccgtatcttatattagtttatataaagatttaacttaatctacattatacatcattaaaatcagccaattagatttaatggatctgttatctcaagttcctcagctgcacttggtttctatatccttgaaatgcatactcccatactcttcactgtgatgttacaaggataatttgttttctataaggttctctgagctcctttgaacaaagcactaggtaaatatagcataactttatgacagcattttggctatgctgaggatttatcagaaagtcacaagctatatgaaaaattcaggtaagactggacaggatcttataagatagagaagaaaccaatttaatacaccattcccctttccttccatggaacatctggatctatgccgtctgtgagaaccagataagaacccatttcttctatgaaacttgtgctgactagcataggccatgacactccattcccccatttgtcctttactcagtaaactatggctagtgatatttatgtaagcattttgcttggattgttacaggaacattccatgtctatgttcctcatctacttctataggactatgaccttttttcaggaaagacagtgttattatactgtaggagcatagtgtagggagatatgagcattccctaacaagtaagaccccacctcatcaaagggcagaagctgcagggaggtaagaagtgcccggcaggagaggctccaagagatgtgactaccagtggggcccagcaagggagtctcctgagaatccacccaagtgctggtgatgttgtagaactttttccttagttcagctaagagccgggttcttgttacatggccatgagagattaggcttgcagacactttgaagggtgagaaaaaaaaatggaatttactgggaaaagaggggatgaaaatgaaacaggggccctcggcaaagccagagtcctgctagctggcttccccctggcagactgaattccagtttccaccccaggagagaaggggccaggctcctcccctgcaaatgttgtgaacctcccaaggctcacccaactgcacattccttatactgcacaggccttggaagttctgtcagggagcccttcccacctggctgtctcagtgagaagagtcaacttaaatcataaaatagggccagactgctcagagctgactttggacgttagtgggcaggtgaaaaccttttgcctcctttacctcccctccctcacccctctaccaccctggccactggcagagtcatggccgacctccgccccagtctttcatctggaggagagaagatgatctgacattcaatcaggttctgtgttttgattatttgtaacagatcattttcaattgctaatgacatgacaatcgtgatttaatgtgaccaccaaagtctattatttaagagtggctcaaaacttcggaggtttattttcaatttatgactaaatttccatccagaagcaagaaaaagatcattttttactaaataaattttaaaggaagaatgggaaacaaaaacaaatgcattttctgattgcttaaaaaaaaaaagtaagataccttggatatgtggcctttcagggaatttttagaataactgggatgctgcaatattggagttagtcatgtaccaattaaaatgaataatatgtaaggtttgagtgaatttcatacattttagaacagtaagcttactatttatttctagcaaaaatttagaatggacctatcagacagcatttacaaaggcacacctccaaaagagcttctctggactttcaaagatgttgctttcccagatacactccagtgattgtctatatgtagacaacactgaagcctgagggctgggtcatagcttgctggcaatgaggtacggtgtccacctgtggaaggaaggcagtggcctgtttcaggactgtactttttttttttttttttttttgagacagagtcttgctctgtcgcccaggctggagtgcagtggcacgatctcggctcactcactgcaagctccacctcctgggttgacgacattctcctgcctcagcctccagagtagctgggactacaggcgcctgccaccacgtcctgctaatttttttgtatttttagtacagacggggtttcactgtgttagccaggatggtctcaatctcctgacctcgtgatctgccctccttggcctcccaaagtgctgggattacaggcgtgagccactgcgcccggcctcaggactgtatcttttaactgccttggtctgtttattattatcaatgaccaggttggatgaaggcatagataatcatgtttgtttgtttaatcctgtaatgacacaaaacttaaaagcaatactgaatgggtgggatgccaaaatcaggattttaaaagctcagcagagattgcagtgtatgagtaatacctatctagctcaggaagagtctacccaaatatctaatacaatcttagtttgcattattaggaagagagcacctgatttggagaggtagtggtactgctttgctgtgcacaagtcagacacaagtgaatgatttccctaaatacactttaaaagtgtatgctccaggaaattagtcatgtggaggatgagagaacttgaaaccaacagtatatgtttaatggataagagaagactcttcaggcatatgacagaatctgtagaaacatgtatctaaatacattagaactcttcaaaacagaagcacattgaataatgcagtgtgaaaaatccatggtgttatcttgaaggtcacggcaggtactcaattcataattattgaagtaaatttaaaatctagcattttcacttaaaatttcattagacattatcctatacaaccatgatatgctaattaagaggatattgcaagttgacaaactccagaaatgaacatctcttatctctaggaaacatcaactagaggctgaagaggaggtagtggtggtgattatacatgtgcataatataggatatttcactgtgatttcaatattgtgaatactgtaatcttaaagaaagtaatctagcaactaatgttttagagacataagtataaaatcaaaatcgtcaaaatatggacttatggtgtatgagagccttgcttttaacttccagcaaaactaaatacaagttagagtatttggaataaagatattgttttcatagaactttataaaatgagtcactaaatctatgagaaacgaaatgcaaatttcttataaataattaaaaagaaatcattaaagtatttcttaccacaagataagaaatcttccattctgtttctatttcacataatccctcaatctttttatatatgtactcaagatatatgcattctttctctgctttttttttagggtactttgaatccctattgtgtattgtgggatgactccaaaacgtaagtgacagatgttttcctacattactttgggctaaattttcaaagcacattaagttagttcagctgcctgctagttaacaggaatataagtcagtgggatgttgcattcagagaaaaaaaaatcctctttttgaatcttcaggacagcatgatgaatgtgtttgtgtgtaatgatgccatcaggttacatctcaagatagtattgcattacctactgtgtaaggcacattgcaatgtgaattccatgaggaatttttaaaagctctgatattttagaattgatagaagctcgaatgccatcttaacatcttgtcctagtaattcagcttagcattgcagaataaaatagcaagatctatggtcatttagccaatatattactcacatgaccttgaatctattatcagagtaatgcaatatttatatggtccctccaaattgttttgtgataaaaacattgagtgacatttaattttttatttgtatatttttgaattcaggcagaaaaaataattgcactaaataagtatgagtaattcttccatgttatttttttgtttgtagaagtaattgcaatatatctaatcaaaatcacctttattttattgataatcctgagattttgatgtctcaaagagcaggaaaatctgtagttaagtcttggttagactcctatactttaaatacttgtgtagcttataacttttatttttttgcttggtttgattttgcatgaggggagataaatatcaatcaatcccaaaagtaatcccactctatatatgctgtcagatgaagcaccatattgttggactgtatgtattctaagaattttcctggtgttcttcacccctgatatgatctacatctgaggttttgtgatgctacttgtttctcaccagagagtctagaagaggagcatttttagaatctctaggaaaagattgaaacctcggacaattttctcagtcctaggatgctgatataatttaaattacaattaatattaaacatactcttttgctataggttctcatactctgggtatcctttactactagtccagtacaatagttaagtacagagaattccaacttgccctgttgataacatgagctggatagccttactgatgtcattattatttttttctttttggaactttacagacaaatccatgatagtaaaatttttgcaagctttctctctctaccaatagccagagaagaatttggtggtataatctaagctgcacttaatatgttatatagccaagggaaaaataaaatgctataaaaatctagttgaatgttttcggcccaagaaacatgtgctatcttgaactcctgattttagtttccatatctctgtgaataataagcaactttgacttagttttattattattatttttttttactgggtagaatctgcttctttgttgatctaaacgggggaaagtgttagttattccaaaagccccttaagactattaaagggacactgcaacaagagatagttccttattttgtgcctcctgttggctacttttcatagacagtataaggtgttaagttgaatttatcaaactattggtttctgaggttagcattcacctgaggaatcaatcacacctccctaacatctgctgatgacatgactcttatctgtcacgaagaatgtctcagctttacaacattcagcttctaagttgtccttgaagaaaactatccagggagaggaaatgtgtttagttgtctttcaaagaagataatctcaagggattggtgtagttcatgttttcttgatgtatccgaaaagtgatcaaaaaccttcccattgtgacagaacttctttcccatcacagttttcgctagattgtttcattattaaaagtgtttttctgggtgagctttaaacaatgaaggttaaggcaactttatttcctttcttcacatttgttcttctattttgactatatttatatatacacaatagttttattgatgtaatcatattgaatttgaatataggtcctctaaatataattaatagtgaagagatactgctacttctttttatacagaaaacggctgtcttaaatattttcaagattgcagtaataaagttcaaattagaagttgtgctttaattttggtttatcaagttgctgttatttttaatttttaaaaattgatttttaattacaaaagcaatgcacgagtattttttacttgtaaaactttaaggcagaactgttaatgtaaagagccccactgatcatcaccatcttgggcctccacatccacccatatctctaagatcattcctatttacattttgttgttcataatctcatatatccatttatacattgacgtgtattcattcatagacattcacactatttttaaataaatgttttcatattgtatgaacacttgacaatctcaattttaaattcaacaaatatcttggaaaatttattttacactacctatatttcattcctcgtatctgctgcattgtataggtatatcaaagttgatttactattctctatattgatgactattggcatgatttctaattaattttagtctctaaactgtgcttctgtgtatctccttgtacatctctccctgaggatatctctgctcacataatccaaaatgttgccctgttgttctctttatataaccccgtttgatactttcacagcatgcattcctttttcttattttcgtttggttaccacctgtcttcctcactagaaaataagcaccataaaagaaatactttgtctttcttattcatcactgcactgttggtgcctactatacctgcatataagatacattcgataaatatttattggctactttggtaaaagaatgaatgtttgcatgtttcgtaggtacattttctatctaagaattattcccatctctatttgattttatcagttgataaatatttctagcaattattagagctaacattggaaatttgatggaagaatgtttcagcttgttaaatagtaagatccattataaacaattaattttatttccaagggtaatctattacccagattatctcaaacaaaggcattttattttactatcattagacaaaacatctttagacaatttagaaacatatttgttttgttctggctcactaattaacaagatattgaaaatgcttcattgtatgtgacagatgaaataaattcaaagtgattttctcacttcagacataggcttattgtaaatcggagaatattttttattcaatagatgcagaaaagaccttcgataaaattcaacaccccttcatgctaaaaactctggataaactaagtattgatggaacatatctcaaaataataagaactatttatggcaaacctacagccaatatcatactgaatgggcaaaagctagaagcattccctttgaaaactggcacaagacaaggatgccctctctcaccactcctattcaacgtagtattggaagttctggccagggcaatcaggcaagggaaagaaataaagggtatgcgactaggaaaagaggaagttatatgttcttttaaagtggcttacaaagttatcatttgagtgattggtaatttgcacattctttgagctactctaaatttggattttgagtattagatcatgcgtggtgactacatttcctggaaaacctataatccctcccttaaattagcctgtggtctttctctacagatcttgtaaccatccatctaatactctcaagtctgtgaaggactacgtttgttttcagaaagtgtttcgttaatccatttgtaatttatttacctatcttgttgttgaaaacaaaagcttctaaggactagacttccctattttttcttcatttcaaattgatttattggagttgggagtagcaacagtcacatcttgactgagactgacactggcttgttttctctcaaagttaagtaattgaattgaactaatttctctcctttgcttccattatccttatttattcataaccagaatatctttctctccctttgtcattcatcctggaagtcaaaatttcatttacctcacagtataactcctagcaaatataaaactaacacttcaacctcatcttcttatttcagggaagttgacatcattttctttgctctgtgaatgattgatatatctatacattaggaagacacaatattatatgccttaagaaaaatatgttcctcttagaaattttaaatacttatacaaagtgttactattattggatagccaacctttccctgcagggaataaccaaatgataaagctcttttatatggctctgttcaaactgggatagagtgggaccaaactaagatgaacagaaaataatcttcttataagtatgatacaggagcaaaaagaacaagaaagaggtcttgttggagacttcatttaagcaattaagaaataaaccaagaatagtaaccacgtaaaacagcaatatcatggtctcattgtttggagagaaatgtggaaacatcttctacagactcataattacctaattgaagccttttcgtgagcagcaatgaaaaaaaaaagtctgtattaaaaatatttaacaatgtatagccatcattccagtagaaaactatttctagaatttcctggtgattcaattaaccatagacaggaattgaaaactatttaacttcaagaagttatgttacctttgtagcacaggttggtctgtttagtacatgttaacatgtaactgattacattattacagtcgatactttagtaagaaatcacaattgtatgacaaacgtatgatgttcagtcttctaaattaacattgttatgtgcagtctgtatgtccaatatatgttctaggtgccagcatgttccattttactggatagttcctaaggtcttgtagttgttcttttctgtagttagaagggtaaaagaataactaattttggctgacacttgtaaccttgcctcagtaggtatattcgtagtcagtatgttgcagaactgcagaagcagataagttaaatttttggaatttgcatctaagatgttaaaattccatagaactttccattatccattcaggtccaatcattaattctctaatattataaaactatgttatgctttttgtcccttgattatattcacactgaaaatactgaaaatactagacctttacattatcaaaatactagtccttataaagtaaaatttacctgatctccaaaaaatgaaatttatattatagtcaaagatgctaatgccaaactttagaatggttcttggttttcaaatttattgtggataaaatgtttgcttctgtttgcaaagcaaccctgctcttctagaaatattacaaaaagcaatagaaaaaatttaattttctaagaaaatagaaatacaattaaagatttattggtgagaaactaaatgaaacttttactttttgcttttctgtttatactatacattattttttgaagttttttcatattcacaattgtgtgttttctcataaagccattataattcagctttcttcaggtaaatttttctttttaatttcttaaaatttaaaaaattatcttagaatgttttaagttacatcatagattttatgattttaaatcttaaatgcttagtttcttaaaggtgtattattaaatttgttagcacataagcaattcttttttaactgataacgtttacataaatgcttctaatattattagcaacccattatgtccattagcgtgagctataaggttcaagaaatgctgcatcatgccctcaacacaaattctctggtctaacattaggaatcaaatggcatcatgtatttttcattgtaattctcaccttgtccatctaacattggggtttgcacactacaacctgtgtcacaaatacagactgctgcatgtttttgtaaataaaattttatcagacacagtcattcttatttgtttatgtattgtctattgcttctttggtactacaactgcaaagttgagtcacaacagaaatcataatgtctgcaactcctaaaatatttactatttagtcttttatagaaaaaaaaattgccagcctctgccccaaacagtgctttccagcactttttatatcttggcacacagaaaatattgattatacatcatattgaagtaaatgaatgaaatatttgcaagcagggtaagggtaggatgtccaaggctagagaggatcaatatctccattagttctggaaattctctcactttttgaaatatagattcacccataatttgtctcattctcatctgtaataccgaataatattgtttcctatccttttcatctcataacctctcttccatagttctacttttttcccctctcagttatctattttaacttactttcagttcattaattctctcttcagttttgtctaaccagttatttaattatccatagagttttaaatttgggttatcgtcattttttatttctagagtttccatttaattacttttgatctggtaaattactttctaggtttttcttttatgcatatttttgtaatctgttgtatttcttttaatgtattaagcatagttattttgtaatctgtggctgacatgtcttatatttgaaacttttggggtttgtttctgctctcttttatttcttccaattctcactcattgtactttatctcttagtgtgctaggttatgtcatgttaattgtccttaacaaactattggtgagaattctttgaggccaaggataaaagtgcattcctccaaaaacaattcgtatttgcctctgcttattacttgttgatattgcattaacctaggatcccttaagctaaatagagtctagaggttccctgcatcactcaagtgttgtgaacccaagctgcaaatcctagctggatcgttgtcacatttttccacatatagttcagaatttatagaaatattcaaatgggaaagttgatctgaaaaaaatcttattgctggaaattggaaatttaaatccatatctcctcatatgtatagttcttgagtaatacatctcacatctcacagcatgcctgtagagagtgctgccctaaaaagctttgtgtatatatcttttataatccttatattttccgctttattttgtagcaatttgatatttctttttagactaaagtatttgaggactagaagtgtgtcacattcatttttgtaaattatactttgtttactgaagagatttgcaactagttatcagtaatgtgttcattcatttgacaaatgtttcttgagaacctattatttgttctgctgtttaaggtgtctggcacatatatcagtgaataaacaaaaataacttttttatgagacttagatgtgggaggggctgggggatgagaaggatataaacatgatagatatacaaattatgtaatgtgttaaagggtaagaatttcatgggtggatagatcaagatgagaataagtaatgccatttaattcaattgactttttcatattcctttgactgacttactccaagattccaccattcatttttacaattaatgtttacttagcaagcatcgaaaatgtgtaaaggatccaggatccatctccagctttcatgagccacctaattaactgttactttttttttttttttttttttgagacagagtctcgctctgtcaccaaggctggagtgcagtggcacgatctcggctcactgcaatctctgccttccaggttccagcgattctcctgcctcagcctcctgattagctgagattacaggtacatgccacgacacccagctaatttttgcatttttagtatagacgcagtttcaccatgttggccagtctggtctcaaagacctgacctcaagtgattcacccacctcggcctcccaaagtgctgggattacaggcatgagccactatgcctggtcttaattaactgttacttttggtcattgagttctctgtccatttcagctagctttcctctagtgtttgatctttcatcttttgtctgctgtctgcttttccctctggccccacggtgattgttatcccaactatccagttaaattatataatgcttgagaagaggtagatataaactatgacatgaaaactaaatattttctgaaattaagatagctaagaattctggccaaagagatctttatttattacaaaagaaagaaaaaccaaggagccatgtgtgttaaaacaaaacaaagcaaactaccaaatgtgtagaatctactctctgatattaattttctagcatggtaataaaattcagaaatgaaaactggctttgttcataggtatttctaaatccaaaacattgccagtgatatctagattactatttcctatagtctattatttagcatatgaataatgatctggaaagacaacaattttaaaataaataatatttttcaaaattcctctctatagtttactgaaaatcttataggagataggggctttcagtttgtcagtaaacattttctatctatttgaggttatgaaattgaaaatttgcatcaaatttttaattagtaatatgaaataaagtatgataataaaaataattgcaatatatctcatcactctaagctccagattactgaaaacatcaaaatgggcataatattgcctatggcatggaggtgaatgataagaatcaacaaaaaagttctctaacaatgcttggtccagtgactaaagtatgggaggtgctcaataaaggtttggggtatgcatgagttgtttggaagttgtttggtatgcatgagtggcttgtgaaagaatctaccaaggaaggatagttattcctattctcttgtttgaaaaatgggtcttaggtatcttgaaaagttattttttaaaggtatcatatactttgggaagaatttccagagtgtaaaggaaaaaaaataccctcggtgaaaatattgcgaaagatgccaaccagaagattcctacgtgtcataggaagctctcatcagtgtctctactgtgtgaaatgtacactttgcctcatccatttctccttattctcagaaagtcattgaagtcggttttgaaagtatttacttaaacaaagtgctctaaaaatcaataatagcaaaacttggaattcatcccatatttctcaccaatttagactgttctcagggactctgggatgatttcaggagacctttacacaagaattttaaagtaaaattatgttattaatatattaatgggtatagtattaataagagcaacacagagctggctggtaaggataggcccctgggtaacctctcttaattttctaatgtctgtggttctattttgaaaagactttatattgctgagaatttatattaggtaattttagcactgtatttttccagtcatttgaatgactcagactaattttttttttctattttagcttttataaacaaaagactggacattttccttaatatttaatttgatatttccttttcttattttaaacccccaattcagaattgctcacttgtactatagttaataaccattttgcaggtttggtgttcctcagtaattaaaggtacctaacattgactgttttagacattattaacaagcaatctattatgaattttcaaatatctcctaaaattcttactaatatatttatctaattatttaaaatatagatttgaatgaacatcggtaaagataagataaatttaaagaaaattattttaaggtttggtaataaatatacaggttattaatccaactttggagaccattgaggaaaagtaatagaataaaaatgcatgtatcaataatgattttgattaaaaaaagaaaccttctgtttaatgattttcatttgatataatggacataagtaattatacttgagggttgtaaatcaagcaataatattttaaaatttatatttggagtcaaattgagattttattgcagacaatatattttgcaaagaatgaaaactaaagatggcatttaaaaatatacataaacatggtctataaaaaagtaatttggaaatttacattttagaagatattagtatcttcaatataataataaagcacaatattgccactatatagtatatagaaagctgtttgcccactctctctactttgtacaagtggttgtttttcagtatgaactggtgttgttcagatgttttttgatactcttagtagaactgggcattggcaagaattaggcaaatttcactgccctgaattttcactagtgtagtaagctagcagtagtccgaaatgtgatgtactttgtgggctaactcaaagtagatggcactatttcctgccactaatactttactttgtcattataatctttagcagtgagattatgtttactaggttttatgatactgtgtttgagaatacagccaaaggtttgaaagttagtgccaaattttttttggtttggttgggtcttttggagaacaggaagagggaaataggagtggcaatgaagaaagatttctaaaaagtgcatttttgtttgtttgtcagaaatttttatttatttaaagaaataacattggttattgattagacatatatcattatggtttagggtatgagatatagagtccaatgtggtattattagtttaatgtgtatcttcttgtggcaatagtgaacagtttcaaaagatgaatacatattttaaagggggagaatgacatagcatttttaaccttttcacgccaggaattgctgtgtgtggatatctgtgtgctgagtcaaagaggcttaggcttttttgttagaaacgtaattgtaataaagtaccatgtagtctcagaattctgtccaacaaggtactacttgcttaagtctataacctgtcagcttcttttccagaattatacacacatatagatcctttacacgttctaacttgagcctacactaaaattggaattcagagaaacacccaagactgctctggtatctggtacctacaaaaggaattgcatttattttctttcattgttgtgaacttcaaatctcaggacccggtagttgagatttaaaagataaaaagtttaacattactgttctaaattcattaccattcacctctcttaatctagaaacacatggaaaatagaagaatatctgataatccaaacagctttgacatactgaactgatgttagtgctatggtctgaatgtttgtgtcaccccaaaattcatatgttgaaacttaatccccaatgcagtgttatgagggagggggacatctaagaggtgatgagctcatggtatttttgctctcatataaaagaccccaaagagcttgcttatcacttctgacatatcaagaaacatagaaggcactatctatgaggaataagcactcaccaaacactgaatctgctagtcccttgatcttggacttcccaccatccaataaatttctgttgtttataaattacccaatgtaagatactttgttatagcagcccaaatgaaccatgagagttgaaaagtcaaaaaagaattatttatgaaaaaagaataggtagaaagaattggaaaatatcttagacaactggcatgtattgcagctaaaagaaatacaatacctttgtttagaaaggcttgactacccatgagtctacgtcacaggtgagcaaccatccttttagtaattactgtaattaaaagatatttcatgccttagcttaatgtatttcccgtgttaatagatcttttcagcctgacctgagtacagatcacaagccactaatatgtatggtctgcttcaaaaactaaggacaagaaaatctattttctatagtttcaggcatgcaaaactgaacagactgtcttaaatggaattggttttctcagggaggtctctcccttttatggatttctttggatccttcctatatgatccatttcactttttccaacacctgtatagttctcagagcagagtagctatgtaataaatatttactgaattgaaatggaatgaagtttttaattttatgataaatttaaataggttttctccttgtctttattgacacatatgttatacaaaaagtgtcaagttttatgtatcaatatacgttaaaaaaaacacaatttctgagttgataggtaatctagttcaatatatacaataaagcaatcttatgtgtttctttgttgttgttgttgttgtttttgttttgagatggagtctcgctctgtcacccaggctggagtgcagtggtgcaatctcagctcactacaacttctacctcccgggttcaagcgattctcctgcctcagcctcccaagtagctgggactacaggcaggtgccaccacgcctggctaattttttgtattattagtagagatgggatttcaccatgttggccagtctggtctaaaattcctgacctcaggtgatctgcctgccttggcctcccaaaatgctgggatgacaggcatgagccactgtgcccggccaatcttatgtgtttctgaaagttaaaatgttcttgctctttttcttttctttcaagagagaaaaaagtttattttgccacagaaaatacaaagtgattccgtgttcatgggaggaattcataattcaggctcttattttcacactgcctttcaacaacacctacgccacctagaataataatgtgctaagctgcagtgcctgcaaagtatttcaataaaagaaggaaattattttcataattactactaagttcttaatttgttctgctaaatggtaaatcagccatagttagtgaaagaagcaattcttgtgtgttgatattacaggtttagaaaaggaggtttgcagttgtcttgaaatactgaagaatgataatttaatttaagaagacaaagggttaattagtggaagttctttgaatctccacagaggaagtactgcattgctttctgatatttaaaatgctcagtaaagtcatttacaggtttctactattattggaagtagacagcagtattttctaatgaattgtattgcaatgtgtctgcaggacagaaatcagttcaaactataattaaacttgttaaacttgtcagaaatattaacatgagatatatattgagacctactttgaacacaggcataattattgactttataaagaaagagtactatttcagatgttttcatgatgaatgtcaattaggtgctcataaattgtatattaaagggaaaatttttgaatgagtgaatatttatataatttttttctgagctaatctttcccttgcaggatacctagaaatacatggacacttcttagcctctattgttagggttaagtaaattattgattcactaatatatctcattatccagcatcactggaaaataaaaaaataaaaacttattgctgataaaggaatttccagttaagtgagcttatctcttttataaccactttacaattctacttatttaatttatctttgtaggatgtacttcacctcctgtactgtgagcatggtccaggctgagataatgctgctgccctagagctctggttctttctctaccaagtaggagcatctctcaatcttgacactgcagggtgttaagcagcatacctggcttccacccactggatgccagtaactctcctgaccctcttagttgtgatggccaaacatgtctccagatattaccaaatgttcgtgagggtggggagaggcaaaatcaccccaggttgagaaccattgatataggggaacttgttgaaaattcaaatttttgcccccaacttagaataacaacctcttggagctatgtaagtactgtgtgcatttttgtttttctattttattttgttttttagcaaggtaaactttccaagtggttataacacattaaatttgagaatcattattcaagtagccttctctgcttttcattttctaaacttctattacctaggtgcaaatcaaatagctaaactgagtgtgtaaccttaatattacatgtatttcagttatgtgggttattcaatacctcatctccaagaaagtgcctggactatgaggtcatcgccttctttagtatctctgggaccttgtctgttgttgagcctgtttggaaacttggctgcagtaaatttgactgtaataatgtcctgtgcataccaaaatgatgagtgatgtcattggacaggctatcctttggctgaaagtgcactatggccttgctttccagtatatgtaatgaattttcccagactaatcaaataaataacaaccatagtggatgaggacatagccatttactcattcactttttcacacactcatttattcatttattatttgattctttcatgcatatatttattcaagaaccattcattgggtacccaaaatgttggtactggggacacaaatagtgaacaaggtataggacttgtaatctgtaggggaaatgttagatatgcggccacaaagtcaaataaagatcatggttttcattagcaaagggctatacctgagctaattagctatgaaaggttaattaacaacttacctattcagcaaaagaaataatatcttgatcgtttggattgtttggattgattgcaaccatcatgcaatgcctaatggttgccccaatcacagttaatgctataggggaaataagctttacagtgctataaacatattgcccatattctcactattagaaagaagaaactttcctgaaatttgattaaattaatggtttaatttcaggcataaaagtatatttaaaaatgccttccaaaatgaacagacacttctaaaaagacatacatgcagccaataatcatatgaaaaaaggttcaacaccattgatctttagagaaatgtaaatcaaaaccacgtgagacaccatctaacatcagtcagaatggctattactaaaaagtcaagaaataacagatcctagcgaggttgtggacaaaaaggaatgcttatacactgttgatgggagtgtaaattcgttcagccattgtggaagacagtgtggcaattcctcaaagacctaaacacagaaataccatttgactcagcaattctattactggatatatacccaaggtaatataaatcattttattataaaaacacatgcatgagtttgttcattacagcacttttcacaatagcaaagacatggaatcagccaaagtgcccatcagtgatagactggataaagaaaatgtggtacatatacaccatggaatactatgcagccataaaaaagaatgagatcatgttctttgcagggacatggatggagctggaggccattatcctgagcaaactaacacaggaacagaaaaccaaataccacaggttctcacttctaagtgggagctaaaggattagaacacatgaatacatagaaggaaacaacacataccggggtcttttggaggctggcgggtgggaggagggaaaggattaagaaaaacaacagtaggtactaggcttaatatctgggtgatgtatagaatacaagaaacccccatgatacaaatttacctaattaacagacctgactttgtactcctgaacttaaaataaaagttaaaaagtaaataaataaaaattaaccttccatatagtctattaattttaaataaaaatcatgttaaatgtttggagtatttttgacatgattaaaaaaatgtataaaaataacttttaattataaagttggaaaataatgtttgaatgagccatctgtttaagttcctccaaagcctgtttctctataagcagtctgcaaatgtggcccctcttcctgagccctagatttccattttttaagcttcatcagagatttcaacagttaaaccttttctctccagcttcttcagtcttggcctccagagacttcttcacctttgttagcaaagattctccagtatctcttaaaaacaaatagcctccttttaacctatttaaattttgtcatgatcttcacaggcttgagtcatctgtcctattctctttacccttcttcaaggtcaatgtcttgcctaaaggagtaccagaaacatctagtgttcagatcatttccattgtctattttggggaaagatagaaacagtaaactgaccccatattcttattaaattgttgatttgaagtaacgttctaattaacttttcatgagtttatgtctttcaccaaatagactgtaaatttcttagaaattgagactcaagttttattcatcttccaaccccgtccccaccctattccaaacctgtacctacctctgcacacagaaagttatccaaaaagactttggagatttgattttttgataataattgtaagcaacatgtgtgaaaaagattttgtgtgcaagttactggctgggcactgaggacatacatattaataaacacagatccttcccttaagaagttacagttagtgatgaaaacaggaacgtaaagagacggttacagttaataagcaaaaaagtacatagaaggcagaaccaatcagactaggggacccagggaggtcactcacaagaaatgatacctgaattggtttgtgaagacattggacgattaaatgttaggtgggtgactgggggagggaagggggagaacgttttcaaaaaagaacaaggagtttgtgtaatggtacagaaggtggtgttagagcacttaccttgttgagaaaggagccaatgtttggtggagaggggtgggcagccgagattcaggggtagagcagtagacagcctaggttcaggaggagagggagtaggaagccgacattcaggggtggaagggtgaacagcctaggttcagtggaggaggggtgggcagcctagtttcagtggactgaggaggatagccttggttcaaggaagagcggggtgggcaccctaagttcagagatagaggggactggaagcctacgttcaggggtacaaggatgggcagcctaggttcatggagagaagggtgggcaaaacaggctaagggagagagaggtgggcagcctgcgtccagggaattgaggtagccagccttggttcagcgggagagggttgggcagcctagggaaagggatggggtgggcattctaggttcagtggtagatgggtgtgttttctaggttccagaggggaggtagtgggcatcttagattcaggagagtcatgtagcctgggttcaggggaagagaggaatgtgcagcctcagtttaaggaggagatagacagcctaggttcaagggatagggtttgggcaaactttgttcatagatagagtggttgggcagcctaggttcagggggatatggggttgggcagcttaggttcagggggagaggggcgagaggccaaggttcagggaaagagagggatagatagcataggttcagtgggagatgggtggggagcccaggatctagggagtggggtgggcagcctgggttcggggggatatagggtgggaaacctacgttcaggggctagtaggtgagcagcctaggttcagggaaagagagggtgtgacagcctaagttcagggggataggagtgggcagcccaagttcagcagtagaggagtgagctgccccaagatgcaaaactcatgagaactagagatgtaagaatcgtaagacctgtgtttgctttgctagggagtttgtactttttcctaacagttatagaaagctgtaaaaattatttaaatcagagaaaagtacaaggaattattgtttttaaaaatataaccttaaggtagtgatggggaaattgaactagagtgattgactgcaggctggaaactgtactgatgctcttacaggaatccaggaaggcagacagtcagctgtttgcacagtggaggcaaggtgaagagaggtggacaggttagagaggtgtctactatgaccgaaaccaacagactttggtggacaactggacatgaggcagagggaaggagaaaagttgagaatgagtctcaggtaggtctgatcagagggtctgtacaacaccttctccatgcacactcttattctattctggcaggaaatttaattggtgcattttgattaaacttccaaattgatggctctcttatgctctgacttgtaataattgaaatgattaaagatgtagtttcttctttccaaagcttttcacttatcagttgctcctgttttattgagaaaggtgcttgtagtgatgttatattaagccaaactactttctgatttggttcaaacagactaacacacaaatgctaattaatatttagcatttagatatctgtatccaaattaaattggcacccagaggatgaaagattgaattattcagctgctgttgaaagctatatgtcataccgtgtttacaattgtagttatcagaagtcggctttcattattctaccaaatgtgtttattttctcatagagcattcaaatcttcatggttggctatctatatagaagataatattaaaggttttaaacttgaacaatttatataaaataaaaaaattaaaatctctagtcagataatgtcatttaagggccatttttggatgccttcccatatgcaaagatactaccaatgtagtatcttttgcatgtgttcccatatgcaaagatcaaccatttctgaagcagaatgcttatttagatcattataaaatgaaactgcacacttttaagatggcttaaaataacacaagttacatcataactttgacttaagctacgtgaagagaacaaaagatatggacctaatagaaggcatcagtgtgacctttgtgctttaggactttttcaagcacagaacaatttgaatccctcttgagtgtgtattcctttgttccaattattccaagtcagaattaataaaccccaagtaattgaatggtcttatcattttctgtaggttgctttttacatgtgtctcccacaatgtctgcaggttattctaacatttaaaaagctggattaaatggtaggaatatgtagaaaagcagcagatttactgaattgtttttgaaatttctaattgttttgaagtagcagccacaatgggaaaacttgatcatgggaggccttcaacagaagagagttctgaaccagattttgtaaagatagagtgctctgtgtccacacagatggagaggagcatggggggcagggggcagggggcaggggcatggctggcagtggcttatatgtggaggaaagcatcataaagttctttaaaggcacacccaacatatttagttagtgaaaataatgaaaatgaagctggtaaggcagggaagactggttagcaaatgatattaaagtccaggctaaaaagctggggtttagcaatgtaagatttttccgtttatcacgtgttctaataactttgtctgtctggaagaaaatgcagtgctttgggatatttttacattgtatttcatgagttctgtcgatataaaagacattaagtgacaaagtaatcacaaagtggttttcagaaataggcaaactgagatgcgtactgaaatgtattgcttcaatatcacatgataatacaacatacacacacgcacatgcacgcgtgcacacacacacacacaaccctcttgcttgtttgtactgttgtattgcatatgaaatttctaaaatttcttcatgtcctaggattatcacactggttttaacaatttctttgataatattgtataggttcagagcagatataaataatgagcaataatctaatgtaagaccagaggcctagaatacctttaaagacaattaaaaatcagcacttttattcatggttctatatcagatgtttctgtggcttacatttcatttttttagtgcagatttccatttcttcctggaactttgaaaataattcagttgaagtgttttaaaatgacaaggtctggaagtccctttagttcataaatgaatattttagctttcctaatttttcaccactaactgttatattcaaaggtttaaaatttaatttaccatttttatattgtgatgcctaagatcaggttttaaaaccaacccaggtctcaaagctacgtggacttgctttaattaaagacaattgtattgtgtccaagaaagagggtttttattgttttgggtttttttttttttttgcttatctttattaaatgcatcatcttctatatgcatctattatgcccatccagatttttcctgagatcaagaaaaccattaacaattatgttaactatttgatgccactaaaatacttataaataaaaacttccctgaatattagctcccccattgtcctatttttaaaagtgtctaaggagttacctggttaacttaaaagtgggtgtttttcctgacccccaagtcactataatcttgctcatagtttgtgcttaactttttttcttatcaaaatctgtttccagttctttctactgatatgaccctgttctcatagctgctagtcagttttaagtcaccggtataccctgcccaaatatggtaggtctcagcttcactgtagaagatgacaatacctttctgacctctttaagtgcttcatttgatcttggggagcagttcaggcattcagaggtttttctcatgtgtttcaaccacactacacactgcatttcaagtgaaatgtgaagtgaacctcaaggtctctcaggaatccaaatggaatttgcattgagtctttgaaagaaagtgaaatcacattttctctgtgagttagctatttgaattcctgctttatataaatagtagaagctgaccctgatgtcctctaacattaaagtaaaagaggacattaagaaagagatttcactttaaaagctgtagctggtaatgagaactaaatactacagtctgtttcattttatctttgggaatgttcaataatatttaaagaaaggtcgtgttgatgccacttatcacatcatgagattagcatatctatgactcaggtcgagctatacatgatgaccaacttaataagaataatacaaatgtatctctggttttaaacatttccaatgaatggcaatattactaaatgaacagctctaagccacatgtcttcacttaaagaaagtattttttaactatctgctagatcttggatgaattaattaacttttgctgaaagtatactgcatttttggtgatctttgaggattacaattcctctggtatcattaaataagaaggattttctgggtacaaatgcaatatatctaaccattcatgtctaagtgcttgagacaatttgtctcaatagattctacttttctatatggtagtaagaataagtaaattccaaagtcatctctaacactaacataaccacatgttttccttaaagctacattctggagctattgcataataaaataatgaatatatattgaatatacatatatgtatgtctctgtgtatatgtgtgtgtatatatgtgtgtgtgtgtgtgtgtatatatggctatatggctgctgcagacattggaaaaacctagacatatcaaacactttggaagtgattcctaaaattattttaataaacaaatatattcatcatagctggaaaattatagtcttccttcaagagacacaaggaaaatggtacagatttttaatgtaaacatttatgagttattttaaatgaaaagaaaaagtaaaaacataattatgttagtatgaaaaccagatattctgtggctctatttacacaagtggatttagataatttaggtaaaaaataggttattttcttgaattacccagtgaatgatttctgacaaactgcctcagcattgcaagtaattttctgattctctgtttcactctgtgacacacacataaaaccaattaaaatagtgcagcttacctgagttttactactttgatcataaactcctggcttcaagccatgctctcttcctgccttggcctcctaaaagtggtgggataacaggtgtgagccattgcacctggccctgttttactactttgaatatcagacataaatcacctacttcaagtattattaatttgggactctatgaaaacagaaaaatattttttgagaatgagtgaagccacactatgagctataaacttattatgtattaacttgagatgttatgggctcccaactaatgactactgtattagtccatttttactctactataaagaactacctgagactgggtaacttatgaggaaaagaggtttaattgactcacagttctgcaggcttgacagtatgcatgaatgggagacctcatgaaacttacaattatggcagaaggttaaggggaagtgccacacttttaaaccatccgatctcatgagaactcactcactatcatgagaactgcaagggagaaataacaccccatgatccaaatgcctcctaccaggcccttcctccaattcgacatgagatttggacaaggacacaaaaccaaaccgtatcaataaactgcttattttacttaaagaatctgaaataacactgtattattaacaccaggtcattaaagaaaggacttttttttcatatgaaatgataaccttttaaaattcaaataaaaaattattatagctatcttaaaatgtcacgagttgtcttaatttttctgattttatcccatttcaatgaaaattttatcagtgccaactaattctctgagaactggtatttgagaagttcttaattcttagttaaaattaattttaaatagctacctctatgaaaatatgtgtgtgaaattttgatactaaagtcaagttccttccagtggttcatactgagggtgttcatactccccaggggacatttaccagtgtctggagacatttttggttgtcaccactagggtggggatgccactgacatttagtaggtagaagtctgagatgctgctatctaacctacaatgtgtggtccaattcccccacagcaaagaattatctagttcaaaatgtcaatagtgagaaggctgagaaactcttttaaaccctttttaaagttaaacctaaagaactggtaagtttgtaaagtcacattgactaagagagtatcagcttctgttctgattgagcctaaatttatctgctttctctgtcttcagatctcctaaaacttacctacctcctgtgctaatttccttatatgtatgacaattatgtgtttcagagactcctgctatgttactgtcagcagaaaattcttctcatttgcttatgcatgagtacaaagtttcttttaagtgaaacctctatccatagtgtcctagggaagccttggtccttttcaacatcttctaaaaacacaatggcctttcttgctcctcaatgtgcttcacttgctacttactattaagtgcttgttgattaattctacccaaaatataaacactctgaatacatttgcgtttaacaaatggggctcaagatgaaaacagacttccttcattctcatagggcagaatgaggtcttcatcactacagtgtaatgctatgcactggggcaagacagtccaaggggtgattacatttaatcattcctcacccagtattatgtaacctgtaccaagtgagccaggcttaatgccattactcacagagatttacatatagaatatgaagttttaagtcctttgtttctttatatgaatatttgtggctcttatataaatattcctaaagaacaagctctgaaaaagtggaataattccaaatgttgaaaatagttttggactctattttgcaagtgttaacaggtttggacacatcagtcatttacacttaaacaaattaactcatagtatttcctatgaaaaacaactcccactggtctctctttagatattatttaacttttattagatgtgcccatttgcaagggaatatttctgtatgtgtttcttgttttagtgcagaattttctgtaaatcattcggtctacatctataacttttaaatatattttatatattcacgctttctattaatcttcttactttttggttttgacttttttcccctttacattttgtgaaacactcatatacagggttataactggatacaaaataactaaaaaataaaaatcaaaaaacatatgttccaatccataaaatgttcactaggaaaatattgtcatgaaaatgaattctataaaagttataagagagacagagataaaaagaggagaggagaaaagcaaaaactaagttctcccattttgtaattagtaactggaaaatttttactcaaatgtaacagctgaccttctcccatattaaatgctttttggctgtatgggtcaatgggaatacaagaagacctaaccttggtcagagattggctttgtatttcaaataagatcatgccctgatactattccaattgctagaagtttttcaaaagacaacttaaaaatatgtataataattccagaaaggtaattactgttaaatttttaccctttaaagcctttaaattcagttttgttcttagaaatagggtagatttaatagacggaaggaaaaaaaagacaaaggaaggaaggaaagaaggaaggaaggaaggagggagggagggaaggaaggaaggaaggaagaaggaagggagggaaggaaggaaggaagaagcgagggagggaaggaaggaaggagggagggagggaaggaaggaaaggagggagggagggagaaagggaaggaaggaaggaaggaaggaaggaagggagggacacttggagcccattaatgtgcagttatgatcctggaagccatagggtaacgcatttcctaaatattaaaataagattttatgtcctacattttccccagattaagaacacttaaccttaccactctttagtggtttctgtgatgtctaacaacccctgcccaacccccaaacacaagtaataaagtgcttgtataaaatgcttccagagtgaaaaactgctcaaatgaatagtatgattcagtaagggttaacgcatatagcatgtatggattgctggtcttccgagctctataatgtagtgaaataaaaatttgcctaaattttatcttaaaacagttctatctctttgtttttacttagacatttattttgagaaatggagtactattaaggctttaaatgcaaatattagatacagtaagtatcgtgtgtgtgtgtgtgtgtgtgtgtgtgtactgcagaacagtgagcaaaaaaggagaatacaagaagctgaattgaatttacacaaaactgacaaaccctggaaattgcttagtttttatttaggcttttatttgccatttatatatttcttataaaaatagactgtgaaagacataaattttaaattatatttacttttttaccatattatacagaaacattttatgatatgtcctatatacaggacactgttctaaatctttgtgtgtgtgagtgtgtgtgtgtgtatgacatgtaatctcataaagccctataggatagtatcatccctgttttacacaataggaaatgaagcacagagaggtataaaattttcccaataccactaagctggtaagggtagaataggatttgaactcaaacagtctattctggcatgaatactatattgcctcctaatatattaagactctcggccgggctcagtggctcacacttgtaatcccagcactttgggaggctgaggcgggcggatcacgaggtcaggagatcaagaccacggtgaaaccccatctctactaaaaatacaaaaaattagccgggcgtggtggcggacgcctgtagtcccagcaactcggagaggctgaggcaggagaatggcgtgaacccgggaggcggagtttgcagtgaacagagatggcgccactgcactccagcctgggcgacagagcgagactccgtctcaaaaaaaaaaaaaaaaaagactctccatcttaaaaacatataaatacaaaatttgcatagtcactttgaaacctttgcatcccaatcattttaattcgctgtagtgaacctagaaaagtgagcccaagcagcagacacattttctgaaatttttataaatagcattaagtaagtcagtatggtgagtaccctagaatgagcgtggaaacatatttcaaatatgtgtatgtttgtacattttaaatgtttttaatgtacatctaaaactccttttaagaaagaccaacttttatgtttactgtgtttcagcttttaagaagcagctgtttaaatacatggcattagggatcaggggttgctggcattgtgattgaggccacattccctgagctaacggggagcagaggcattcatgtcattctgagtacagggtgatgtgaatggatcagtgagcagcagggccaccaaggtagaactggcggagcccaagtgaaaaatagagcatcagtaattttatactgatttgttggtagaaaagagtctacctagtgccacatctgatttatggaacaaattggacttgtaatgagtccagatacaactgacctctttgaaaggaagtcacaacctttttttgatatacttcatgtatatactcatgaatacattatcactatgcagctatttcattttattctgcaactcatttttatggttagagttattctaattttgttgtaagaatagacaaccatagaatcaaaagtgtaatttacttcattcttttactgctccgttcatgctgagtattttgttttgtatattccttctcatgacaacaatgccaaaagaaaaactatgcttggaatgaacttgttaccatggtaatctcaaaattaaagtttcaaagtgttcaaatgttgccctcaaaaaaaaatcacaaataaaaatctactcagttttgtaaggtggatggcataacccttgttgcagcatgtacataatgacattcacctatcttgaactttagagagagtccaaatgtttctggtgtactgaaattctgtttagttcagttgaaataaatgggttataactatgcaattgctacagtatttgctgaaatgaaataccatgtcaatatataaagagaagctcattttcatcaagcaaagtagacatcaaaaaaactattttatatagcattgcttagacaaccaaattaaacaagtaatttttgtagatttaattatgtatgtcataactagagtatgccaactttctgtctcaataatcacattttaaaaatatattgattaaggaaaaaaagaagtctcatttgccagtgaacctttggatatttattaagataatttatggctttaatccaatttttaaaaatctttcatctatcttaaagtggcttcaagattttaaactctttcctgtggcttttatctttaattttatcctgtagtgaattgtaaaagtaatgaacaagggcaattggatgactcctcttacatatacactcaggaaagctctcagtcatctatatatccaaatttgtgtaaaatatatttgttattatattcattattataatattattatatttattttataaagtcacatatattaagatagaagcatttctgtttaaaaattatcaggcagtgacagtaggaaaacttgtaggcaagctaattaacaactagatccttcctatcattcaaggttttcacggatgctctcagtatttaaattatacattaatattgttaggcactgaataatcatctattctgaagttggaatttttgtttgtatcgtagattccattaaactttagtttttaatttttttttattattatactttaagttttagggtacatgtgcacattgtgcaggttagttacatatgtatacatgtgccatgctggtgtgctgcacccactaacttgtcatctagcattaggtgtatctcccaatgctatccctcccccctcccccgaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcgttttctatggctgcatagtattccatggtgtatatgtgccacattttcttaatccagtctattattgttggacatttgggttggttccaagtctttgctattgtgaataatgccgcaatggttcaggatagagcttaacttctgcttgtgaaattttagtttagaatttttgttttattagattttttcaacattttaataaaaatgtataggcaaatgaaatcatgtaaagaatatgttgctcttttctataatatagtatgggaagctgtcacttctaaccaactacttttgtggtaagaaaacaaagagtaacactgaaaacacaatatgtgtttcagtaaaaattttcctatttgctcaataattcaatatttattatcatatttcatggtaatacatttctggaagtttatttaaaaatttatatttaaacaattaatttgtagtctgctccaaggaagtttcaaaaacatatgtgtattatgttttactgtttcattatcatctgttcattttcatccaaaagatatttttcttgtgattgggagacaccggatatcataatcaacatacaagttttatgcttttgataatatttgaaaagtgttttaacattgtagtttatagcaaatgacttaataattgatcctcaagtaagtgaagtggaaggttactcaatactaatggtagtaggcaatatagaatggatgtttggtagatacaacttgtgctccacaaactctcaattgcaagaaatgtttcatcattcatttttcttaaaatcaaatttcatctgattctggacgcttatcctagtgagttccctggaaattccatctaccattattgtaccacccttccctttctcccacctttccctcctgcccatttcagcctctaaaatttccagggatctaatgaagacacttgaggacttccactggtactgacttcactttggctgccatggatgagtagcagtgcttctgctgctattttgccctcctcctgggcatggaaatttttctcagaacttgattcagacacattcgtgtaccatgcagctatttccctatttcctgccctctcctactgtcagtgtgagttcctcaggcctacatcgccctctgcctccttccttttgaaaagtcttgccagctgtctagtccaagctcataatttatctctttctcttacctctccccaaactcccagccccgtttctgccagggctagtattgcttctcaatactattgcttcaggcttttataaaagaaaaaacatttaatatcccaaaaatcatataatgcagttactagttttatctctcttttatgaatgaggaaattgagggcagggcagatggagtagcatgcccaaggctacaaagctagaaagtgtcagaacccagatgtgaacacagcctagcaccagggagatccagttaccttgttgaatgggggaaaacaaatattagaataacatgcggtggctcatacctgtaatcccagcattttgggaggccaaggcgggtgggtcacctgaggtcaggagtttgagaccagcctcgccaacatggtgaaagcttatctctagtaaaaatccaaaaattagccaggacatggtggctcgtgcctgtaatctgagctactcgggaggctgaggcatgggagtctaagacagaagaatagaagaattgcttaaacccgggaggcagaggctgcaatgagctgagatcgtgccactgcactccagcctgggcaacaggctttttctgtgagactgcgttaaaaaaaaaaaaaaaaaaagaaaagaaaagaaaaaagaaaagaaactttgaagaaaataaatttgttatgttattttatgttatttttatgttatatttttatgttacatttattactagtatttggctaaggcatgcctgtccattccaaccatgcatttccaggcatatgcttgtaaaggagtacaagctgtttaattaaacggtggtgtatgacaggtctaggttgaagttatatttctgcacctctattttcattaggccttattttttctgtccgtattagtactaaaaatgtaagaaaatgcattcgtgtaccctcctcccttccataagaaagtaaatcaccttttgaaaagtatctaagtaagtaaaagcttttgctcctcaaccaacttatttcaattaccatcactggtcagatccatttgttcaccaggagaattcaatgaatccagcagtttgccagaggctttaatcgtatgctttatagtaaagcctgaaaaggcactttccccaagggacttgtgtaaaggactgagctgctggggaaacattcatcatgaattatttgtttacacttgcagtatttggtaatgtagaaatgaccaatgtgctattggccatgtaaaagacaaagggaatgtctaaataactgaaggcaaatcacagcaggatgtaaacgtgcttagagtcttctactagggcagcatcacggtgtaattcctgactctgtgcatatgcagcatgaaaacctgcctagtagaaaaagaaaaatggaagaaattttggaccagtgccgttagttcacttgaatataaatgtagccaaatcctccagtctctcaaaacttgcattactagattgaggatcttcatgccactattttatgtaaatgtatttaataactatcttccaaaaaaaagtctaagtaaatctgtgatgttctttctaaccagcaaaacaatagccactatgactaatctttgttaagcttctgtaagagaattacatggcatgcgtaagtgtgatttcttattaattagccttttttaaatagaaaaaaattatatttctacttatgtatatgtgcaagagatttttaaaatccagttttcttaaaattgaagtttttgtttagtacaatgaatgttcaaataaagatcactttcaaacatgccattttaatatcacattagatatacactaaaatacatgaaaatcatttatttatcaaatatttattgagtgcctaatatgtgcaaatattatgcaaggtgctaggagtaaaagagttttgctttttatattccttctttgattgtagctttcttatttaagaaatcaaccaagattgtgtgaattactagcagttacaaaatacactgcaagttagacatgtatttttaaaaaatcactgagttaaaaagtggtaaccaaagcattagtcacaataacaaagacaagcagtcaacctaggtgcccatcagtggtggattggataaagaaaatgtggtacatatacaccatggaatactacatagccataaaaagaatgaaatcatgtcccttgtagcaatgtggatgcagctagaggccactatcctaagtaaattaacacaggaaaagaaaaccaaatactgcaagttatcacttataagtgggagctaaacattcggtactcagggatataaagatggcaacagtagacacttgagactactagaagggagagggagggagggggcaagcgttgaaaaaccaactactgaggactgcgctcagtacctgggatcattcataccccaaacctcagtaccatgcaatgaatctagataacaaacctgcacatgtccccaccttccgaatctaaaataaaaattgaaaaaaaaaaaaaagtcagccgaagaagaacgaactctcttgaatgtctgaattatggagtaagtcctgggaatcttagctccaggtcacagaaactattcagtctttttcttttaggagagactgtaaaggctaaatttggccacgagacttcttcagtttcattgcaaattcctcattgctatttctctcccctttaagattgagtacggtgaagtggctaagggtttacctaagttttcagatcaacatggtacaggcaaatgtgtgggatatggaatcaaataaacttgaattttaatattagctccatttgtaaatggcatggcaagcttcttgttttttttttttttccaaatctcatctctgaaataaggatcagaatgcctatacagtggactttgcaagattacaaagcgaacattatatgcaaaatacttaacttctttcagcttgcaatgcaggagtgagaaaggcatacactaaacaccttattttgtgtgtgtgtgtttgtatgtgtgtgtgatggcaaattgtgataaggactaggatggttaggaacaaggtgctataaaagagaagaatgatgtggagatcaaaatttagtttggggaattcaagaagacatttttttagtaagtaaaatcaggttgaggcttggatgacaggcaagagtcatccaggaaaagatttggaaaaatgctggaaaacttttaggcagaaaactgtgtagtgccctcaagaatcagaaaagccagtgttatggtaaagacaggcatgcaatgggatgtgaaatgtattgggcctcatttaaagagtgattacttaatttatattctgagctaggaaactttaagagtgaaggtgatagggaagaggtaatattcaccatcatgcaagaagaataggtataaactggaagtgtcttgggcacacaaggctgcaccaacaccctactaactggtcatatcaaagagcttggattttgttctgaatgcaataggaagccactgaagggcattcaataagagggttacagtatctgatttatctcttaataaaactacccaccgtagtggcctataagattcttggattatgttatttctcttagtataagcaaaattaagaatttgatgacattttagacaaggttgaatttcttttgaaattatagctcattcatgaaataaatgacaaaggagaagtgtctttagtagtttaaagagggatgtagaagttccttcactgttgtctactatttgggaatgtccaaaatcagttgtcctggggcaatgaggggcataatatcaatattatttaccctccctatctctcccagtcttccatgtcctttgtccctttgtacctaggtatgtggtactagtatgactcaataaaagtaaatagtaaaaatagcaatgataagaagtaatactgattactagaaaacatgccttcaacttcacattcattgtcttatttaactcaaattatgaggtaggtatcagtaaccctattttacaaatgagaaaattagctttataggagttaaggtacttgtccagctttacataactagtgagtgaaaagttgaaattcctccaagattgtctgatggcagagcctctattctaaccctctatactagagatggcaggtcagtgactattcagaaccctgttttggtgatgcaatggaagcggaaaggggataatattaaatactatttggtgggcttagtgtagcaagtctagtctctaatatcaataacatatgcaaaaaatattttgagaaatttctgttttcagctgtcattgttattattgagtataattaatagccatgatacttcaaaaatggaaatgatgcactggtactatgattgccttctttaatttttttttttttttttttgagatggagtcttgctctatcacccaggctagagtacagtggctctatctctgctcactgcaacctccacctcccgggttcaagcgattctcctgcctcagcaccccgagtagctgggattacaggcgcctgccaccacgactggctaatttttgtatttttagtagagatggggttttaccgacttggccaggctggtcttgaactcctgaccttgtaatccacccacctcagtgtcccaaagtgctgggattataggcatgatgttatttttttaaatcagatgaactattattatatttttgaggttgtagttttaactctatagtgtccatgcttactataatgaaattaaaatattccatgtgctgagttaaagatagaataagactatattttgaacataatatctctaatattagtgaacaatttatgattgcctagtcactctttgttgaaaaagaaaaccacaataagttaattaggaaactgctacagaaaaacagaacttactataaaaaatgtttaaaattcccttgtgtagaggtaaaatgtcattaattgttatagaatttatttggataatgagtatgaaattgaatccttaacatttctcctgaaagttgtttcatccttatctttttcctttttctgattaaagtactagaagataagaagttattttaaaaattaacaatagtttaaaaacttacctactctataatagtacaaagcccatcagaagcggtgaagtataaacacgtagcacataatattttggctgttgatggaaacaggggtttgtgaagaaagcaggaaaattagcaaccttcttaaggttgatatttgttatcttcagcttacatacggtgaacatatttaaatcttgttcaccttcttaatgggatatgcatgattagacttgccatttgtggaaatattcaatctcagaaaaatagagcccatctaggaaaatcatgaaaggaaattacgttttttcaccattattcagaatataaaataaatttggtttctgatgatttcgtttttaatgaaataatattgtggtaaaaataattttagtttttatcaacaaataggttattcctcacacagaaccttagaattatatctcactgaatcacattagaatcatttagggaccttccaaataaactgaaattgatatacgtgaaatagattttggatacaaagcttgtattctgttctttctgggaataatagcacaaccattcttaggaaaaccactcatctccccatataaagctgtttgttttgtgtgggtatgacttcatccctacctagagcaacagaatatgtgaacaaaactgaatcatgcccaggtaaatggtttgcagtaggtacatgtctttagtctgtctgatctatccacacttcttggcttttcatggaaaaacaagacccccctttttgtggccatgaataagacagtgtgtagccctgtttgctgcctgtcattattttatgaccttagggaacaagcatttagataaaactgtcaagtacggaagcctcatagagaaacagaacaaaagcgtgtccttggtgacattatggaatttctgactcaagtcactccttagcttagcactatcaccttattcttcagctgagtaagctaacatgtttgtctacttttttagtcagtttgagttcagttttctggacatgaaaccaagataatttcttggatatgaaaccaagataattttaattgatgcaataaactattttaaatgaaaatattgtttcaccttagacttgtgaaatgcagaacaaataaaacaatcaaatacatgtgaaccatcagcttaaaaaaacccttctatgaaaactttgagagaaaatctgaaagaattactttctggttgggttgcatattgggtatctgttggggtataggtcattttgagttgttgtgggatagtcatttatagttccactaacctggaatttttgcatgggcaggaactgtttaatcatttggtggcaggaatctcctgatggcagataggctctgtgatatttagggaataggctaagctggtgtaataaatatctaaaaaatcaaggacacaatcaaggaagatttttttcttctcactttacagtccatgcataggcaggccgtccagagacaggaggtagcgctggtccttgtggttacgtgagcacgccccacccaatggctggtagtgctactttgtcatcttctacttggtttcaatttctggatccaagacagatgttccacctgtcaccctttgccagccagcagaaaaaggaaaggaaaataagtggaggataaacagtttcttttaggaattatggtttgataattgtttatcctgttttcgttcacatcctattgaccaaaacttagtcaaaatcatatgactcacctggttgcaataaaggctagggaatgtagtctctggctaaaactctttagtggcttcatattatagagatgagagcactggggacaagttaggtacgcttcacaagcacatttctccatgtttctagatcattaataaaaagcttttatacctatctatatagctatatcaatgtgtgtgtatatatagcaggcctttcgtattcatgagttccacatccattgattcaaccaactgcagatcaaaaattaaacaaaaataaaaataaaaaaagacaaactctaaaaacaatatagtatgactatttacataatctttacattgtattaggtattataagtaatccagagataattttttttttttgagatggagtcttgcatcattgcccaggctagagtgcagtggcacaatcttggctcactgcagcctccgcctccaaggttaaagcgattctcctgcctctgcctcctgagtagctgggattacaggcaagcaacaccacacctggctgctttttgtattttcagtagagatggggtttcaccatcttggccagactggtctagaactcctgacatcaggtggtctgcccacctcagcctcccaaagtgctgggattacaggcgcgagccactatgcccggctgagataatttaaagtatacgagaggatgtgcacagcttatatgcaaatactatgctattttatataagaaacttgagcatctttggattttggtgcccttgggtgagtactggaaccaatcccctacagatgccgaggaatgactatacatatgtatatgtacaatatacatatgtatcacacatatttatatgtacaatatacatatgtatcacacatatttatatgtacaatatacatatgtatcacacatatatgtaccatatacatatgtatcacacatatttatatgtgtatatgtatcatatatatgtatatgtatgtatatatgtgtgtatatatcatatatactccacacagaaatactttctttaatttttatgtatttttacaaattagtggaaactcaagttctaaaaaaactaaagttataattagtaaccacagtagacggtataattgcaatttctttatattctcagtaaattaagtgggaaaaagaaaatttcatttcaattgatcataaatatttatagaaaatgactaaatatattaacatattacctaagttcagaaatttatatcatttgttacaacatttcctggcataaaagtgtgagaaaaataaacttacatgaatgaggcaattagtcaattattttccttctgggaagttatttattcaaggccttttcgtgagtggcaatgggcataatttttatttttatgacttctcttaataatgtttttcagtatcagataattgaatgactattactttaagtctgatttagatagatattaatgatgtcacctaagtcagcctgggtggctgagtttatacagcatgggggctctctttcaaatgcatattaaaacaaaaatttgcattacctaatttcttgtgttcccaaggaattactaagatgtaagtcctgcagagttttggtgcccaggacaatgaatggcccaaagaatgagattctgggagggcaaaatcgagtatcccaataacatcttaatatggctttagtaattttgtttaagccactactcactgaatactcaccctatcccagacatgtcctaagtccttcacatttaagcctttcaacttcccttaggtaagtactattatcaccattttacagatagaaaacctgaggcttggaaaagtgataggatggtgcaagacaagacaaagatttttcttttctttcactccaaactcttgaaaattatacaaatcttttgagaagtgtttgttcatatccttcacccactttttaatgggattgtttgtttttttcttgtaaatttgtttaagttccttgtagattctggatgttagtcctttgtcagatggatagattgcaaaaattttctcccattctataggctgcctgttcactctgatgatagtttcttttgctgtgcagaagccctttagattaattagatcctatttgtcaattttggcttttgttgccattggttttggtgttttagtcatgaaagtctttgcccatgcctatgtcctgattggtattgcctaggctttcttctagggtttttatggttttaggtcttatgtttaagtctttaatcaaccttgagttgatttttgtataagttgtaagggaaggggtccagtttcagttttatgcatatgactagccagttttcccaacaccatttattaaatcgggaatcctttccccattgcttctttttgtcaggtttgtcaaagatcagaaatttatgcagccaacaaacatatgaaaaaatgctcatcatcactggtcattagagaaatgcaaatcaaaaccacaatgagataccatctcacaccagttagaatggcgatcattaaaaagtcaagaaacaacagatgctggagaggatgtggagaaatatgaacgcttttacactgttggtgggagtgtaaattcgttcaaccattgtggaggacagtgtggcgattcctcagggatctagaaccagaaataccatttgacccagcaatcccattactgggtatatacccaaaggtttataagtcattctactataaagacacatgcacatgtatgtttattgcaacactattcccaatagcaaagacttggaaccaacccaaattcccatcaatgacagactggacaaagaaaatgtggcacatatataccatggaatactatgcagccatagaaaaggatgagttcatgtcctttgcaggtacatggatgaagctggaaaccatcattctcagcaaactaaaacaagaacagaaaaacaaacaccgcatgttctcactcataagtgggagctgaacaatgagaacacatggacacaaggaggggaacagcacaccctggggccagactgggggatcgggggttaggggagggatagcattaagaaaaataccaaatgtagatgacaggttgatgggtgcagcaaaccaccacggcacgtgtataactatgtaacaaacctgcatgttctgcacatgtatcccagaacttaaagtataataaaaataaattaaataaagaaagaaataaataaaattggcaaacaataaatgtttgttaaattaaaatggatcatatacagcctttgtggcagccatggagatgtgccacttaaattaacatgtttcaaagaatgcagttagctgatggcttccccatttggcatccactgctgtatttaagccatgcttatggtctcccaagatggttcccagccaaggattgagcatggctggcatatgagttaaaataaaataaaataaaaaagaaaattatacaaatgttgcttacatctaggtaaaagtgggtgtatcagtctgggttctagagagagagggaaagacaaaagcattttaaggaattggtttgcacaattatggaggctggtaagtctgaatttgtagagtaggctatcgagcagggcattcaggtaagagttgaagttgcagtcttgagttcaaaatttttagggaagaccagcagactggtacctcggataggatttctatgttacagttgtcaggcagaattccttcttcaccaggaaacctcagcttttgttcttaaggccttcaactggttagatgaggcccatccacattttagagggcaaattgccttacttaaagtcaactgcctataaatgttaaccacatctccaaaactcctatactactgtttgaccaaacaactgagcatcataacctagccaagccaatacataaaattaaccctctcagcatgtttctaaacactgcgcccacacacacctgttttcacccctaacccttttttaatgcaaaaactcagaactaatactaaattaaactggatttaggttttctcacaatttggatacagctatgaggagattggacatgaaagttatttttcaggacacagctgggatttaaagttgtgtgaaataaaattttctttgataatatacatgtaagctaggagggatcaggaaaaataaggattacagaggcatattttcactgattgcagtaaaaactgaaggcaatttcttgctccaggtagtattaagaaggtggagtttctgaaagatacaatattaacaacagctttgccttctttaaagttaacagtgctagggtaagaagaaagtatatgattttcggaataaaacttttattagcaaacccattatccttgggcaggtggctcattgcctgaggcagagctttgtgaaggcacattatgaaagtgggcatgcagggcttactaatgtgcctggctgatatgcatgcttcattagtgcctgccaacggggactcagcactgcaagcctggttcttggctggtgggcctctgtgtggccagcttcctagatacccctttcttccagctaagccctgcttacttcagaagttaaagccctgaagatacttcctctagttccaactattattttttgtcttattacaaaagtaatatatataacttgaataaaaattaggaaaaaaagatagacaaaaaagtatctgtactgccacaatccatgttgatgtatatttttacaatcttaaatttagaatagatgttaatgtggatctggctgtggatacagatataatatagttacaaaaatgctttctatagtgctttatgccctgcttttttatttattatgtcattaatatagttgcttgtcaatagaagttctacaagttttgttaggactacattactttctgttatattgacattctcaacagtaggtggattgaaaagtataatccactgataaagtttaggtatgttattccactagaacacagatttctgagatttttgtggctctcaggctatcaggcatacattaatatttctttgtctttaagcagaaggaacagaaaaagatactctaatacattctaaatcactatcctctaataagtaatatcagagccatattatagtaagccaaattcttggaggcaataggtaatacttaggagtaaacaggagtttaaaatgtaattacctcaacaagtttggaaatatgagggattaatcaaggacagtttgtttttaaatttttcattattttgagctttaaggcaccaggctctaaacccaagacaaattttcagtgccttctaactattgtcttatattcctgtgtctgagtatgatatgttttattgaattagattaaaattaagttttggagcttattacacagtggtctccaaagaacacactttttcttcactactgccttttcaaagattgctaatatccacaatgtaaagctgtaccacattatttctggaatgactatattaaaacgtgaagatagtagcactgtctgattgcagcattcaagtttttctcccctgtttttctgcctcttctaccaatatatgaattttccaaaatcacaaagataacagcataattaacactttagactcaagtctatgttatataataagagctgctctagaaatagtcatgagcttctggagtctaggtatggccctattatcaatcaaattgagaaagtagccggttcccagtttcatcacttggaaaatgaggtggttgaactaaaggatcattgaaattcttccaaatatagtataattctggtgtagtaattcttcttggagcccagaggcctcttctaacttatgcattgatgattgagtaccagtcctggtattttgttgttgtcagtgtcaaaatgccaaaaaacaatccagtctagcaagtttaatatatagtataaataacacaaaacttggccagccacttgaggaactgatattccttttagaatcaagaagatgcctacaagagataaagtctcaggctaccagagtaaaggcccaggtacaccagacaatatggatgtctgtcacccatcttctctcctcctttacctcagttctaaattcaggcttcaagtaagtgtatatgattggtgaagcctaaattgcatttagaatcttacttccaagggtctctgggacatatcacattttatattttcagtctctgtagtagagggtgtcacactagatagaggttagattcgatgttaagggagtcagatcacagtcccagatgttctcaatatcaggttagtacaagaaacataaaaagaagccactgctttacagaaaaaaaaaataagagcctccatgtcatagtaagtatatagtcttactttaaatgagtttaccctataaagttttgaaagtgatttttaataataaataaccaaatttatattttatctatatatagcaaaattactctttggtaacaatattctaaatttttcctcttataatgaagagtatatgataaatatgctgtaaaagaatacaatatgaattaagctgtaattttcttcatattttatttcactcaaaaagaattagagctgctgttataatggtgctttacattacagatttctcaaagctgacatttgttattagcagcatttcgagtccaccaatcctccagtttttcactgtcatggaaaacctctgatttacatagaagtcagaaactattgacaattgtagttatgtctaactgagctaaagttattttagggagagtattgatgaatggctgattctaacatcagttcattagcatggaatttatcagccaatgataaaatgttagatgaagagaatgaattattcattcattcagcaaatatttccttctgcctactatgtgcaaggcacatagtaggagtttggaatacatcagtaagcataacaaagatccccgttctcttggagtatatattctaatatgggtagatatataataaaaaccataataaataagcagattatattatacaaggtaatatgtgctttgaaaaaataaaaagtagagcgaggtgatgtgttaggaattgtggtgggatatggtcagcataacactcactgagatgggtgatttcagcaaagactttaaggaaataagatcttttgtttttgtgtgtgtgtgtaatcacttgaggaagagcattccaggaagaaggaagaactctccattaaattggagagtgccaggcttacacaaagaagaacaaggagacctgtatggctggagtgcaatgagcagggaagacttatcaggagcggagcatggagagctcagagagccacatcacatagggcttttaggctattacaaaaacttggaaatgggctctgaaaaagtgaaaagtcatttcagggttttgagcagagaaatgagataaacttacattttaagagaatttcacaataactactgtgttggcaatgggttatttagaagcagagaggccagacaggagtctatttcagtgagccagatgagagatgatgccatctctctcaggatggtagcagtagggatggtgaaaaatggtcagattccaaagatcatttgaaaaattcgatttagaatgtatggaaataggggattcatgaataagttcaaaaactgtggcctgggctactggcagaatgatgttgccattaagtaaaatggaagaaattacaaatggatcaggtttgtggggtaggaatgggagttctgcatcgcttctttaaagtctggaggttatgaatttgtgtactgcattgcttattgaaatgtggtccctgaatcagcagcatgagcatcacctggcaacttgttagaaatgcatactttgggtcccattctaaatctattcaataaggagctctggccatggggcccagaaatctgtgctttaaccagccttctgggtgattctggtacacactcaagtttgagaaacactgtatatcatctccaaggtataaggaccagggactacttttccagaatgggaacatcatgtgtttggagatagaagactaacttgggtcaagatggtttctctatctgagccttaatttttatgtctttaaagagtgaatggtagtggtactgatgtcaataattggcttgagaagccaaatcaaacaatgcatgttaatagccttgtgcaaattaagcaccctgtaagtactagagaggggagatggtagcctggagatggtaggctggagatggggatggtgcaacacagtttacctcttttttttgctaaaattatcttgctttcaaaaagaaataataattacatggaaaatcagagttttattgaagttttcctcgagctttaaaacataggtaataaagatgactatcacaaagcagattgatggtactatgtgtgtgacacagtagaaggagtggctatttgaatttaataattatttacctcacttgcatgtaaaaagaaaagagaaacatgtatttttactacaaaatagaaaaactgtttcgatatgaatttgtttctccaagtttatgcagttatctttttttttttttttttttagtatttattgatcattcttgggtgtttctcagagagggggatgtggcagggtcataggataatagtggagagaaggtcagcagataaacaggtgaacaaaggtctctggttttcctaggcagaggtccctgcggccttcagcagtgtttgtgtccctgggtacttgagattagggagtggtgatgactcttaacgagcatgctgtcttcaagcatctgtttaacaaagcacatcttgcaccgcccttaatccatttaaccctgagttgacacagcacatgtttcagagagcacggggttgggggtaaggttatagattaacggcatcccaaagcagaagaatttttcttagtacagaacaaaatggagtctcctatgtcaacttctttctacacagacacagtaacaatctgatctgtctttcttttccccatatttcccccttttcttttcgacaaaactgccatcgtcatcatggcccgttctcgatggtcgctgtctcttcggagctgttgggtacacttcccagacggggcagcctggcagaggcacacctcacttcccagatggggcagcgggacagaggcgctcctcacttcccagatggggcagcgggacagaggcactcctcacctcccagatggggcagccaggccgaggcactcctcacctcccagatggggtggcggccgggcagaggcgcacctcacatcccagatgatgggcagccaggcgtaggcgctcctcacctcccaagacggggtggcggccgggcagaggcgcacctcacatcccagacaatgggcggccgggcagaggcgctcctcacctcccagatggggtggcggccaggcagaggcgctcctcacttcccagacagggcggccaggtggaagcgctcctctcatcccagactgggcggctgggcagaggcgctcctcacatcccagacgatgggcggccaggcagagatgctcctcacttcccagacagggtggcagccaggcagagacactccccacttcccagacggggtggtggccgggcagtaatcttagcactttgggaggccaaggcaggcggctggaaggtggatgttgtggcgagccgagatcacgccactgcactccagcctgggcaacagtgagcattgggtgggcgagactccgtctgcaatcccagcaccctgggaggctgagacgggcagaccactcgaggtcaggagccggagaccagcctggtcaacagggcgaaaccccgtctcctccaaaaatacaaaaaccagtcaggcgtggtggcacgcgcctgtaatcccaggcactcggcaggctgaggcaggagaaccacgggagcccggggcagggaggctgcagccagccaagaccacggcagtacagtccagcctcagcaactgagggagaccaaagaaagaaagataagggagagggagagggggagggggaggggggagggggagggggagagggagaggtgcagttatctttttacaactgtttaaattttgtttgcagtctctaggcttgtttctcttacttcacaaagtagggatgggatctctgagttttatagaagtctgcagataagttaaaaataaagttagatgcaacctttgagtcatttctccaggaaaactgattattctttcattttgttgcaagaaaggatattcaagctatttgctaagaccaagtctattttttcagcaaaaatatatatttttgctaaaacatggccaagaggaggcttcaaacatataaaatcaatatggcagaacaaagctggtttcaaacatacatacatacatacatacaacttattctgtgaccttgagctagttacttcatctcagtgtctatgtgattcttcatctagaaaacaaggataataataatacttatctatctatatagatatatgtatgtatatatatgtgtgtatatatatatacacatacgtgtgagtgtgtgtgtgtgtgtgtgtgtgtatgtgtgtttgaagccagcttggttcggccatatttattttcagacgtaagtatcacctaatagttagccatgttgattttcattattataggtttctaattgaggagctattatggtctacgtataaagggataaatatgcacaatatgggttaacacaactgaactgcaaaattacaaatttactaccattttgtatttttatgcattcattagggaattaatgtaatataggtgactaaatattagagttagaaacagtaaaatagagttttcttcacgtaagtacaaattaagtcaaatctcacctgccttacaagttcaagggcaagaacttttacctcctgcctctgaaattttctgaaaatattcttgcagattgttcaacatttattcagcaaatatatactgagattctatgtccctggcaccattgtggattctgggactacaacagtgaactaaacaagcaagcatcttcactctcctataaattatattccagtggatggagatagataataaaagctgcatctgccatataataaatgctatatagaaagataaagcaggagagaaacgtatcaataatggggtgataagaataaggcaattttatatacagcacctaggggaaaaattactgagaaagtgacatttgagagtagacttcatgggagtaggggagcgaatcatatatggagaagagagttattcaaatacttactgcaaaggccaagttagaacatatctggccttctacaggaggagtagggtggtcaatgtgaccacagaagagtgatagaaatttaagagatgaggacagtaagatgaaaaacatacagagcattatggacctttataaggacttaattacttggagtaaagaaccagtggaaagttttggaaaggggacttacataatttggcttctttacaaatatctcttccttacattttcacttaattaataccttacctgaaaatacacttgtaggatgaaattatccttcctataaacattagaggcatcattgaccccaaccatgcaacattgcatgactctgaattttttttttgtaggtgacatttttaactctctgtaatttttgacgtatctttatctttatattttacaaagatttgttgtccaaatgaatgtcttttttccaaaacacctgttcatgtagctgaagattctgatctttttgtgtcccattgaaaatgccattatttgtttatttctctttttatttattctttattatctcataattgttaacacttctgttacatgaattgatgggatttctctatttcccatgcctcttaatttttaattttataatttctacatatttatctttttctgcactacagactatctgagttagaattctgtagcggccaacttaatttgctctgtgaccttgagctagttacttcatctcagtgtgtatgtgattcttcgtctagaaaacaaggataacattaatacctacattagaagagtgttgtcgggtttacatactttatagagactgacaaattaatgtaggctatctttcaggtcactaattcagtattcagtcttcttcagtctattattgagcagatcttttgaatttctaaaaagttaagacaattataatttcaatttccaaggatattttctactttttgatttattctttctatatagcatgctattccttttttccatatatgcaatatgctatcaaatatcatgaggaaaacaattagaaaaatgtgaagttcttttcttcaccaaattaattttttttctgtttcctccagagtctgccattctatttctatttcctggtattttcagttttgccattttttttttctttaaatgccttaagatgctcagttgtcattccatatttatggatgaagaatgtagcttcttaacatatagatggctggctctgggggaatcttatgtatggtggaagtctttttctcctgatatcatccttttgggtgggaagaatcactgcagggtctacatcaccaggcagagatgttgacaagcaggcttcctcttagggtccacgggcaagggacaggcaggcagaccagccaattgccaacctaacatcccttttggacagtgttacctttccctgtttgtgtaatccttttatatcatttgcagaagtccagagttcccttagcctctattcctcttcttacttcagctcctaagcacatacaaggagccctccccagacagatcagcgcttctctgggagatttctcgggctttaactcaattgctttgtgtacaactgctatagtcggaatgtttttgtccctcacattcatatgttgaaatctcacccctcaagctgagagtatgaggaggtggggactttgggagggttaagacctcacgattgtgattagtgcctttataaaagagacaccacagagatcccttgccccttctgccatgtgaagacagggctggaagggactgtctatgaacagcccttccacgtggaagcaggcctccacaagacgctgaatctgctgtcaccttgatcttgaacttcccaggcttcagaactctgagaaataaatttatgttgtttataagccactcacactatagtattttattatagtggcccaaacaggcaaagccaatgtctaaagtaaaggggagatctgactaacccaatccaccctttatttaatttatttaatgaatttgaaagttctgtaatgcttttttaaaaacaacattgcttacctcccactttgaaggcaatttgttctgttctggtatctctttcagccatttccatccatatccatgttctcgagatttgaacttggcccttgattcccattcttaagaatatgttgtatgccatttcagtgaattgaggaagcagtaatgggatgaagaatcttgtgttttgtccaacatttgggtcaaagtcaaatccatgacttttaatttgtacttcctgtgcttttcgccctagatactgtttctgaatatgcactaagtatatttctgaatatggactagttacaaataaaacctaacataataatttgtaatatagtatggtacataatatcaagaaattcccttccttcttgtattagatttccccagagaaacagaaccaataggaaatgattgatagatagataaatagatacacacatacatacatacatacatacatacatacatacatacatacacacatagataaagacatatgagaggagatttgttaggggaattggctcacacaatagtggagaggtcttgcaacaggccatctacaagctagagaaccaggaacgttggtagagtggctcagtccaagcccaacggcctcagaactgtggaagccactgctgtcgttctcaggccaaaggtctatgaacctggcaggctgctgtgcaagtcctggagttaaaaagtaggaggaactcaagttctgatatctgagggcaagagaagacgggtgtcccatctttagaagagagagagagaattcaccttttctgttctatctgggtgctcagcttattagatggtgcctgccaacattggaggagggtggatcttcctcactcagtctactgatttaaatgccaatctcttccagaaataccctcacagacatacctagaaataacactttatcagctatctgagtatcccttaatctagtaaagttgacacctaaaattaaccatcacacttaccttcctatagagtttgacctttccaactctaagccgaatgtgctggattgctctagagggaactctatgatgacaacaatagagttaactcattagctcctaaattaaaggactctttttctcctcagtccagaccctcttcttccctagtagaatatgagacagaattgctttgctggaatttgtccccagatatacctaagggtataggaaattgagattgggttggaagctggagagagaagagaacttttgagaatagtgtgtgggaagcaaaagtgagatgttagacttccctgttcccaccatggggatatgtgttcaacatgtctccctatcacacttcagaatttcagctaacaatgaagattagcatccagtttcctgactaaaattttcctggttgcaggaccccttgatccattctcaattctaaaaattgtagccctgaagtggcattaaaacattcatcacaagcccaccaaaacactttgtatttattatttctcttatttagacttccaaaccaaattatgtcttcgtatattttaggcaatcaataaatattaatttattcaatactagagggaaaaggatgtcacagaactgtggaatcatttcctgcttattgtcctttctttaatcaccaagtgagggtgcggtggtctggctatttctctaagtttgaaatgacaaatttagcttcaattccgatttctattcagtaactgagtgacttgggacatatcatttgacttttcggtgtcttgcttttctctaaaaatgaggataaaatataaattactcaaagtatactcagtttgatgtacaaaacatagctggatcttggtgagtattcaaataaaaaattatctttccctccttgccttttttgcaccacaaaaatccaggtttattccaaaatatactaacctcttatttaggtgtgattcgtcttttaaaaaattctggatattgagaacaacttgggtgcaagatagcattacacaactgtaaatgttaaaactatactacatgaatgttcccgtgacctgggaatttgtatgaggtgggaccaacagagcaaagctacagccaagataatagttttttttttgttttttttttctggcatggcatttggacatagatgtctttaaaggtctccttcgtacataccccacaaagagacactaaagccatctctctcgagagaaaagaaatgaaatgttaagagtcagtatgatatgttcacatatggacagattcttcattttgtaaaaaaatatatagttactctctttgcagtgagaaattgtagatgggctgtacccaatctgcgaaaggtgccggctgactgtgaactgtctatacctattatcagtatttaggacacctcatcttcttatgttcactgtcacctgtctactcataagagagtatctaagatctatccctttatttgaaagtcaagtgtatttctgtgtctttgccacatcaattttacttaaagacttaattccccaaagccagaatgacaaaatccacagtttagagtcatttcttaaaatgtaaagcctcagtttaattgaagaaagctgttaggggatcttgtggtctgtgacttgaagacaattatttttctgtaacagtaatatcaataacttaaaatgttgcttctctgcctgtaatacatagtaactgtaatcatagcctttctactgaggtctttttctgccatctgataaatcatacagtagatataaactcaccccactccaaaagaaaagaaaacaactccaagaatcatcgatccaggctcaaagccaagcaatctatttttagtactttctcaacgagccacacaataaaaatgtaaatgaaatggtactattttctcttcagactctttttcaaaatgtaggtttagctttgttaaactgactattttcagaccatcttcaaggaacttggttattccagtctagggactttcatatcccaatttcacattaactataattcccatgttccttataactttaaaataatttgcctgaatgaaaacctaaggatcaacttagatatattgaatgtcttctcacttcaagttgcagaattagcactgagacaattgggtctcatctaagtcttcaggcaaccgatagaccagttcgtttcaagttataagtcctttccccatgtggtacgcattttagtaagcctttcttagggtaagtgatttacttttctgaaatatcactagaatgtaaattgcttttgatacttacgaacagtagccatgttttaaccctctacactcaccttcacagcttaatgaggtgggcattactattatcttctttagacacatatgttcatttgaaatgcagaagccaagtaacttggccaaaccacacaattagtgtgtaaggtagcaaaaacttcagctactcactagtagagagaaggaattctgggtatgtgcatggaattaaattaatgcctatggaatgcactggagctttttaaaattgcagatgatgcacatgaaataaaaacagaaaagtgaaagacagaataaggaagttagagaagagcatcaaagaaagaataggaattaagatgaagaacaaaataaggtcaagtgaagaaattagtgacaaataaggagaaaagagtttaaaagagcttaaaaaaacataagaacattggaagaagagggtgttacatagaaaagtcataagaaaacattgactttcttaagtcaatggactgggaagaatatcacaaattgaaaatataaaattaaaacgtttcattcttaaaatcgctacacatatgctattacattattgcttcccaggttacacacactgtaatctcatcatcccagccttgggatgctgttctatgtgaatcaacatcagacactagttcaggtcaggtgtaaatgatgtaatttcactgaactacagctgttgatgaactaatcattgagtctttacattgcacaaaatagaaaaagaattgtgttgtatgaattctttttagtgcagaaatgtagtatcagtcctctcctggaatatctttcctagactctgtttcattaccttttccctttccagtaaataacctacactaattgtttataaccaacttttatagaatctagttggctaccgaaatactggaaaatcccttgtcctagtccattcaggttgctataacaaaatattataaactgggtaacttggaaaaaacagaaatgtattcctcacggttctggaggctgagaagtccaagatcaaagagccaacagattcagtgtctagtgagggctactttcctgatggtgtcttcttgctctgtcctcacatggtggaaaggaagaatgagctcatttgggcctcttttgaaagggcactgatcccaattacaacatctccatcctcaagacctagtcacctttcaaaggttccacctcctaaaaattatcacggtggccattaggattttaacatatgaattttgggattatataagtattcagactatagcagctgtatttcattcttttaatgcattgtcttggctatcttagtatgcccagttctgaacacattttcacccaaatcatatttgtcagcccccatgcaattatccctcactgacactagtattcttccaagaaagaggaggatgctattttgaattgactaaagtagatttggaagcccctcaactgggcttccaaatctactttagtcaattcaaaatagaaattcagccccccgactgggctccttttttttcctctgtttctttattttggattaaagcttttttattgtcttttttaactacactggttttagtagttatgcattgtgtttcttggggttttttctaagtatttaaccattattattaagttgtaaacttgatttaacaaattccaatgtggatcagtatctcagcttttttcttgaatgacacaatgatttcagctctttaatgcctgtcattatgccctcctggcatatgtaaatgatatttgaaagatatatcctttagtggttcttccacctagcaaatcctaccagaggcctctctgaacatgtttttatttgatgttcgctattcaaatgatgaaagacataggggtttttgctaacttttcctcaaattttaattactttttataagaaaatctccaaatgaaagttaagaaccactaaaacagaataatacctttaaaagaagacatgaacttcaaatgttggaatatagccattaattatttcagtattaaaatctagtataagttagcttgaaataaaaaaagaatgttcaactcaataccctttcagtataagatatttaattagaaatcatgaaattattgcagaagtcaaagcaagtcatgaaagctaatattggaaattgtcttcaactaaaacgggatcaagaaatgacactgaaaattcccagtatgtctaacaccaaacaatattgaagaaagtaacttaggtttgaatacaagtccatggtatgtaatttcaatgagtacagtttctatgtgtgtctccacagttaaagcacaaggatttttttttctttctttctgagacctatctcaagtttttggggttcacactgcttctagtcatccaccttgaatgcccaatcttgaaatggttttaattgcatcgaaaatgggggatacaacagtttcaagtggcaaatactgtatactaaatactataaatactatatactataaaatgagctatttatttaaattttataacaagtacattttaactgccttcgttttttatttttttaataatactttaagttctgggatacatgtgccaaacatgcaggtttgttacataggtatatgtatgccatggtggtttgctacacccatcgacctgttatctacattaggtatttctcctaatgctatccctcccctagccccccaccccctgacaggcccttttgtgagatgttcccctccctgtgtccatgttttctcattgttcatctcccacttatgacagagaacaagcagtgtttggttttctgtttctgtgttagtttgctgagaatgatggtttacagtttcatccatgtccctgcaaaggacatgaactcatccgtttttatggctgcatagtattccatggcgtatatgtgccatattttctttatccagtctatcattgatgagcatttggattggttccaagcctttgctattgtgaacagtgctgcaataaacatacgagtgtatgtgtctttatagtagaatggtttataatcctttgggtatatacccagcaatgggattgctgggtcaaatggtatttctgattctagatctttgaggaatcgccacactgtcctccataatggttgaactaatttacactcccatcaacagtgtaaaagcgttcctatttccacatcttctccagcatctgttgtttcctgactttttaatgattgccattctaactggcatgagatagtatctcattgtggttttgatttgcatttctcttatgaccagtgatgatgagcttttctccatatgtttgttggccacataaatgttttattttgagaagtatctgttcatatttttcatccactttttgatgaggttgtttgtttttttcttgtaaatttgtttaatttccttgtggcttctggatatcagccctttgtcagatggatagattgcaaaaattttctcccattctgtaggctgcctgtccactctaatgatagtttattttgctgtgcagaagctctttagtttaattagatccgatttgtctattttggcttttgttgccattgcttttggagttttagtcataaagtctttccccatgcctgtgtcatgaatggcattgccttggttttcttctagggtttttatggttttaggtcttatgtttaagtctttaatacaccttgagttaatttttgtataaggagtaaagaaggggttcagtttcagttttctgcatatggctagccagttttctagacaccatttattaaatcgggaatcctttccccattgcttgtttttgtcaggtttatcaaatataagatagttatagatgtgtggtgttatttctgagggctctgttctgttccattggtctatatatctgttttggtaccagtaccatgctgttttggttactgttgccttgtggtataatttgaagtcaggtagcatgatgcctccagctttgttcttttttcttagcattgtcttagctatgcaggctcttttttggttccatatgaaatttaaagtagtttttctaattctgtgaagaaagtcaatggtagcttgatgggatcacattgaatctataaattactttgggcagtatggccattttcatgatattgattctttctatccatgagcatggaatgtttttccatttatttgtgtcctctcttatttcctggagcagtggtttgtagctctccctgagaaggtccttcacatcccttgtaagttgtattactaggtattttattttctttgtagcaatcgtgaatgggagttcactcatgatttggctgaagaagttgaatccctgaacagaccaataataaattctgacattgaggcagtaattaatagcctaccaaccaaaaaacacccatgaccagatggattcacagccaaattctaccagaggtacaaagaagagctggtaccattccttctgaaactattccaaacaatagaaacatagggactcctccctaactcactttatgtggccagcatcatcctgataacgaaacccggcagagacacaacaaaaaaagaaaatttctttttttttcttattatttttattttaaagttttgggggaacaggtggtgtttggttgcatgaaaaagttcattcatagtgatttctgagattttgatgcgcccatcacccaagcagtgtactgtacccaatatgtggtcttttatccctcacctccatcccaccctttccctgcaagtctccaaagtccaccatatcattcttatgcctttacatcttcatagtttagctccctcttataagtgagatcataagatgttttgttttccattgctgaattacttcatttagaattatgttctccatctccatccaggttgttgcaaatgccattattttgctgctttttatgtccgagtagtattccatggtatacatatacctcattttctttatccattcattggttgatgagcattttggctggtttcatacttttgcaattgtgaattgcagcacaaggatttaaatgggactctgagaattggtcctcttgaatatgctttaaataaacactctctctacaaaccatccactccattcttcctccctttttagtcaccatttatgccctctaccctcgtccaccaattcaattcttaacctttactgagggttcagggtaaatcctattttctccaggaagcatttcctcatcattgtaacttcctgtatcttttagagcactgattgtttacactggccaccacacattacattgttgtctcagctaacttgtgtattgttttgccaattgcactgtgaaaacatatttgggattgggaaccatagcttttacttccctgtaatccccatagcacttcatatctcatattgcagaaatgattcttactacctttcttagttcagtagtaaaagttaggcagtttggaaagagtacaggatggtacaagaaattgaaaggatggtttctgcctcatgaacttagtaaggttctctactacttcataaagttactgatgctttatgaagcggaaacatatatatatatatgaaccctcaattagagaaccttaggtgtgtgtatgtatatatacatgtatatatgtatggtgtgtgtgtatatatatatacctaaaataattggagaataatttcaacattatatgcaatacatgaataaagggaaatatggaaatataagctagatggctatgtttcaaaaggaattgaagagcaacatctccatagaatacagtaagttaaagaaggttgattacataggttttcatatgcattttttctaaatataagtgtcatttgtggtataaaacaaactctgttttagtgttttttattattttctggaaatataatgtattttcacattattttctgaggggtataaatttcaatacattgagcatttcatttaaaagggaccctgatgtactctatagagacatgaagaattagctacccaaatggatgttaaaataataaaaagaagcttttaaaattccaaataagtaccagagctgattatgctaagtagtgagttcattgtccattatagacttcttatcttctattttcttctagaagcagcctaacagatgtaagtactattcagcaaaaatcacaactactttttttttttttagtggagattttgatgcattacagcaagcctctttaaatacagtgtttacagattttcacctggtgacgttggtttcaatagagtccattaagatgtcctctataagctaatttaatgccaagaaaaatgtagttacctttgtaaaaaccatgttctcttaattcatcagaataaatgtactgtcgtagtaagccagggaaaaagctatacatgcattaatttctatgtatgattttttaagtacaggcaacatggcatttatactttttatttcattattaagaaaaattttgtctcagctcaaaaaagccggcaagttaaactcattaattattaggaatttgcagtttcctgcatctaaatcataccaaaggaccaatttcaactcttaacttggaaaattcagcaacttatgttttttgacttatggttatcaaaagcctgcctgaaaataaaaggttcataatatccaggaaaacagactatagggattatcaggagaacaagaaaaaaatgccaagtgttgaatttggaaaagtcgtaacaagttagtctgtagccataaacagaaagtaaaacagaaaatgctccctctacaaaagattccctgtgtgattgaaatgaaatccaaggaaatgtacgaagacataactttgatttagccttcaccagggaaggtagaaaatctcaggaaccaaaattaaataacttgtgatatctctttcctaggacactctttactgaaaagcagtagtgtcagaaatatacccctagtatgaatatatgtatatgtacatatataaacttgtgtttatgtatgtgggtgtggacatacatatgtaggcatggctgtgtgtgtatatactcaaatatatgtatgtagttgtaaataggatgcaaactatagtagccataaaaaaatttagaacttaagaaatgtcatcctaaataaaacattggtttatctctctcatattctatatgtaatgctggcaccaaaaaataatttctgagaagcacagttataatccatgatgataacctcaaaaaaatgaaagaatgtatacttacaacttttctctataaatgtagcacttaaaatgtaaataagctcttctttatatgtggagcagcctgtgctaaatgctactgatgctttatgaagcagaaacatacatcctactacactgaagagtaatgagtttcttttatttaatattaaattcatcatctgcttctatatgtctatatatttggcattatataaacaatcgattttcttctaaaaatcgccttcatggttgtttttctttggtgattctcaacccaccatttttttttcttcttcaaaatggagaattcacattttcttcactctttaacttttttcctttgatcattttagttcctttgctttgaaacttctttatttcctttagtagccatagccatatttagagccaaggacttccagtaacagtttatttttatgcatatctagatagaagagaaaatttatctttctactttgaatagcgccccactttttgtggcactttctgtttgtataaacacattacctacattgaatacataatattttctacagggtcagtgatgtcattgagtacagaaccgatttcaatccctcactggtggtttcctcctttttaaaaatcgtatctttttccaatagaaaatatctttttacttctcatcccaccgatgcagtggtgtttcttttcttttctttcttttttttttttttttttttaatggtaagatctttttgagcctcaaatgtgaaattaaaatagatgaccagtgtggtttcttataactcctgcattttgtgagtttcaacgtggaatcttaatgcaaacatttataaccatccaaagttatttcctcttgtctttatgcagacttgatttactctcgaaaaacagttaccttttgcccagtaggttatatttgaatactttttcagtgatgttattccttgctaaatacccccatcagttcacaaaatgataaagtaaacctatgaacttaacattttctgtgttttttttttggatcatctggatggaccagctgatgctgtggcaaatcaaacacacacacgcaaaaacaaatcaatcagaagcttaaaagagtagtttccgaaacaagagagttcactatattagttactgtaagaaatagccccttgtccaggcatggtggctcatgcctgtaatcccaacactttggaaagcttaggtgggcagatcacaaggtcaggagttcaagagcatcctggccaatatgatgaaaccccatctctactaaaaatacaaaaattagccgggcatggtggctggctcctgtagtcccagctactcgagaggctgaggtaggagaatcacttgaacccgggaagctgaggatgcagtgggccaagatcacaccactgtactccagcctgggcgacagagcaagactctgtctcaaaaacaagaaaaaaagaattagccccttaaaggtgtacgatgcctaaacacaatagatacctttctctgcctcatgttaacagaacaaataggtgaaatgtttggcagaatggccttcttccgtgctgtcattcagcaactcagttgataaacatattgacacctttagtatgtcttcagttgttgccttggggtcaggcccatttcaggcaacagaaagtacagaataacatggaagagcaaatgtgggagattttaattattcagacctagaaacggtacccatcatttccatggacattctgttgttaaaactgtatcacacaaaactattcttaacttcaagaaagaagcctggaatatatggcttactgtgttcccaggaagaagaaaaaaattttggagactagctggcagtctctgccacatccactttattcaacaatactgttccagcatcagaaaaatgttgtaggaagacactagctacaggcagtgtgtggttaactatttcagggtcttcagtgttgccaaagtatattcagctgccaattcccaagctgttttgtggctcaggcatagctatgtaatgactctgacatggtaccatcattttatcataacaggttactgataaacctcagtggcagccagtgttcaagtgttcaccatagaaatgtaccaaaacaaaagtgagatttaaaataaaccttaataaccctcatgctcaacatacccattttcaagtcatttgattctttcataaattattttcttggaaaaggaaattggctcaatgtcaggttctttggtggttaaaatgaattatcaggtacaataaatgcttctttattggaggtgctatttttttctttcctgaattttaaattaatgagatttacaatattaagtttataaaatgctaggttaatgaattataatgagaaataagagtatttcattgtaacgctgccgttgatactaaaaagaacagctaaatgaagaaattcacatcataattcaaataactaagggaagcaaaggttataaaaggaataatttaatgtgagaaaaattgctttatgcctgtcaaaagactctagaggaagatattatttgacttttaaagttagctagtgcatgactctattcagagtaagtagatcctggtttttgtgtttaccctaagcccaagaatttctatttaaaaactgaccagtactgagataaattactcacatgagataatctctatgttgagtgtcagctcatgagttgttcaactctattttcataccccttcaccctaccacctccctagaccaggtacctggtcgcacttgatagtccggagctttcccaaggtagcgctttaccggggctgcccttttagctggtccagtgctgctaatctcagctcacccattttcctctcctgctttcaatgttcatctagcctggcagcagtcccataaggacttgtcccctcatgcacttaaatgccaataaatgcctgtgtgactcactgatattcagactggttggttccttagtaccctgttagtacaaaaagtaactgctgatacaggaatttcaggcattctgctctcagtgagagatgttattgtgggtgtatagtcattgtttctcaaataaagacatgtatctgttgggtaaagttgcattttatgtgaggaatggtttatgtttattcttacattattaatgcaatggaattatttatatacataaacttatatatagaaaatgcagaaaaggagataactatagcaaccattttttactattatgtggcattcacctctccaagtactttatatattccctaaattaatcctcccaaaacctgtttatggattttcacctttgtttgacaaatggggagataggtttttaaagttatgtaaattgtacaagcttacccaaccagtaagtgggaaatacacttggaacacagatctgtctgttgtcttaaccacaactagtgtatcctgactaaaatacatatttttgcttcaactctcaatataaagtgaataagtaagaatatttttctattttgaaggtaatttagaagtcaccttatctaaagcaattattttaataagacctatagaaattaaatgctcttacttcaagatagtctaattgctgaacagcatagcacacactagaactagagtctgtattcttgtctgccacttcctacactgtagcctagataattcactgaatattccatttagaaaaaaaatctcttacaaaacttgtcatttcagcatcttagatgcaagcatagcatcttggaaaacttggaaaaattctaagattaatagcaatatactaattgacaatattatattggtaagtttactctgaattcaaaagtctctaataactgatatataaggttaaatatgacagttcatgggaattgtcactgaaatcagcttttcaagaagagcacaggaaagaacaaacaaagaaaaaaattgcaatcttatatgatatacaatgacatgtatagaaccataagtcattttgttaagtgaaataagccaggcacagaaagacaaacttcacgtgttctcatttatttgtggaagctaaaaattaaaacaattgaactcatgaaggtagagagtagaatgatgattactagaagctgggagagctgggagaggtggtggtgggcgccaggaggaagtggggtggttaatgggtataaaaatataattggatagaatgaataagatctagcatttaatcgcaaaacaggatgactattgtcaataataatttaattgcacatttaaaaaataactaaaaatatagttgaatcatttgtaacacaaaagataaatgtttgaggtgatggataccccatctaccctaatgagattattacacatggtatgcctatatcataatattttgtgtaacccataaatatacaaatctactatgtacccacaaaaaataaaaatcaaaaaaagagaaagatatgaacaagaattcctagatagagttaagagtaattcatttcacttattcattcatttactcactcaacaatcatttaataataacctgcttgattccaggcactgttttaggtatagcaataaacaaaatagacacaaatctctcccctaatggagctttcaagggggaaggggagagtaataagcaggacaaataagtaaaatatacaatatttggatagtaaatgctaaggagaaaaaaaatgaagtgaaagaaagaagacaggaagtcagtttggggcagggatatttctttctttttttttggggggggcggtggggacggagtcttgctctgtcgcccaggctggagtgcagtggcgccatctcggctcactgcaagctccgcctcctgggttctcggcattctcctgcctcagcctcccgagtagctgggactacaggagcccgccaccatgcccggctaattttttgtatttttagtagtgacggggtttcaccgtgttagccaggattgtctcgatctgctgacctcgtgatccacccgcctcggcctcccaaagtgctgggattacaggcatgagccactgcgcccggccggggcagggatatttcataagggtggccaaagaatgcctcactgagaaggtgattcttgagtaaatagttaacagaaatgagaaagcaagccatacagttatctagagagagaaagcattccagttggtgcaaaggctgttttggagggtacctagtgggtatgaggaaatatgaagaggtcagagtgacctggagagcagtaggaagccaagtagaagggggaagtgggaagcaggcagtccatgtggaaccgtgaagatcatcataaagatctaagtttctactttggatgaatagtctgggaggaactttgttaactgatgtcatgggggaagataggctgtggaatttctgaaattaagaaatttagaaattagtgtattttagttatgaccaagttcaagtgctccattttaagataagaaaataaaagcacagggcagctgagatttgcctatatgaagctagtaagaagcagggttgggactagaagctaaatcttaactgaattacatacattgtctcaaagggtcacagacatggctcaggatggattatatcttagctgtaagaagaccagaaattaatattgatgagtttagaatcataaatcctaagatgagcaatcattaacaaaatgatgggggaaaatggaattgtctaacattatactttgatcttaactttggcactttttaaaaatataatatctttagttagagtatgttccacaggaagatttcaagtggttaaaccgacctgttccttcatttaaaaatataatatctttagttagagtacgttccacaggaagatttcaagtggttaaaccgacctgttccttcattttctttttggaggttaatttagaatagtctcaaaaattggtttggggacctacaatggtcctctgtgatttgcataataaaagtatatctgtcttttgtgtacagttgtatatgagtgtatgtgcgtaggaagggcttcatgcatggccatttagtttagttggttaaggcttgaagctaattaagttgaaagcatgaggtcttccctatatggacttgtaccttggccctaacaggtgcagaatacatcccacaccctgaccagctgtcttgcaaattcatgtttttggttataaggtcaaggccacacaagcctatcgctgaggatgaaaaagattgctcaaagcatataccatattgatagtatgtcagctgcatccttttaatacatgggcaacccgctgattagtcttgaactggtgtaaggctggttgcttctctggctcatgacaacaaaggcagatgaacagcagttttgtttctcaatgtgaatgtctcctcatgtctgtgaggggtctctgctgagagttcctctcagtaggtctcttcgtatgggagtatgtacatattctaaacttagatctgatcaaataagattgcaatttttttctttgttatactgctttcctttcttaggggtatatgcccaggagtggaattgctggatcatatggtacctcttccaaactgttctccatagtggttatactaatttacactcccaccaacagtggatgaaggttgccttttctccacatcctagccagcatttgttattgcctgtcttttggataagagatattttacgtggggtgagatgatatctcattgtagttttgctttgcatttctctgatgatcaatgatattgagcaccttttcatataccagtttgccatttgtacgtcttgttttgagaaatatctatttaggtgttttgctcattttaattgaattcacagattttttttttcctttagagttgtttgagctccttatatattctggttattgatctcttgtcagatggatagtttgaaaatattttctctcattctttgggttgtctcttcactttactagttgtttactttgctgtgcagctttttaacttgatgtaatctcatttgtacatgtttactttggctgcttgttcttgtagagtattactcaagaaatctttgcccaaagaaatgtccccagagattttcctcacagtttttctgtagtagtttcagtttgaagtcttagatataagactttcattcattttgatttgatatttgtatatgccaagagacaggggtgtagtttcattcttctgcatatggatatccggctttcttagcaccatttattgaagagattgttttttctgcaatgtatattcttggcacctttgtggtaaatgagttcactatagttgtatggatttttttctgggttctctattcttctccattggtttatgtgtctgttttaataccagtaccatgcttttttggttactatagctccgtagtataatttgaagtcaggtaatgtgattcctccagttttattctttctgctcaggacagctttgactattctgggtcttttgtggatccatatacatttcaggattgtttttctatttctgtgaagaatgtcattggtattttaaaatggattgcactgaatttgtagattgctttgggtaacatggatattttaacaatattgattcttccaatccatgaacacagaatacctttcctttttgtgtgtgtcctcttaaatttccttcatcaatgttttatagttttcattattgaaattatttgcttctttggttaattcctaagtatttaattttatttgtagctactgtgtagactaattttagctattgtaagtgaaattactttttaaatttctttttcagaccatttgctgttggcatatagaagtgctactgattgttgtatgttgattttgtatcctgaaactgaatcctgaatcctgaatttgtttattagttctaatagttttttcatggagtatttagtttttcccaaatataagatcatatcatctgcaaacaaggataatttgactttttcctttccaatttagatgccctttatttatttatcttgtttgattacactagctagaatgtacagtatcatgttaaataactgtggcaaaagtgggcatccttgacatattccagatcttagaaggaaggcttttggcttttccccattcagtatgatcctatccatgggtctgttttaaatgggttttattatgttgaggtatgttccttctgtacccagttattttagggtttttattaagaagactgttgaatattatcagatgattttccagcatcaattgaaatgatcatattatttttatccttgattctgttgatataatgtatcatactgattgatttgcatatgttgaaccatccttacgtccccagaaaaaatcccatttggccataatgaatgatctttttaatgtgttgttgaattcaatttgctagtattttgttgaggatttttgcatcaatgttaatcaggaacattggtctgtagtttgtttgagtgttctttctttctttctttctttctttctttctttctttctttttctttttatatgtcatctttgtctggttttgctatcggggtaatctggcctcatagaatgagtttggaattaccctcacatcctacattgtttggaatagtttgagtaggattgatattagtgttacaggatcctttgggtgtcacttcattagccagcaacctctgtggccagtggcacctttgcccgagttttgcttgcgcccactgggcccactcagcctgacaagcatactcggcttgcacttctggcctggatcccatgcctgccaagcatgtggagcagcaaggagtgtgtgagcaagtgagcatggggtctggttactgtgcatagccaggcatgttggctgcggtagggtgggcagctccaggcactggtatgggtgccggctccctgcaaggctgcagctggacaaggtgtcccacaacagcttccacagctggcactggggaatgtggtggcacctggaagcttggagacgccaggaactgcagagcccccaaaggggtgtcacagccctggctcagggagctcctaggtctggaacacctgaagggctgcagctcttctctcttctctccttttcattgcctgcaatgtggtaagcaaggggcgtgtttcagctccttttgtgttacagctctttcagccctggcattcagtgggtcccaagttattgtcccatgtccaggaagaatgagatatgtagagaagtggaggataagaaagatgaagagtagctttattgagtgatagagcagctcagaggagaccttcagtgggtagctcctctctgctgacagggtatcactgggataccctggctgcagagaggagaccctggagtcggtagctcctctctgcagctggtcatcctgacatctgcttagctctcagcagagaggagaccctggagtggttagctcctctctgcagctgttcatcccgacctctcttcatgtctggctgagtctggggttttatgcacttcagaagggaggaagtgtgtgcttatttgttcatgcgcaggaatgggtggacctgggaaaagcactataagttcccactccagtccacgggattaccagcccagcctccaggctttaggccttccccagcttgaaagtagggcttcaccagggaccctcccttttctgcccaaaagcctacttgcctcgtaccactttttatggtgcccaggctgttagtgctaagggtcacctgcaggtgagtgccaagctgccctcagccctcccctcagctttacccccatgctcatcagcacccaaagtctggaggggtctaaattgggaggaggctggcatgtcagtgctgccctaagcatgagtacacctggccaggttgtgacagtgcccaggcttggcttcaactttgctcaaagatcagagtgagcactgggaatggggagaatccagacagaggaaacaggcacttctgagcctgagaaggcagaaggccttcctgggtctctgagagtgcagagatgcctgggtccacagccatggctgggtggctgcagctgcacctcagagggtggggctcctgcctgctcccagctcccaagagcacaatgatgcctaggtctgcagctgcagctgggtggccacagacacacctggggaacaagaggcttttgccctgacaactctgaagggggcaggacttccacctgttcccagctaccactggctccttggagtgcacggccctggctatgcctcccacactgcagccagcatcatggcagtggccactctagataggctgcagctgtgatcattaattctttaaatgtttgctagaattcagtagtgaagctgtcaagtcctgggctttttattgctggaagactttttactatcgcttcaatctcattacttctttttttttttttttttttttggtcttttcaggttttggacctcttcatggtttaatattggtaaattgtatatgtctaggaatttgtccatttcttctaggtttgccaattcgttcatatatagttgccgacagtagcctgtaatgatcctttgaatttctgcttatcagtggtaatgtctcctttatcatttctgattttatttatttgggtatctctcatttgttcttagtctggcaaaaggtttttttatcttttattaaaaaaacactttttgttgcatttatcttttgtgttgttttctttctaccaattttattgatttcagctctgatctttattatttcttttcttctactaattttggatttggtttgctctagcttttctaattctttaagatgcatcattaggttgttcaattgatgtttttctacctttttgaggtatgcacttgtagctataaaattccctcttagtactgatttcactgtatcccataggtcttggtatgttttgcttccattatcatttgtttcaagatatatttcagtttccttcttaaattttttattacacactggtcattcgggaacatatcattgcatttccatgtttttgtatagtttccaacattcctcttgttatttatttctagtttaattccattgtgatcagagaagacacttcatatgatttaattttttttaatgttccaacactagttttgtggcctaacacatggtctgtccttgggaatgaactacatgcagagaagaagaatgtgcattctgcagctgttggttgaagtgttctgttaatatctattaagtccatttgggctatattgaagctgagtctggtgttttctttgttgattttttgactggatgatgtgtccaacggtgaaaattgggtattgaagtcttcagctattattgtactggggtctatctctcactttagctctaataatatttgttttatatatatggtgatccagtgttcagtgcatacatatgtaaaattgatgtatcttcctattgagttgtaccctttattattatataatgaccttctttgtcttataacttttgtcttgaaatctattttgtttgatacaactactccttctcttttttagtttccattggcatgcaacatctttttccatccctttactttcagtctatttgtgtttttataggtgaagtgtgtctcttgtaggcaaaagatcactgggtcttgttttttatccattcagccactctatgtccttgaattagagagtttagtctatttacgttcaatgttattgataagtaaggacttactcctgctatttgttatttgttttctggttgttttgtggtcctctcttccttctttccttccttcctgtcttccttttaataaatgtgatttttctgatggtattttaaaatgtattactttttattttttgtatatacattgtgtgttttttaatttgaggttaacataagacttgcaataatgtcttataacccattgttttaaactgatgacaacggtgactgcataaacatacaaactaacaagaaagaaaacactaataaaaactctacattttaacttcatgtccctgctttttaactttttattgtttccatttctatcatattgtactgtcttgagaaattgtagttattatttttgattggttcatcctttagtctttctacttaagataagagtaatttacacattgcagttactgtgttgtaagattctgtgtttttctatgtatttattattaccagtgaattttgtaccttcagatgatttcttcctactgatcaatgtccttttcttttatattacaaaactccctttagcatgtattgtaggacatttgtggtgtaaatgaaatccataagcttttctttgtctgggaaagtctttatttcttcttcatgtttgaaggatatttttaccagatatgctattataggttaaaagttttgtttccttcggcaccttaaatatgtcatgccactttctcttggaatgtaaggtttcattgaaaagtcttttgccagacatattggagcttcattgtattttatttgtttattttctcttgtttttaggatcctttctttttccttgacttttgggagtttgattatggtctcaagattgcctaggtatcttgagacaaggtaaatctgtgagatgttctataaccttcttgtagttgaatattgatatttttcactaggattgggaagttctctgttattatccttttgaataaactttctacaccatctctctacttcccctttaaggaaaataactcttaaatttgctcttttggggtgattttctagatcttttaggcatgcctcattcttttctattattttttccttttatttcctctgactgtgtattttcaaacagcctgtcttcaagctcactaattctttcttctgcttggtgaatttttccattagtagactctgatgcattctttagtatgtcagttgcatttttcagctcggaatttctgcttgattctttttaattacttcaatgtctttgttaaataaatctatcatgatcctgaactccttctctgtgttatcttgaatttccaagtttcctcaaaacagctattttgaatgatctgactgaaaggtcccgtatctctgtctctccaggattggtccctggtgccatatttacttcatttagtgtggtcgtgctttactggatggtcttgatgcttgtgaatgttttgtcagtgtctgggcatttgaaaagttaggtattgattgtagccttcacagtcttggcctgtttctgcctgtccttctttggaggggtttccagatatttgaagggacttggatgctgtgacctaagtctgggtcactgcagccttatctgcattagagggcaccccacacagagtaatgctgcggctcttgcagaccaacttggtggtctcgcgtagcatcggagagaattccctgggttattctcttcgctctcttccccttactttcacccaaacagagtctctctctttatctctctctctgtctgtctttctgtgtgtgtgtgtgtgtgtgtgtgtgtgtgtgtgtgtgtgtgtgtgtgtgttgagatccctggagctgagggaggggtgacacaagcacctctgtggccacaaccacggggacttctctgggtcagacctgaagcgaaaacaacagcactgtcttgccaaatgctcactgtaaccactacctgaatactgcctatgttcactcaaggctgtaggactctacaataagcaagtggtgaagccagtcatgtttgtatctttcccttcagggaagcaagttccccaggtcccagttgagtccagagatgtcatcaaggagccagggccatgagtcaggaaccttagaaatctacctggcacgctattatactgtagctgagctgccatgcaaaccacaagacaaagtcctttccactcttccctctctcttttaacaggcagaaaagtctttccccacaaacaccactgccacaggcccacagagagtaattccagtctactgtgaatgttcacttaaggcccaagggctcttcagtcagcttgtggtgtatgcttccaggcctgggactcatctttcaggtcagtgccctacatcctagcccagaacaggtccataaattccattcaagagccaaggcctggaactggggaccccaagaatgcacttggtgctctgcccaattgtggctgagatggtagctaagctgcaagacacatttcccttcacttttacctcttctttccttaaacaaaaggaggctttccttgtacccactatagctggaaatatgctagatcacacttgaagtcagcatatctcacccaaggcccagagtgtgtactacctggttattgctgctgattattcaggacccgagggctctttagcagcaggtgatgaatcctgtcaggacttagtcctttctttcaaagcagcagattaccttctggcacagggtatgtttagaaatgtcctctgggagctagggccaggaatgggggccttacaattttgcccactgcccaatcctattgtggctgagctagcatccaagttgcaaaacaaagtccacattatgctttcttctcatcttctgaagctgaaggaagaagtctcttttggagctgcaagctacactgcctaggtttggggaagggttggtgcaagtactccttagtagccccagctggtgtctcaccaggttgcatgccccaccaagtccactggctccaagcccagcacaccactaggactggcctaggagttgcagttctgtgacctagaatgcctttcaagtttatttagaactctagagccctttatcccagagtgtcgagacttgccagaactcaggttctgactcctgagatgtatgattcccctccggccagtgctaatctcaatgttccttctgtgggcatcagttgagttttgcctggtgttgcttcccactatgacagggttccattgcaaagtcccacaatcactgtgctcccccatccccaagcatacagattctctgaaccacatggttgctgctggagaatgggggagagttggcatcagtcattcaaatctatcttttctgccctcttcagtgcctttttcagtgatttgaagttaaaaccaggcactgtgatcactcatctgatttttggtccttatgaaggacttttttgtgtagatggctgttaaattcagtgctcctgcagacaggacaatcagtggaagcttctatttggccattttgctctgccctgtgattagcagtcctgtccgtatatttctgataccataaatggttttgctatttgtttatattatacagaaagacttgaccaaagctcacaagttgatatggtttggctgtgtcgccatccaaatctcatctttaattttagttcctatagtccccatgtgccatgggagggacccagtgggaggtaatttaatcctgggggtggttattctcatgctgttcttgtgatagtgagttctcacgagatctgatggttttataaggagctttttccccttttgcttggcacttatccttgatgctgccatgtgaagaaggccatatttgcttccccttctgccatgattgtaagtttgctgaggtctccccagccatgctgaactgtgagtcaattaaacctctttcctttataaattacccagtcttagtatgtctctatgtcagcatgagaacagactaatatacaagtacattttatattctttttgggtgaagcaagaagtcttatttctttcaagctctaaatctaatttttatgtttcaaaaatgtatgcatgattccataattagttcctcaaatggaattctcttgtggaagtcattgcttctgtagttttcacacatccagagagaaaccttgaaaatatggtgtttaaattcaggtcccaatgtgactcttcttaatgcaaattgagtatgaatttattagaaatcattagtgggataaatgttctcctattatgtaaatctgtgtctttaatctgaaatgtagaaagcaaattgctttccagaatatctaatctgcgattctgtaattaggtgagcaggtggttaattacaggtgctgttagtgacttgcccctcatcacaagaacacaaatagctaattctatgtgtcccaagtcagtcataagggtagttgtgttggctacacaatttttaaatccacatgtgttaagtgcctaaatacataagtagaactgagtatatgctactgttttataaatataaaagttgatccatcacaaaggatgcacatttaagaaaatttttagtggcatttttcattaattttatatactactttacaacagtctttggttgaatgtccaaaaagcagatgaaagaaattgtatttatgtatatttttatgctgtactgtaatagtatgtgaaatgtctaaataaattgtaaaagaggttacttatatcgctatgactaaattgaggatcctggaactgcattgatgtactcagtttatgatctcacttattttctagtaactgtttaagtcatagtgttaaggaaatgattacaaaacatgtgcaggtgctaagcttagagtcataagcaataacatgtagctatagaagttaatttcacatgaagcgtccacccagatattaaaaggactatatttaaaatgtaggaaacctatgaaaccctgcatgcaaaacaattggatttttaattttaaaatctgttaaaaagtaagaaaagtttttagagaacatagtattagggcagagattaacccatggcagaaaaaaagagaactataaagttgttcttaaaaactcatgaagcccccgcaccacccttcttcctgcttctaaacacatacctttgagatccagggagttgtattgttgtctctttttcaagcttgataatgtcaatgacttttaaagatatacaagcaaatggaataacaaaggataaaagaggtttggggaaaacctgagaagcattgtagagtaataggctaaaactaaatggagaataataaggggttgacatttttgacctccaaaatgctataagtccctttcacagaaatgggtagttctttttcaacaaggtatgacagcatagccttggtcctaaagaaaagttcatcaagcttaatattatggccataaacaaatgtgggaaatttcaaatgggatccatcaggtaaagatcatttacctctgaaacctcttccccctaaaaaagtttcatattaatatttggtaagagcctaattactttagaaacataagagtaacctgtaatcccagcactttgggaggccaaggcgggcggatcacgaggtcaggagatcgagaccatgctggctaacacggtgaaaccccatctctactaaaaatacaaaaaattagccaggcatggtggcatgtgcctgtagtcccagctactcgggaggctgaggcaggagaatggtgtgaacccgggaggcagagcctgcagtgagccgagattgcaccactgcactccagccagggcgacagagtgagactctgtctcaaaaaaaaagaaacataagaataaaagtggaacttgcataattttaatatatcaaaatgagttgaaatgatgcaataatgaacctgactcttgaaaccacacttcaaaactggtatttcgtgactttatagtcaatttctatatatgcacttcctctgcccacaatttcagcttatatattgtctccatcacagatcaatgtcagtgttttaggagggatcgtagttcccatgtgatgatgaaagatttgctttgataatcaataattgcagtaggagacataatttgccctggcttttgactcttaaatctatcttcactttcactaccagaatattttatcttttggttgtttcccacctcctcattagatagagtgcagatttctcagcataatttatgaagccctccatgatccagcctcatcttgcatcattttctctttaccttctgtacctctgccttgtcattacggtagtcaaccatttgcaattttcccaacacaccacactgatttgcaccttcctcttttttgttccatctgcctagaataattttgttcatatacttcctcctttgcctggcaaattcagatcacatctccagtctctgccttccgttttcccagagcaccctttacctcccacatagcacatggtaatgagcttgtgttagtgtcagtccctctgctaacgtataggtctaatggtcaagattttccccttcaacttgatttccccagtcttcacacaatgcctaccccatagtagatgctgattgtctattgagttgcatagtataccttagtctgcacaatatatttatttatccattcatctatctatatattcattcattgatttattcattcaagcaacagtttttaatttcacattgtttaccaaggcccttgctacttgctaagatagcatattcttacaagtgaagactgattagcttaaaagttttaaaattgctctggctttgacagtttaaaagtgataaactgaacagagaatattgaaaatgcattttgcccacatctgattatttaagtagcaatgaaagtcttaatagactttacaagtattctaaaattcaagacttgatttattaagttggacttgagagctaattctcatacagctattaacctaaggtgacaaattgcctcatatggagagagatgtccaatatatctaataaggagagagaaaggaataaactgaatatttcatgccgtgacaatgtttgcccttcccagccacatctccccaaatactacttccattctccattaacttcaagacaagataaacatctacatctacattttggtataggccacccaaaaggttttgtgtgcttgttttcatctgacaaactagaaaaaacaatccacagtgttttgtttgcttccaagaaaagaaaagaaatttcaggaaaatacaaaattcaacattatgccatcatgtaccacagggaataccttttgttctttatcaagatactttgcaaactctagattattacaaagtttacccaatagtatttttaaaggataaaggattactagatgcaggaatgaattgaatcatcatagaatagggaattaagagctgccatttattactatcaatcccaatcagtcaatctactgctgccatctaatgttggagctgtttctaaagcagatgctgagtacaggttacctctaccatttgaaaaatttttataggccagcgtatttccaaaaaatacacaaaatcaactgcttcctagaaagagaagatagtagtttgacaaaatggagaaatattttttcttcatttagaagcttcaaaggagagaaatcatgtaatagtaaccatttgagtactaatatattttttaaaaggcgaacaaaaattagccattttcactgatacagcaatatgactgtgtctatatttgttcttatgtttcttatatatattaaatgaaagtttaaaaataaacacaaaataattataattagaagactcattaatttagttttacatatgctcgttaatttaatttaaaaatatttaattgagaacctagtctcaattaattaagcccaaaatattataattgtcttttacataaatgagaaactttttttcaataaaatgtcactattccatatgttggccctgtaatggttaaaaaatgaacatggttcctgccctcgaattaattagcaagataatggcagaaaatggttaaattatgtgaaggaaacagagcaagatagtatgataaagaatgactgtgtgagcagggaggctcagaggccctgtgttagacagcatggttaggaaaactgctgtgaggagataatattttagctgatatctgaatgatgagaaggagccctgtgaagagatgggacaaaaatgcttgcagatgaggacatagcaagacgatggccctcaggcaggaaacagcttgatgtggcaaagaatgagacaagatttacctggctaggtatatttgataagaaaagagagttcatctggggtcagatcacatggggtctttaggccatagtaaggagtagggatatgttcagaaagcattgagaagtcatatgaacccattagccaagagaacaacatgatggctgatttgtttgattttttacacaatcccttgggttccatgtatacaatggattgcaaagagacaagaatgaaaacagaaaatccaatgttgttatgaaaatagaaggctgactttcaaattttgctaaagctacaccagctaattgtcaattttatcactgaatgtttaagatgaaaatgaccttagaagtctttttctctttggtttacaaatgaagaaactaaacctcagggatgttgggtaacacagctcacaacttgatcaagctgattcgtagcaatatttattactattcccagtataattagccttccagcaggcctgagcttgcaagtcagagaagacactatgtttccctaagccactgaagaagtggcgcagcagaatggtgaaggcatccatgctggacgcaaacaccctgattttcataccattcacgccttactggctgtgcaactgtgtgcagattacttaacctcaatggccctcagtttccccatctgtacgtagagatgataatatctactttataggatcaatgtgagaattacatgagttaaaattcacaaaggactaagagcagtaccaggtaattactgtaaaatagttatttaaaaaataaaacaataggacactgatgcatgaatatcgcaagtgtcatgtgccaagaacctagggacataggtgtttggggagcttctgtacctactggagcacttgtgagggcatattcagtagtggaaaagatgaaggttgtacattgctcaaagaaattacttgatggtgatatttccaagagcatctgctatttgcttcttaaccaagaaccatttttcttccttttcttttttcttgtagacctcactcacaacagaagctcaaatatcacatacattctatcccagacttcatttctgggtttggtcctgtgattctagaaaaggcctatggggaacatgtatgtgtggcagagggggaggaggggtaagtttctaataaatgattaggttggtgcaaatttaattgcattttttgccattgaaagtaatatctctctgtaaaaaaaaaaaaaaggaatactcctgagacaattccctttcccctccatgattttggatattttgaaatgagaaattgatggttagaatggtggcaaccaacttatgacaataaaagaagtctaaatgtattatagagtataataacagtatgcagaatgactagagttctgccatcattgagctgctgaattatccaagtgcagaactacctctattaagagttgtttttaagtgtgattttaacataaattcctcttgtctaggtttcttggactggtattttgttacttgcagtagaatcatcctctctaatctactctctcctgtcattcatttttcaaaaagtattaattagatctatcttatgccagatctcctgcttaatcttacgatacacataaaagatatataaaccctagtagcatttatgatgattttcttattcattgtttacttctatatttctccctaccatattgtaaataatttagttagacattttttttatttattttccccctcacacctacacaacacctgctgaagttctttgggtaccaaataaacttgattaatgtttgttaaattgtattaaatagcattggataattgcatcttccttcccccatctctcatagctatgactccatataacctaagatgattaaacttagattgaaaaacacatattacattaagtattaatttactcaccctcagctaaagttcagccaaaaaaaaaaataagaaatacaaaatgaggcttaagcagtctcagaatcaatgtaaatgaatgtattactctaattgaaagacattctggctaagaattatgcttcagtcaaatgaaatatggctttataaaaatagaaaataaaaaataaattttatttcaaatgtacattattgataaatgtttattattaatactactcattacaggatattggggaggatgccctcatttcataagtctttcaacattattactaaagtaccatgacagctgtctctgaaccctgcttgaagatattatttttttcatttgcctccactcagctgtttctcatctacttcaaagggatcataagagcacttgagggagctggtcttcttgcaactccaaagtgaagaatacagtaatgcagactataatatcatttgattatcacaatttttcaatcttattgaggatctgaataagtcagaatcaagctcctagttctatattttattatagcattattcatcttctcttatttcctccagcatccaacgcccccaccccaccacctctataccatgcctcatgaaattattttcatatttcatcaggcgcagaacactgagaaactgtggctttagtctaatgtctgaagtttctaaatgtcctttggcttcttacattgagtctgaaatgtagacactcatacaattactaggcctcagctccctctaatatatttactttcattgtccctgaaattcttttcacactcctcctaatctacttttatgtttcacctcctaaaaaatgtctttcattattaagtagaatttatgtgttccaaactaaaacaaatggctttctcttacattccatttgcattttaactgtcatcatactcttatgtataaactataatttatttttaaaattcttcatatcttatttcttacctcaagtattagtagaattgattatatttattaattacagattgattttaaaatcaataaaatatctattatctgccaggtacctgaaatgcaaatatgaatgtaaatgaactgaaccctggctcagtgagttcttctagttggaaagagaaataagcaagcagacaaaccaggtctagctgtttgtcagacatatagtaaatatttaataaatgtttaaaaaggaagtgaaggagtgagaaagctctaatgattatatacatttgttcatggagtcccattgattttatctatatttgttttcttaatgatctcatccagtctcatggttataaatattgtgtataaactgatgactctccaattaatatctatagcatcatctgctcctctgaatttccctggatacctgatttccacatggacatctcttgaatagcatatatgctttataaacttagcattccaaacgcaaattccagaacctataatgcacacattctttcctatcccagtaaaagatgactctatccttccagttgatcacagtccaaaatgttttctttcacactccatgtcaaatgctttagaaaatactatcagctctgccttcaagatgtatccagaatttaatcccttcttaatactttcactgctattatcatggcccaaacattcatgatcaattgtctaagccctagattactgaaatagaattctaattattctgacaggtcttcctgattcaacccttgccatatagattattcataacatatcaaccagagtgatctgctgaggtagaaattaaaccatgtcattttctctgttcaacacccttccatgtcttcccatcccatgcagagaaaaacttacattccttacagtggattacaaggtccttcttgatatctctcctcctgcctttcatctctgccctcatgtgctacctaccccttcactcactcaactcaagccacacatgtctcttggatattcctccgatatggcaggcactctctcatctcaggaccttcacacttgctcatatctaatcatgacattcacttatcaatgccacaaactgcattcctaacctaaatcaggacttttctcaaatgttatctttcagcgctggcttccctaaccattgcatttaatataatctttcctttattgttaatgctatcatatcatcttattatcatctagcatagctattcgtatttttcaattatttcttttcaggccttttctttccccagctagaatgtaagcaccaaagcaataatttttatctgttggtttgtttgcttttccttccagtgctagatttgtaatatctgtaatgtttataggcatataataagttttcaataaatatttgttgaatgaataaatgaatgtatatctcttctagagagagtaaagaatagttttatataggcaattacctctgaacttagtttcatgaaagagaccaagatacatgagaaagccaagagacttgattgagaaaactcaaagaactggaggcaatgttctgggaggcatgtggcccattagctcaatatgccaactcaacactcagactcatgtcaaatcttaattttaccagttactagtatggtaactgatatcaggcaagttagtttatctttctaaaacttattttccttagttgtaaagtgggaatagtaatactacctatctcatagggctttatcagcaaattcttgtaagataatacataaaatggttataataaagcctaatatgtaatctgcacaattagtatctatcatttattttataataatgattattactaaattaaataataataataatttaacagcattgtttgggcagctcataagacagtcagtggctgctaaatcttcctcgactgcaactgctgaaattggttggaatggagaatgcttagggatgaataacactagatgagagaacaaagatttatcaaaaaagaaccatagaaaggaccttataggcttagctaatggttttagacttcattctgtaaagcagtggtttctaaacttcagcatgcatcagaattgcctaggagacttgttataacactaattactgggcctcccttctaaaatttctgattcagtaggtctgtaatggatcttaacaagttccaggtatatccattatctatggttgcctagctaatcatcctcaaatttactgacttaaaataatgaacagttattatctcacagttgtcgtgggtcaagaatccagctgcaaattgcaatcaatgtgtcagctagggatatggtctcatttgaaggtttgactggaggaggatttactttcaatccctcatgacgttattgacatggttcagttactctccagttattgaactgagagcctcagttatttactggctgttaactgaagacttcctcaggtcttcatcaggtagcttctccatagagcaactcacaacatggcagctggcatccctcagagtgagcaagcaagagagtcagagatagcccccaaagtaaaacccacagaaatttggtagcttaatcttggaagttacgtcctattatatctgtcacattctatttggcagaagtaaatcaataaatccagaccacactcagtgggaaggggttcgataagatgtgaataccaggaatcaggaaccattgatggccaaggtgatggttgtggtgctggcttgggaactataatctgagaattacatgctataaaaaattttgacatggatggttctaacatggactggtactgaaaatcaaggtgagactagttaagaagttcttgcataacgacttttatctttagataattaaattattttatgtttacaaaattaatactcttttaatcaatattttaaagtatcccttcaatgttgtatataaacctcatctaaaaatgaaatattggaaagtaacttaagttatatgaaaaagaactgtgtggagctaaattccattaagggtttcagtatgatattgcccctttgtttaaaattaagcatgcatttagacagagagaagcgcagcctggagtaacaagaaatatattttagacttcgccactaactacatttcattctgtaggcaactggtggtcctaaatacataagtacaaacattcaaatgcctttctctctctctttctctctgtctaaaagcttagaccacctagcaagttaataatatggtcaaggacacaataacttaaaggtgccaagagaatcagcatacaaaatgatgcaacattttataaaatgagtgaaaatgattttaagttaaatgtagaagtaaatgattttaaaagtgagggaaactatgtaaaatagatagactcagacattactttaatggaatcattattttttgcatgggagtacatggtgctttaattatgtttctcaaaagcttgtcagtccaattgagactctgtatcaagaagctgtcatcttagcagaaaggcagcctgcttgaccccatcaccattcccacacagaccgtgggagctgatgacatctagtttcaacagcaggtttcatattctttgccacagaagcaggaggcagcttagcctttccagctgtggggattctgttcccttggcctgcttatttgtctgagtcaattcacttgcctcagcctgctcttacctcctgtttattgattttggctgacatttagttcaacatgttataaattctcttaatcatctcaaagagagagaagggagcagagatgccctaaccactacctctcacatcagcccaagacagcttcaggtcatccattccccagacagaagctcaagttgaaatgtgtgtttttcttactactactttagccacagcaacaccaatggaaatgttagttcagacatccaaaagtatataaaatatctgattctttactttaattgggcagcttttttctacctctattgcaaccaggtacccctcttcctatattaccatgggacaaatgatttgctctgcaaattacaaatggacataattttgaaaaggttaaacgctactcaaaaaaccttcaagtaaagccattcaaattatgtgaaaaaaaattaaggcggagaaaagctatattttcaatttggtcttgcaaatgctaatcagttcagataggagatcatagatataataaattgcttggaagtgacccaaagcccaggtgaaataggatgggcaggtaggtgccagtcaccaagattttctagggatagattaagaagctggttgaattgtaaatactgtacaaccctttcaaggtagagtccctaggttttgcagtaactacattaaaagtaattaagcaacctatacttcatacagaattatcttgcattcgttctatgagaaaaacccactgattctttgtataattgattgcctttttaaaatttgcatgttgcattcagagtagatccttcaggtattgcattatttaaactatttttcaaccacgactttcttctaaattttatgttagtatttctaagtgcctgatgaggcatctttcaggtatgaggctgctcctccttaaaaattccctgcccctcttaattagcatttgcaaaatcttccctctagtgagatctttgaaggtgaggtattgtctaattcagctttgtttctccagtatttttttcccaaggtgaaaggagtcacccttctcttcctctgttcgcataactgctcttctgatcataactacttgtctacatgtatatttgtcatcacaagctaagctaaggactgcctgtgggtaggacctggctcccatttatcttttttccccctacacctagcacagtgctggcacatggcaggcactgaatatatttgctgaatgaagggagacaggaaacccaaaagaaaaataggacaaaccaaacaatactgctactatttttttgtcaagttagaaaaaaaaaagcttacaaaggggataatttaatgactaaaaacatgtagaatcagcggtaagcagatgttatcacatatccagacattggagtgatttcatgaagaatttgaataaatgaatttattactttgtaacttgcaaacctcaagttagcataagatttatctctgagcagggtcttgttattattaaaggtaagaaggcaagcattagcaccagcctagaagcccatgtaggtaagtttactgtcagtagagataagcactcataagaggccaccaggcaagggacaattaagatattcattctattagataggcactaattgagcacttcttgtgggccagttagaagacagtgaaatgaatgagacagcgtccgtgaactctgggaacctcaatttaagggggaggcacagcagttacacaatcataattagataattttccattgtctgttttctctattagtttcaaagctctttaagggctttctattcttggcagctagcacagtgcctggcacatattaaacatttcacagatcctaatgggaagaacaaatcattctataccaaatggagagtagacattatcctctttctatgccccacccctcctccctcagacctttattctgcctggaggcttcacacagtctccttactgctcactccaaatctcttccacccggcattatttcacattgccactaggaggacctttctaaagctaaacctgatcccatttgaaatccttaacatcatcctcaaaaacaaacagtggtttttcattttgacaacacagatccttttgaaaatctattaaaaggcttcgaacattctcccccacttaaaatgcatctacaacacaagactttgtgcccaatttctagttatttatggtcagctcaatagaggtgcaagaaccctaaattaagaatctcaggataaaatccaaaatatgtaggacacaagatatctgtcatttttgtgtcatccttgggaactatcttctcccgcggcagccatcccccccaacttcactttacaccccggcaaaacaattgtttggtttacttccacaaacacaccatgctcttttggatgccatgtatcatcctggagttgattttttcattttgcaacctcaagcctttatctaattggtgaatcttaatcagccttcaaaaacaagctcacattctgcctcctccaggaagcctctccaactaacaaaccctaattaaagtcatcccttatttctttgggttatttctggttcctttgcatactctagagttgcttatattaactgtttttatagtttactcacctgtctctcctctaaattctagtaatattactaataataatggttagtatttaatgagattttacaaatgtatgagacactgttctaaccattttatatgcataaggtaatttaaatctcacaaatactctataagggtattgtttttatctttattttatagatgaagaaactgaggcacaagggactaaattttaattcttctgagttaagaactttatctgaaaacatgttaaaatgaatggaattgaaatgcagtattataatagaaatattaacaaattattgaaacaatacttctgatagaaccatttactgagcactgactactcttaccgttgtactcagaattttacaatatattatcactaatatccaccacatttcagcaaggcaggtattacttcccaccattaacaatgagggaagcagacttctatttaattttttggtaccagggcagctttctatgcaatctcaatacagaagagggaagactacttagaagagctgaactgtgagtgagtatgacaaaaaccacagtttcagcaggttcgtagctcgaagaaagcatgcaatgtgatagaggtgtgtcatctagggaagaccacatggccttttagaaggatccccacatgaatagagccttggttggtcacattttctcactctgagctttgtacatttacaagtttgaatattagtgctttcaagaatcatcagtctctagaagattgattcaatttaaataaattaacaagaaaccaatgtataaaatgtagaatgatactttataaattcataatctattcactgataggtacattcactccttgttgccaaagctatataaaaagctacatcataattaaaagattgccaggaacacacagaattggagctgtgggggttaatgagacttaattttccaacaaatattgagtgcatcaatttgccactcactgttgtaggcactgaggaaatcaacagtgaaaatgaaaaaacaaggtcctattctcacaaatattaaatactagggttgcatcattaggcctggtagctgtatccttccatcttcattaaagaaacaacttaattatatgctaattgtgattacaaggcactctcttttgagcagtacaatggactctcagtcaatgtttgctccctagctttctcttttctatcaatgctctgtcactgatctttttttaatctgctaaagatttaagaaaaatgtttgatgatgttcaagttaacaattaggttatgcaaatcttaatctgatgacattttgttcctttaagaacattttgtacatctttgttctgctgtatgtttatttagagtttgactctcacagagcaggaagccgtacttctctctttccaagttcttgggcatttattgctcatcccatgcatcacttatagagagcagccagggtagaagtatgtatgcttctctatctgtttgcaaactgtatagataattgtgtttgtagcctatagtatagagagaaatggtctaaaaatgaagcttgaagtctaaccagaaggattttgagaatcagtttaaagaatatgaactttattctgtattatatatggtagaaagtccttgaaggttttagaacaagaagtgacataattagatatgtatattagaaggaacacatttcagggcaaaaactcagatatacatggaaaaaaactgtctcttcctgaagctgatctgaatttctattccatgcctccgttcctctaacttatacagtatgtgtagtctcaattgatttagaatttttcagtgctttgtcctagattttctcaccaaacatctaaatttagagatttgggtttttccagttttgtttttgtttttttctcacgccaattctaaataatgtctttcagggtaagagaataatacactttccccagatatatttgcgggtataagagcagaaaggccttgtgctacattcctgaaaagagtccacaaaaataaccagaccccagagttctcctgccctcccacaaggtgcagaagctgtaccacagaaatagctggttagcctgtattagagatggatagaaggcctaagccaacatcacagagcccttagttgctagtgtaggggacaaggggacttgcactggggtggttcatgtttttaggcagcctcaatgagtttcccacaacaatggaattttttcctatgtgcccaggaacaaagaaatctctaaaaggaagttttatttacagttaccttgcattgcaaaatgagaaacgatgtatgatctcctcatactgggagattatttaagtctctggaatttggatgcagaacggagactcttattagaaattaagttttagaaaagaaatttacacattgttcttacctaactatgtaacctgaaattctgagctggtgcatagtttagaatctaataaattataagagtcgatgcctaccaaggaaagttacttaatcagtagaaacgtacagtatatcaccaagtaggcgagaacagggaaaatgctgggttcaatttcatcagccgaaaaacggtttggagataatgtgactgtagctacctgaataattaaatgtggaattaaaagcagaattctagcatgggaaaacaaaatctatcaaaaagcaacaaataaagttaattaactagttaacgtaaggtcatactaattacctgaatatttactaagtacccaagtgtgacattgatggagaactaaaggttgctttaaaggaaaaatattctccaataaactaatgttttcgaaaactagtctccatgaatcaccccacataatttgcagtagcatttatccccaccagtccaaccacagctttttattagtcagtctctcactgattatggcttatagtgggtatgagccataatttaaaattaatttaaattaatttaaaatttaattttaatgcaaatcaattgcaaactaaaatttcaatttttgcaagatgtgatttcatagtttctgtaagaaatgttgtagaattactcatatcataccaaatcattgacagaatatcattttgtcctcttttaaattttagttggaaaaatcagcatgtaattcagtctacagttctaagaattgatgtatagttacactacaaacaaaattttttaaataaaagtaaacatctcataaattttttttactaacatctcaacttatttttatttttttattcttgctttataatatttaccataaaaatttgatgtgttttaaagggatttaccttcactttcagttactttttccaatgatgtaatgaatatctgctattctaaatgaaacaggtggaagtttatgtaggaaaaaaagatagttcctctatagccatgctgcctgggaaacagatataccttaaaaaaagagtaaatgattgaagagagagaaactatatcacattgacagatggattgggaaacaaatgcccacttgttataaattgtgattatgcaattttacaactgactactgaaaatgttgtttattttgaaatatgtagcccacatctagcaagtataaagttcttcacagtatgcatgctgtgctcaatataacttcgtattagagtttacttacctatttttttggccaatttctcttacttattttaaatttgtcttacagtgctgtaagctatttcagaacactatagttacaatgagtaactaatgtgttaatgatataaattaaataatatttaatgatataaaagtaattacaaattataattaaattatataattatcataattaaattataatataagcacgaattgtgattaaattatcatttaattataaattaaatgatataattaaatgatataaattaaataaataccataggtattgagaatcttacaaaaagtacaaattgaatctgttgaagataatagttttgaccttaaatgtaaacaagatcttctgaggaataactaaagaataatattctataactattggttcccaatttaagtgctcaggaatattcaaccatttctaatgttttaatgcccatgaacttttttcctggcaactgtggcccaatagaggatagtttatagcttgaccttgaattagactatcatgcatagcctctatttagtcttaacagctttgaggtccttggctatctaagtgcagaaaaatagagtcagctagaaggctctctggagcactcttggaacctaacaattctaccacgaagtcagatcgagaaaaccattcaggctttaggaagcactagtagttctaagtacaattaatgaagggaaattgaccctaaggagaagttttgcatagattttctttactcttgctctcaagggacccctgaatgctaaaatgtcatgaacacttcactagcattttagactgaactgatttgagacactcagaagtaattttccaaatttttataataaggccaagtctgagactgtttttccttgaaccatttcagttcaagcatatgttgaaaataaagcatttgataaaaagcctagatctagactgtttgaatgatgtggattctcaacagcatactctttgcttttataggaagtattctttttctttacggcactcaactagtatttcatcactttcaaagctttcttggcccttgctatttctccaggattcactccattattttcagcctttcttctagaataggcctatctgtccctttttgtttttcacagcagcactatatattctctcatccacagatgctttgccaaactcttatcacagccaaggaattaaggtagaatacaaatatacagaaccaccacatttccccagaaaagaaagcaggaggtctatagaagtgttaaaacatgtaaacaattcactctgatatatagaaaaggtgttctctgccgtaaaactgcacaggtaaagtcgtatggtattggagaagaggaagatatgacttctcattgtaaaggaatcatagtaagtctttcttgatgagatggcattggagcaagagctcgaaaggtaagtaaagatggggaattcagatatggaattagagcttattagtggcacatagttcaattttgcttgaaggtagatgaactcaaggtagagagttcatgtaaggtgacatagaaagtgttatcaattagtgctgtctaactgaaatataatgtaagctacatacataatttgcaatcttctagtagccatacgaaaagtaaaaagaaaaaagttattttaaaatttagtaattgtaactctaataatatattcattctaaaaagatattttatttaacccaatatatctaaaatactaatattttcacatgtaatcagtgtaaaatttattaagaagatacttacattctctttttcataatgtctttgaattccagtgtatattttacacttactgcatatctcaatttagactagctagttttcgaatgctcaatagccacatatggctaatgacttccatgttggccagcatagttgttgaatttgtatggattttagttgataagaacaagaaaagaagaaaatgaagaaaattaggagatggctctcttttcactcaacatgtatatgtgatatgatctgagttgagaaacatgtgccaccaaaaatggcctggccaacttccatacccttgttcttggtagttattctgattgccaatcaggtatccatagctcctacccgtagtccatttgctatggggtaaggtaactcaaagttctagttgtatgaagatgcatatgatttatcttagtctcttcccttgggtatagttgttgattctgttatgatccatacaattggaggagacattttctgggaagtataagaaagaaaccccctctccctatttaggaaacaacctgaggtgactcaacctcattccctgtcttcccctggatgtgaacaaaggaattttaggcagtcatcttgcaactacttagcataaagaatgaatacagagtcaaaaaaaaagccctttattactccaataaactacagaatctaactaaccatatatcctgtggaagatgttgctacccaatatcaatttttttcttcctcagtaatgcagcttgacgtttgattctacattgccacacaaaataagtacctcatttcccagcctcctttgcagtaaggtatggccatgtgactacttctagccagtgacatgcaaaggaattattacatatgtcttcctggaagtatggtacctcagcgctggtgcaatagcagctttcttgaccatggtgcaactttgtagttggaggttgtgtgttgaggatagtggagcagaaagattgaagcctatgtttttagatcatgggggctatcatatgagctttgaccacctatcccccacatttcttttatatgagaggaataaatgtctatttgtctacaaccactgtagacactgtgtactttgatcttttatattatagaaaaaccaaacctaattatgcctacctctggtggtatagcaatgaccaatacagacgagatccctgctatcgggagacatctctcctagtggagggaaagagagataataaagaaataaacaggccaggcgcagtggctcacgcctgtaatcccagcactttgggaggccgaggcgggtggatcacgaggtcaggagatcaagaccatactggctaacacggtgaaaccccgtctctactaaaaataaaaaaaaattagccaggcatggtggcgggtgcctgtagtcccagctgctcgggaggctgaggcagaagaatggcgtgaacctgggaggcggagcttgcagtgagtcgagattgcgccactgcactccagcctgggcgacagagcgagactctgtctcaaaaaaaaaaaaaaaaaaaaaaaaaaaaagagaaataaagaaaaagaaaagaaagaaataaacaagcaaaagagagacttcttgttagagacagaagcaataagaggggctactttgtgcagtcaggggaggccttcttgagaagcagacattagagacgtggcctgaggacaacaaggagccgatcacaggaagatttgatccaggcactctgggctgagagagcagacagaacaaaatggctgaaatggaaagaaagaatgctggtatgtctggaatacactgagtgacaaagtggtaaataaagagacaggagttataggcagggcctggatcagtcagggccctttaggccaggagagttgtgtggggttttggtttttgtttttgtttttgtttttgtttttgttttgagacgaagtctcactctgtcgcccaggctagagtacagtggtgtgatgtcggctcactacaacctctgcctcccgggttcaagtgattctcctgcctcagcctcccaagtagctgggattatgggcatgtaccaccacgtctggctaatttttgtatttttagtagagatggggtttcaccatgttggccaggttggtctcgaactcctgacctcaggtgatccacccacctcggcctcccaaagtcctggtattacaggcgtgagccacggtgcccagccaggccaggcaagttatttgaattcttctctagagaattttgaagccactgatttttcttttttaaacagaagaaaaagtggtctgatttgtgtattcatttttatttacttctgaatttatatttttgtggatcacttagtggataagacaggtgtaagaaaattatttgcagtagtctaaatgagaaagaatggtaacttggagtaagatgagagtgatggagatgaagatggatatgtgcatttttacacaattaaaggcattgggtaaatggaaaggatattataatagtcaattaaccttgtagcattgttttttttttttatcttattgtaagtcattactactctttgtctttatccagcagaaagcaggacctagagggaatggaagaatgatggataaacagtgacaggtggataaaaaaggtcagagaataagattgtgtgagaaaactcagggcacctaaaaaacattctgaggatgctgagcaaatgaaacaatgatgggagcaccccaaagcgttttatgactgggtaggaaaaggacaaagcagaaagtaatggagaacatgcaggaatggtaatttgttcacctcaaaatcttaaccaagctcttcatgtagaaaatactttagctaataagatgaacgtttgaagaaaaggatcttccattacttgctgtaaagtagtaaaaccctcattgttttaaaggaaattactcatgtacttttttctttttttaagataatttttaaaaaataatttcaacttttattttagattcagaggtacttgttcaggcttgttacctggggatattacatgctgctgaggtttggggaatgattgatcctgtctcccaggtactaagcatagtactcaatagttggtttttcagcacttgcatccctctcttcctcctccctctagtagtccccattgtctattattgccatttatgttcctgagtacccaatgttttgttcccacttatgagtgaaaacctgcagtatttggttccctgttcctgcatgaatttgattgggataatggccttcagctacattcacgttgctgcaaagaccatgacttcatttctttttgtggcagaatagtattccatggtgtatgcatatgacattttttatacaatccactgttaatgggacctgggttgattccatgtctttgctattgtaaatagtgctgcaatgcacatataagttcatgtgtctttttggtagaacaatttattttcctttgggtatataccccacaatgggattgctgggtcagatgattgttctgttttaagttctcagagaaatctgaaaactgctttccacagtagctgaactaatttacctaatttacattcccaccacagtgtacaagcattctcttttctccatagactcaccaacatctgttgttttttgactttttaataatagctattctgactggcgtcagatggtatctcattgtgattttgatttgcagctctctgttcataagtgatgtggagaatttttcacttttttgaccacttgtgtgtcgtgtcttcttttgaaaagtatctgttcaactgtcttttgcccatttcttaaaggacttatttgctttttgcttgttgaattaagatccttatagattctcgatgttagacccttgtcacatgcatactttgtgagtattttttttccattctgtaggttgtctgtttacactgttggtagtttctactgctatgcagaagctctttaatttaattagaactcacttgtcagtttttgggttttttttgttgcaattgtttttgaggactttgtcataaattctttcccaagtttgatgtccagaattaactcaatatgggttaaacatttaaatataagagctcaaactataagacttctagaagaatttaggtcttacatgtaagtgtttaacccatcttgagtcgatttttgtatatggtgaaatgtagtggtccagtttcattcttctgcatatggctaaccagccatcccagcactatttattgaatagggagtccttttctcattgcttatttttgtcaactttgttgtaaatcagatggctgcaggtgtgcagctttatttctgggttctctattttgttccattggtgtatgtgtctgtttttgtacaagtgccatgctgttttggttactgtagccttatagtagtacagtgtgaagtcaggtaatgtgatgcctctggctttgttttttccttaggattgcttcgagtattcaggctcttctttggtttcatatgactttttgaatattttttctagttatttgaaaaactatttggtaccttgataggaatatcattgaattcgtagattgccttaagcagtatggccattatagtgatattgactgccaattcatgagcaaggaatgttttttccatttgtttgtgtcagctatgatttctttcagcagtggtttgtggttttccttgtagagatctttcacctccttggttagatgtattcctaggtattttattttgcagctattgtaaatgggattgcattcttgatttggttcttaacatggcaatacaagttattggtgtatagaaatgctattgattttggtacattgattttgtatctagaaactttactgaagttgtttatcagttcccagagacttttggcagagtctttagggtttcctaactctaaaattatatcatcaacaaagagagagttgacttcttctttttctatttggatgccttttatttttttcttctccctgatttatccagcaagtacttccagcactatgttgtataggagtggtgagagtgggcatccttatcttgttccatttctcaagaaggatgcttctacattctgcacattcagtatgatgttagctgcaagtttatcatgtgttgctgttattattttgaggtatgttcctatgatgtctagtttcttcagagctttgatcataaagggatgttagattttatcaagagctttcccatgtctattgagatgattatatggttcttgtttttaattatgtttatgtgatgaatctcatgtattgatttgcgtatggtaagccaaccttgcatcccaggaatgaagcctacttgatcatgatgaattaactttttgatgtgcttctaattcagtttgctagtaatttgagaatttttgtgtgtgtgtccatgttcatcagggatagtggcctgctgtgtggtgtctttgccagctttggtgtcagggtgatgctggctttgtagaatgatttatggaggagtccttcctccttgattttttgcaataattttagtagaattgttgccagctcttctttgaacattggtagaattcagtggtgaatccatctggtctgcagctttttcatcacgttagttaagtttattattactgatttaatttcagaactcaatattgatctgctcagggtttcaatttcttcccaattcaatctagggacattgtatgcttctaggaatttatctatttcctctagattttctagtttgtctgcatataggtattcataatagtctttcaggattttctgtatttctgtggaattggttgtatagtcactttcgtcatttctgattgtgcttatttagatattctctctttctttctaacttagctagcaatctgtcgatcttgtttatcctgtcaaagaaccatttttggttttgttgatttgttgtatagatttttgggtctcagttttgttcagtcctgctctgattttcgttatttcttttcttctaggtttggggttagttttttcttgtttttctagttcttctggctgtgatgttagattactcatttgaaatctttttaacttcttgagataagtgtttggtgctgtaaactttgctctttgctcttaatactgcttttgctgtatcccagatattttggtatgttgtgtctgtttttctttatttcaaagatttttttttttatttttatttttttagacagagtcttgctctgccacctaggctagagtgcagtggcgccgtctcggctcactgcaagctctgcctcccgggttcacaccattctcctgcctcagcctcccaagtagcagggactacaggtgcctgccaccatgcctggctaatgtttgtagagacggggttttaccctgtcagccaggatggtcttgatctcttgacctcgtgatccacccgccttggcctcccaaagtgctgggattacaggtgtgagccaccacgcccagcctatttcaaagactttttgcttatttctgccttaagtttgttgtttacccaaaagtcattcaggaccaagttgtttaatttccatataatagtgtgtttttgaaataacttcttggtattggttttcatttttattctaccatggtctgacagtatgattgatatgatttcaatttatttatttatttattgagactcaccttgtggccaagcatgtggccaatcttggaatatggtccatgtgcagatgaggaaaatgtatattctctggctcatgggtggagtattccatagatatctattagctccaattggtcaagtgtcagagtttagtccagaatttctttgttagttttccttctcaaggatctgtctaatgctgtcagtaggatgttgaagtcccctgctgttattttatggctgtcttttcacaggtctagaagtacttgttttatgaatctgggtgctccaatgtggtatgcatatatacttggaatatatgcatcttttgttgaactgaaccctttatcatgatgtaatgcccttatttgtccttttttactttggttggtttaaagtcttttttatctgatataataatagtgacccctgcttcttctttgtgttcagttttgcatgatagatctttctccaaccctttactttgaggttatgaatgacattacattacaggtgtgatgggtctcttgaagacagtagacaaatggttcttggtttttttgtttgtttgttttattttttaatccaacttgccactctgtgccttttatgagggacaattagactatttacattcaaagttaatattgacatgtgaggtctcaacctatcatgaacttgttagctgtttgctttgtggtttctattgctttatagggcctatgagttatgtatttaaatgtatttttgtggtagcaggtatcattctttcatttccatgtttagaactcccttaaggatttctcataagtttggtctgacagtaataaattcccttagcacttgtttgcctcaaaaaaatttgtttctcccttacttatgaagcttagtttggcaggatatgaaattattagttggaatttcttttatttaagaatactgaaaatagtccctcagtctctattggtttataaggtttcatctgacaagtctagagcctaatgagatttcctttgtaagtgatctgaccttttctctaagtgcctttgagattttttctttattgttgatcttagatagcctggtgactatatcctttgttgatgtctgttttatatagtatctcacgggtgttctctggatttgtcgtaactggatgtctacctcttaagcaagattaaggaaatcttcttgaattgttatgtcaagtatgtattccaggttgttttctttttctctgtctctctcaagaatgccagtaatttgtatgtttggtcactttacataatccaatatttctcaaagaaattcattttttaaatgtttttttaaatgaattcctcaaagaatttcatttttaaaaaaattattttctctatttttatctgactggtttagtttgaaagactggtcttcaagctctgaaattatttcttctgcttggcccagtctattgataaagctttcaattgcattttgaaaatttttaagtgagtttttgtattctaaaagctctgactgatttctttttaaggtgtgtatcccttctccatttcgtagattgcttgaaaagtttctttatgtagattttcaaccttgtcttggatctcattgagcttccttacaatccttgctttgaaattttaatctgtcatttgaattttcattttggttagggaccattgctggagagctcatgtgatcctttgctggcatcactacattcagatttttcatggtgccagaattcttgaacttgtttcttctcatctagagatgctgacacttagcttttgtaattttctcatgtggtagcacttttttttctagataatattattgcttgtttcttctttccctttcattccttccctggggtgtgtggctgtagagaatgctgggtaaggttttttggcttggcttctgtagccctatgtacttctgtcagcaggttttatattggactgtgcagtttgacttacaagccagtaggtgacacttatgggtaagagctgtctgtggcctgtaatgactaggcatgtacttgatccttgtttacttggagaacctctctgttgcctagggcaatgggctgattcatgaagtgcactgtggtctgagctctctcctcagcttctgggtgcaggagccagatgggcagggccagactgggcatgtccacctgcaggtcccccagtggcaggcaaaagcaccaatactgagggactatccagtggatggctattaagcatccagaggtgtggcaaggcatggagctgggaaacctccttggccctgagttttctgtatgagaatgggagcaacctaaactcctaattcagaaagcagctgcttcaggtgcctggagatctgcctgggtgtggcgtagagcagtcccttctacattaggatccctgcacatgaatggtggggtggctcagactatcagtttgggcaaacaggtgctttgaatggttggagatctgcctgggcatggagcagaaagggccttcttgcaccacaatctatgcaaaggaagtgtggggcagtttaggctgctgatgcaggtgaatgggcaatcaaaatgcctagagaatctgtctaggtgtggagtgaagacgtcttcactgtacaacaatctgtgtctaggaagggtggggcagctcaggctgcttaaccagttgagttagtgctctgaatgcctggagatctgcctaggaatggagtagagagagccctgctccatcattatctcaggagagcaggctggggcaggcaacaatgacatacacagaccagttccaggttgccaagctggccgtagctgcaagtcttagtccaggagaaactgcagttgtagcagctctccttctgcctcaggcctgcaatggggagagcataattgtaacacctactgctgagctgctttccacagttctggctgtggaggcccctacccgactccagagtacgtactccatttctggccaaagactaaaatgcctgcatgaccagcctgctggatcaccacagaatggctgattttgtatgccccgggattaaaaatggcgtcctgctcttgctcctggttctgggaaaatcccagcagcttttcctggtgtctttccctcacagagtacccaagcctctctgcaagtcaactccagagcttgggagaaaagaaaacgtactccctcagcctactgggttgctcagatccccaggagaaaagtgagtcacagagggctctctgtctgtctcacatactggggcttcactcacttttatcaactggacgccatcacaggggctgtttgcctgcatcctcctcctgagatgtggggtgtcctttatgattctggtgaattccaattttccttattgaaatacagctcatagagtttctctttatgcactatctttctatttctaagggctgaagcatgcctctaatcactatcttgaaaaaaaaaatgtgttaatgttttaatcatgatctatgtccatcacatttacttttcctcataatattcttatttttttaaaaaaatacattattccagtcagacaggttgaattcataactcatttttttgtttaaatttcatttttaaaacctataaatgcacgatatatgcattataaaaacatctgagacggtaagacatatagaattggaaatacttataattatattacctagaagctaaattatctttgaattttttggaggcttttatacattaatatcatttttaaatggtttttgcttcttgcatatacattatcaaataaacataaatgtaaacaacattcagtttcttctttccaccttttgcctagaatgttgtcttcttaagctttgcttcgtcaatgattactatctgcaaaaacattttaaactatttggaaactgcttttatgtagccataaatatattctcctttctttgaaagttcatagtactatatttgtacttctattttacttaccttatttcatttttttactataatcatttagtcaactagattttttataatcaactaggttaataatttcttgtgtttggggataatcttagttagcattgtttccaataacacctaaagaagatactcaataaacaagtaaattgtatgacattcagtagttccaatgagaggacctttatgacagttgttcatcgcaaaaattggctcaccagatttcccaacctcaggacttttgacttggaaatatggccaaaaaaatcatttatttggcaacaaagactgaaaatggaaggatgcacaggcacacagatgcacccatgagacaggagaggatcttatgacacacgtataaaactgggttatgagtgatgcaaaaatcataagtaaacataaactatggcatagagaaaaattgcagagtagagtatgaagaaaccagttagtaatggaaagataatcgtagagttacataaacaaaatctcacaaatcaccactaaagaacttactcatgtaatcaaacaccacttgttccccagaaacctatggaagtaaaaaaatgaaataaaataaaaataaaacaacaacaagaaaaaaaaaaaaacagaaggctagttaaggtatcctaaactaagatgctacttctgaggaacctagagctgcattggattctgaatcactgacttctgagttgtcattcagtgatggtcttaatttttgattatttgttctgttcttcccacttggcctgagactctaatctttgctgagaattattttttcccttattttttttcatcactgccattatttctgcattacttgaggcaaattgagtgagtcccgttcccttaaaattgaaaacacctatcatagaagtaaattggatataacgattggtaagctggtaaatgttaacaatagactctcaaaaggaaaaaggccctaatttgtagcatttgtcaatttccatggtgtaaatattcctaccatggctggtttcaggctatcatcataacattgctgaacaataaaaaactggggagagatatatgcacagttgattcttgtgagcctttatgagcagactccagtataccactggatgaaatattaaaaccaagcatgtcaatcttgtttttttaacctttcctcataaaattgaataactactttctgagttattacttttaaaatatggcactactgtcacatggatgttaccccttacacacattctgctgttctatgccaacgaagcaatttataggacagtttaattcccttttatattttggaggatatacattatttaatttttacatttttttctaatatatgcactctacttttcaccatagttttggttaaatttgaaatttcttagtgtattttgaattgtcatattataaaagctgctttacttcctttcaaattggaagccttcaaatgaaatggtaaaatctataagtacttcaatgacttaaaattgccctgcactatacaaagtgatttgaaatttttgtggtactttcccttttgttataagtgcctctttttataagtagtgaagactgtaaacttccaaagtagaaataatttaaaattattggagtgcttcaggtttttaggagaacttcattctttcaaattggaattccaatttctgaagtgctccagtaactttaaattgctaaatgctctagactgaagattctggtacagaggtccttaccaaagtacttataaagcattaaaaatccttgaactaattctcagaacacatggccagattattgatttcattttttttgaatcttcagtgaagaacaaacttaaatgatatatgtaaaaaataaaagtaaatccatatgttaaccttaaattacaaattacatctttaaattttaacttctctcagatatgtaagttgatatcagactttctaaaacactacaggcttgaaaagatatgaatgtaaattaatttcattgacatgaacaaactcatttttatggaagaaaacactccagtatcatgctctgtgtttccgggacatggacaatgcaaataaattagtgtgtccttaatcttccttgcattataattattattatggaaagttaactaatacagtagttttattcaagctgaaataaaataaagttcacaaaaactcaagtgtgataacttaaaacatgttaggatatgtaaacaaatgagagggtaaaaaatttttaacttttataactcaaataacaaggctggtggccatgacattttatgtttgtctatccaaaaaagaaatggatacatcaattttatggcaccttcatctcgtcatagctgtagcaagtcataattgaaatcactgactctttataggcccatccattacaataaacaacaaaaagtgtccccatcagctggcttctaatgtcattcccatcatttggtacacaggtgccacagaaatcagacaaatgggtgtgatagttagccttttctcatatgacttgagaaaacatgcaagtgcagtttttcttccctccaacgctaataaaagtcaaaccaccaacataatggctgccaacaacaaagaaataagaaacaaaaaataacttaaaagaaaaagacctaggcagaatatatcactaatatgtacatgtaccttggttgtacatgaagttttataattttctgtgacataaaatttatcatcctaaaacatgtataaaatccaaaagcagaattatttttatttttacaattataaactagcttagcattattgccctactggagaaattggactttttagagatattttattttattagtgttttcaaaagagcaggtggcacatggatctctggaaaaaataaaagatactttcatatgagcccaaaagaaaacctcctaagggaaaggaaaataaggtaaataaaaatgctctgaaaaaatatccttggggcagaacagtatcctttatggggcagatttgttagtggaaaataatgtgccacaaaacttacttgccgattacttgagcattcattttttaaatgtctgatttgaagatttgaatcattttcttcaaatgcaatagagtgaagggaaattctctctatgacagtgattgctttaaattaagcacaagaggccatccgtgcattagacacacatagaattagacttatcaaagagttcacatccttaattcattatattttaatattacataaattcttctataatttctaaactaggattagccttcaaattgcctctctacaagaaaatatcttacgttttgtaggaacaagggaaataagtataacttcaggtgttttgagtttaatgaaaattcaaaaacctatactagtactgtacctatatcctgcctccatctaactctcatattgaaaaaaatgcaggtgacctagctgaaacagagaagagtacagcataaaaactctccttgtaaatttacaaagtcttatttactgatctattgattaacaattttggccttcacttctttggccattaggctgctaagagagtatataaaccctcccacatctttcatgaaagaaaaatgactgtgtaactgaaacaccagattagagcagagccaggaacattttcagcacagaacagaacatggcgtattggtacaagtatcagagtactctttcttagaatttctgttttcattttatctaccactattcgtactgtatgccctctgaagaatgaaatgaactttttaaaggactacgttcattcttatcacttcttttttaaggaatacacattgatcttatttcaccaggctctatttaggtcttgattcatgtaattgaagaaaataaaatatgtgtatgcaccttatctttcaaaggcaggacatacttatcattgacttttaagttgcaaagtatacatgatgacttctgtatgttatgagaagcaattaacatattgtgaattcccaaacattaaatgacagcttcgcataagaatctggtatctaattcattttgaatttgtatttccaataaaaaaatctgtgtattaagtctttttttagtagtatgtataagtcaagataccccaaatggatcaaagtgatcaatctgagtaaaagaaagaaaatcagagctttagatttgaaaacacacagagcatgcatgtgtgtgcatttgtgggagcagtgctggtaaccaattagctttgctggaggtttgttctgacatggagaattgagtaaagcctgctcagaggggtaaaagaaactgggtattctcctttgggcattcaagtaacttttcaaatatgccaccaaatgaaatagcaaaaaaaaaaaaaaaaaaaattgtcaattggcctgcaaccctttactgaatgaattaaactttctatgttatctttgtccttggccacaaataagctaaaaggcatggtgctccttattttaagagtaatagatctaaatgcattttatttgtatttttcatagaagcaacattagaaggcagcattgacttttttcccactcagaaatatataattcattgcaaagatggaacatatgcttatttctgtaaagccttccctccccacccagcatcatttattctctaccaagtatagaacgagaatacaagtaatgcagaagcagcaaatctgtcttctgattattaaccccccaagtacctgaaaaaagaaaaaaaaaagaagaagaaaataagagaagcctggcacataataaaatctcagtcactattttttagtacacgtttgaataaacctgtgttaaacagaataaactaaaatctccaagttattgtattaactttgaaccaaaaatctgcttcctcaaatctgtctttcagatatataccaacaccaacctgaatttcagtctgtaagagtatgtaaaaccagaggtcaatgctcaatgtgtgtctgaatttgtgtgtatatgtgtgtgtgtgcgcatacatttttttaaatacagaagtactattaccagtgcttgggcctggtaatagtatattacctctatacagaggtaaaatcctctgtatagtcatagcaaggttttttttttgttttttgttttttttttttgacaacgcatgcagctgaattgtttcttcaatgtataggttcagctattacacaacaataattggaatggtaaacataacatttgaaatgtgacagttttctttctgatttcccctctttttttctgaaattataagaaactcaaaaacaatgctcactttattatactatttatattgcttcatgtttacaatatgtgtatgtttgtgtccatgggagagaatgaaagagtaagaccaagagaatgaaattatttttgcctttaaaaacgtttttaacgaattaatttgaataataattttaaaatgtgaaaaataacatatttccctataatattggatctaaagtcttccgggccagacataagaattttgccagatatgaggtttaggatgataacaactgctattgttcgtataagactttctggtgatgcactaaaattacaatagaacatctgtaaaatgatggtatctggcagtactactagacaataatctgtattacaggtctctgctaaatgatgttttcatcttcaaagtgaaattatgtgacttctgtgatatttaaattcaggcagaaatgtaccatcaataataatttcatggagcagtattcatattgtggcttatcatcccctttgaagttgttacgcagtaggttttgtttcttggagtttaggcagcttaaaagcagaatggaaatcaattacttctgtttcaacacaaatcagaggatgttttctaggtagatgctctgcatgtagggactttcaagaactcacccatctatgaagccttcccaacttttgacagagctggctcttgaaaggagattggaggcacagtggatgtgaaagggaaaagcagctagagatgccatgagagccaggcattgtctggtcaccaagtcctgcttgtccagatagttctaaaatcagcaaagatggagaacctggaggctgtcaagtccctttaatttggggtcattctgaaagtaaatcattctgtgacttgtccaagtgatgactaaacagttgataaaatattgatactagttctttgcagaaatcatgttaagatttcttttgtaaaagacatcttaaacttttcttaaatttctattctcagataactgttaggtgattaatattgccttgttttagatattattggagaatggaatgaggcccagattcataaaattaatcattccaataaaactaaaaggttaatttttgtttgttttttgcttttaccctgatagggaaaaggactattctccataaaatgccttttttttctgggagttattatccaagatattttcactatgtctccatcctggaatttcttttttttcttttttgaaatggagtttcactctttgttgcccaggctggagtgcaatggtgctatctcggctcactgcaacctccacctcctgggttcaagcgattctcttgcctcagcctcccaagtaactaggattacaggcaccctccaccacgcccagctaatttttgtatttttagtagagacagggtttcaccatgttggtcaggctggtcgtgaactcctgacctctggtgatccacccacgtctgtcttccaaagtgctggtattaaaggcgtgagccactgcgcccggccctggaatctttttttactagctttatgtttcatgacttctcacaacagatttttttttggtatcactgcatgctcaaagccttcatatcaaagatgaaaaacattgaactcatttaaaaatatctatgtgtctgggcttaatattttttttaaattcgttaaattataacagacacatttgtttggaatgtgcactctggagaaatcctttgtctccatatatctttttttaatttaatgtcttcacatatatctctttggatggcacaaatactgaaatttaattataaatgcctttttatatgtatctgcagtaaaataaagtatctgcgtaaaataaaataaaaataatatcacaaatgctctttggtattttacagtgtaagaaagatttttaaacttaattaaacaggaagtatttctatgttctttctccacacaatcactctgtgaaatgataaccaatgaatttaacatcatttcttctggaacactatgtgtactttccaaacacttagaaatgaaaacgaaactgaagttccacaatctgggaataacatatgaatgtcagaaactcttaaattaagttagttaataacagcatattttctgtggtgcagtcacaataggaacttgaatgttcatcagtattttttccagtatttctaggtcaattcctttgggaactattcacctaaggctcattatcagttcaactatattttgatgtttgcatttataccagcactttcaatgctgaaaatttctacttttgtccacattgatgctgtttcatattaaagattttgaatcagtgatgaaagatttctagatttactattgacccggcatgagaagatgggtaaacattttttattattgtttgttaaaaatgttttgaaattattaatgtgactatgattggagtcatacacattaacattcacttttatttctgtggaaacgaattccgtctggtaaaaatgccatctagttcaatatgattctccttagggagtctctcagaattataaataggcacatctattataatgtaagccaatttctgctaaaatgagtcagcagttgaccttagattgctcatcaataaaattttgtctctttgctttgtgaggtacacagagaacattgaattttatttactaatgtcatctaaccttgtttaagaatagaaaggtcctttgcagaatgtaaccgtagtaatgttgtataccattatgcccagcataacgttgtggtcaatgatggactacatatacaatggtggcctagtaatattataatagagctaaaaaatccgaatctcttagttacactgtagccatcataacatcctagtgcaaggcagtatgtgtttatagggatgctggtggaaacaaacatacggtattgcctttcatataaagtagagcacatacaattatgtacggtacataatatttcataatgataataaatggctatgctactggcttatgtatttactatattgtactgtttatcattatttcagagtgtacttttactatttaaaaaaaagttaactataaagtagcctcgggaagtcatttgtggagatacccagaagaggatattgtataggagatgccagctgtaagcgtgttattgtccttaaagaccttctagtgagacaagctgtggaggtggaaggcagtaatactgacgatcccgaccctgggtaggcttagggtaatgtttgtgtttttatcttagtttttaacaacaacaacaaaaatttaaaaataaataaataaatatagaaaagcttatagaatagagatataaagaaagaaaatatttctgggcagctatgtgtctgtgttttaagttatgtctcaatacgagtcaaaaagttaaaaaatattaaaaagtttgtaaagtaaaaaagttacagtatgtgtgtataactatgtaacaaagtaaggttaatttattattgaagaaagaaaattatttttcataaatttagcgtaacttaagtgtacagtgtttatataaaatctacagtagtatagaatggtgttctaggccttcacattcaatcaccactaattcactgactcacccaaaagagcaacttccagtcctgcaagctcccttcatggtgattgctcaatatatgtgtactgtttttatcttttgtaccatatttttattattttttctatgtttagatacacaaatacttataattatgttacaattgcctacatcagtcagtacagtaacatgttgcacaagtctatagcctgaggaataagctgtaccatataggtgtgtagtaggctatgtaccccaggtttgtattagtacactctatgaggtttgtgctacaaaattgcctaatgatataattctcagaacatatctttatcattacattaagtgacacatgactgtatttgtatggtgttgttgagtttacaaaatgctttcatatactaaatcctatctgatcttctcaagtgttactgcctattggcagcctccaaatattatgattctcatttgaaattacacatgtagttataataaatctaagactagaactcatcactttgtactcctagttcaatggtttttttttccataacagcttgctgcttctacttgtaatcaatatcagcaacttcagatgaaaataatgtgagcctttttcaatacaaaaggatttatttctagttgaaattatatattttcatggattttagataaaatatttattttggcaaacacaccaatacagtagtttcattggttctttaattagtgttaatattaagaaaataaaattattcacttctgatatagtgaagtcaagaagtgattcaaatatattacttttacatgattcacaattataattgtattatttatacctatggttgcataataaatatggcttaagttatctgaaataattattttgtgcttattatggaatataaatctaatggacaaagctttggggattacaaagttcagaaagagaactgcatttgaaatacatcttaatccactcaacagatatttgttgagtgcgtgctatatgcctgtcagttttctatgtgctgaaaatacagctgtaaataagcaagacagagccttgtctgagacaaagaaatttagattaagtagagggagtgggggagaccataaaacaagtaaaaagtaatcacaatatatcaagatgattagatagtacaagatttgagggttggaaagcagggtgcaagcacttctgaaacaaccgttaagtgactgtttatgtaattctagagtaggcaattaaaaactagactgaggggagtgaaggaaggacaacttggaaggcaaggtcctggtgatctaataattgttacccttaatctttatctgtgtgaatatctgtgtattagtcaggtttctctagagggatggaactaataggatggaagtatatataaaaaggagttgattaaggagtattggctcatacagtcacaaggtgaggtccctcaataggctgtctgcaagctgaggagcaaggaagccagttggagatccgaaacctcaaaggtaagaaagccaacagtgcagccttcagtctgcggtcaaaggtccaagagtcccaaagctgaagaacttggagtccgatgttagagggcaggaagtggatgcacgggagaaagatgcaggctgggagactaaaccagtctagtctttccccattcttctgcctgcttttattctggccacactggcagctgattagatgttgtccagccagattgagggtgggtctgcctctcccagtccactggctcaaatgttaatctcctttggtaacaccctcacagacacacccaggaacaatattttgcatccttcaatccaatcaagttgacacacaatattaaccatcacattttgtatatgagcttttttcttatctatagtaatataaaatggtaaaatggttctaaactttgagtcttgtaatagtttgtaattcttatttcaaagtagaccaaactgggttatcagtttttgtgtgtatagtagtgatttcttcttgtgagatcttgcttatctgttaagcattataaaacttatctgtgtttttattcattaaacatatatttttgagggtctgctatattctgcattaaagtaagtggaaggaatacaacagtgaacaagacaaacatatttccagcttacttagagcttttatctacatatatttatcactatttttcactgctgactacattttgctacaaattcagttagtgtgaggggaaacataaacttggccaagttattattttcctaggagttttatatataggagaaatcaagttggtggtcgttctttttcttacttttcaatatcacgagtcctaaactgtcaaggtaagttacctttatctatattcctttttgcttttaaatcaaggtttgagatacttgtatagaggatcatctgccagtttttcatcaggactgccttctcctatctttctccttcatcctttcctctcttacagtaaatttccctctccaagtgtagtcatgccttcctctgactcaacattccatcttctgccagctcctgcctacttcttagagagtagacaggtgtgatatgaagcaatgtgatggctagatggcaggtacttgtcagcaagaaaatgataactaaaacaaaaacttttttgtgattcttttgagcctgttctcacttgttgtcttgatgacaaataattttattcagggaaataatatctgttagtgggtgtggatgtgcttcggcatctatacttttattcaggcctttcttgttacctcaatctcataggaaatgaggaaggcagtggcacaagctaaagacatcaagattctgaaaactaagagaagtagacaatttcacctgtcctgacactataacaccatattaaataacacattgaagaggtagcatcatgtggtaaaaagaacactgagttagaaattagaacacctgggttctatcactagctgtatgacctttggaaaacaacttaaccctttgaatctcaatttttttttttacctagaatgtaaaataataacctgctttaagtatatcataggatttttctgtaaactaggggcaagaaatattatgtgaactataaggcacagcacaaattaagatgacattatttcaggacttgaaccatgaaaacccaggtcaaatctggtagaaaaaaacaaaataaagccagggcaaaaaagtgaagctctagtttattctgctctttggctttaattttttccagctaccattttatccatcatctgtcttcttcatcatcattcattttcattttcataaagttttcctctccctttctcatccttctcatctttctctctaaatccttaaactagtgagttccatttcagaattttcctctcttatttctctatttacctccggtgtggccataaatttctaaaacaaaataaatttaaattaattttaatttttttaaatgtcatatgatagatgctgaaggaaaccttacccaaaataaaaaagcactacaatatagcatctcagatagactggaaatgagagcgtgtggggtttcacttaactgtcccttgtacagcagggacttcttttccccacagggacttctacatattgggtaatagtgatactggccaggtttatacaattgctgagacagctttcatctttggaactggatgctatggttagatgctcttcagattttccagaaaatcagcagaatttcttaatacttcgctggttccttcttgataagagcagcttaagataaaaaggtaaattagtagtgagttcctttctgtgttgccaaaatcagttttgattgcgtgagaatgggcttgaaagtgagatgtattggcttttagacctgttttcaccatttatattatgagtcatgtgatggttatcaaatcactttaacctctggtaaggttaacctcttaatcttacttaacaaggaattttgatgctcaaaacatatataaacaaacgtattattattagagcctatagagcttaatgtttaagagtggagcctccagggctactctgcctaggtttgaaaccaactgtgaacttattggctgtgtgaccttaggtacttagcatctcttgccacagtacagctaaaagtagtaagagtccaggattatgagactttcatgtgctatttcatgtaaagtgctgagaacaattcctggtatatagcaagcattcaataaatgttagctgctaatattttttatttatcatatggacatatggctagagatgggtgtgtgtttgtaaagaagtttgagtcggcagatactttggtcttgctatttatgtccagtggtagaagtggagaagaagacacccaaatatcctaagaattcaaggacaagctacttcacttatccacttgtcactgaattcatgttggaaatatcagatttgaattcttccaatattcagagtttcgttaatggaaatatttcaaaattgtaccaattgcagatactactcttagaagtttaagacactgcatgatctgggctcaggggctcatgcctataatcccagcactttgggaggccaaggtgagaggatcacttaagcccagtaattcgagaccaggcctggcaacatagtggaccctatttctacaaaaaataaaaataaataataaaaaataaattcactgtagtcccagatacttgggaggctgaggtgggaggatcacttgggcccaggagttggaggctgcaataatcatgatggcacactgcacattagcctcaatgacagagtgatatcctgtctcaaaaaaaaaaaaaaaaaaaaaagacactggagtaatcttcctagagtattgaagcaattgaaatccctgatttttaccattatattctctggcctttcttcttacaatttctttttgtatcctgtgaacaagggcaggttttcatttattgcttttatatttggagaaaccaatacacaaagttttttttttgtttgtttttgtttttaatacacaaggccagactgaacaaagtcctggtggaatcatagtctctacctttctgtctctctggcctatgccacgtttctcaatatcagtttaaatcaattcctttttttatactacgcaaaagcataaatatgctatagcaaggccttatttatcttttcagagtttggagtttaggaaacaactattgattttaaagaaaaaatgaatagtctactgatatccatgagcataataattcatggaaaggacataaatatcatatcttagatgtttacaatttacattgccactgacttccactcacctgttttaaatgtgagactcctggatcccttctgtcatctatttcttgttccacaactgagacttagataatgtttggagtcagatgtaaattaaaccttcatattataaatattatcaagtgtaggtactttactgaggaatacatgggtacataaagtcatatatttttacataacaaaaatttcctttcttgccaatttcatatgaattagcatcctaatgagagttttccatgtaataatagatctgtcaggctggtcttcataaattggtaaacaggctggcctttctgtattagctggcttgggctaccataacaaagtaccacggtttgcatggcttagacaacagaaatttaattttttcacacttccgcaggctgtgagttcaacatccaggtgtcagaaggttttgtttcataagagtcctctcttttgctatcagatggctgccttcttactttatctttacatagccttttctctgcaaatgcatcccaaatgtctatccttttttctataaggacaccagcccatattggattagggtcacacccaagttgtaacttaacttttaattctaactgcctaattttaacttaatcacctctattaaaaatcttatctccaaaatacagctgcattttaagattttagaggttgggacttcaatgtatgaattttaggagagcatgattcagtctgtaacacttacataatgagagagcagagcaagtaaggtctctattgttcattcgttttgcttttatttaaagaggtaattccttgatttatcacaaagggtgatttgtcatctaatgaaggcagtatgatgtagcagaaggagcacaggcattagggtcagacatatcagaatttgagtgcattattgcaggcaagttattttacctctcagagccctaatatgtcatcttcaaaatggagataataccatcctgctcatttgctctgagaattagaagtaattgcactttaccctttgccaactatatcaatatgtatatgtgtgggtgtctatgtctcttatcattatattattcatattaatatcacagtttccctcgagggcaagacaaaaggttttttaaaaatctgctagtatattttagtctaaattgaacttttactggtcaacttactagtccctgctttcatatttaatagtgtttttattgctagtttatttaccattttctcaagaacaaaaatactttaacttttaatttttacaaatgtatgtattttatatatggtaagtgtttataatgttgcatatacatgtgtattatagtaacaggatttatgttggggcctaaatatttaaagcaaagtgtgcttcatgattactaaagacttttttttttacattgttgaatttttaagttacctacttaattgaaaaactctgataaaatattcactcatttttggacttcaaaataagaaaatggatacaaacagatatatcgatgagcataataattcacggaaaggacataaataccatatcttagatgtttacaatttacattgcaactgacttccactcacctgttttaaatgtgagactcctggatcccttctgtcatctatttcttgttccacaactgagacttagataatgtttggagtcagatgtagattaaaccttcatattataaatattatcaagtgtaggtactttactgaggtaagtataatatcaagcaaaggtaagaggctaagcaatgtaaaggctggaagaaaagacaaagaaggattcatgaagtattttgcaaaatatttaattttatgtgcatggagcttttcctccctttgtgcctatccacttagttctattctttaattcctgtctcttacttaattcaagacttacctcctttcatttcctaatacctttattcctctctgagcattcctttatcttttcatactatttgattcctttgtatttatatgaataatttcaagttaatcagggtaagtaagaataatattttccacttcttgtgttttgaacctcttaatagtgatatatactgtaggtatttggcttattaattcattaccatctgatataataaaaattattcatttgtttttgtcagtcttccatactaaaatataagttctgtgagagcaggactttgttggtcttactcataattgtgtcacagaatctagagtagtgcctaagaaaaactaggcactcaagacaagcacctgaaatgagccaggtgctgtgcagggtgatggtaataaagggatgaatgagactgataaagcccccactctcacgattttatattatagtgtagaaaaataggaatataaatactatgctattagttaagataactagtctgaagaaaaagtagggtgaaaagatggagcgtgggatgatgaggtgatgttttggataaggtgatggggaaggcctctcagaagtgatatttgagcagatacctgaataaagggagtatctgagaattggagaggtcaagtcattatgacaaaggtagcagcaactacaaaggctgtgagacaggaataaattcagaatgttcaacagaaagaaagcaaataaaggaacacaaggaaacagttggaagagacaagtctggagtgagtaacaggggccaaatcatgtagggccatatagtcatctggagaggttagattttattttgactgtactaggaatcccctgaattaattaataaatgaataagtgtgtcaatgatgcctaaatatggtgtgattccagtacatatactcagataaattaattgattaattgctataatatcattttctacatcctaatcacaccatctatcaaaatccaaaagaaatctgaccatttaatatgaatcaagctcaagtgccaggctcgttggagcaaatgatgagacaggcagagcaactgagcgtgtggctaaatgcaggtccattacctggttctgtcaaagcaggcaaggacaccagtggaggtgaagcagaaatacaccagatgatgatgggcttcggaacagctatgggtgtggcagtaaatatctctagagtggataaacttactctgaaaactttatttccctcacttttctttttcattgctcagcacatctctgttaacacttccttggaggctacattactattctggaggaaaagcttttcaatagaccaactgcattccaagtattttagctgagaaggagtacttactgaggttaaccatgcagactctataagcagactgtttttgaagtcacctgggtgaccttgggcaagttaaattatcattgccagcttccacattgatagatagggatagtagtaataatctgcataataccattatgaaaattaaatgagataactcatttaaagcactagagttcctggtgtatgatcattgttcaagaaacataagcttttcttattataactaagaaaaaatgtaattttcttggcattcagctttattatgattacttctacaagtttctaaaagttaagttgggattagccactttctgagaaagaaaagtatctttctattctcactttagtggttcaggacaaagttttattgcaacagaagccataaatgtatcccaaaacagtaacacatagcttgggggtaatgtggaattatagaaagatcttgaggtttgaacccagaagctcagctacctgctttatggatgagcatttagaaattatttgagctctctgttcttcatgaccttggattcaaactgagagtaataatagtgaccctcttgcaaggtttttctagaattaaaagtgattatgtacataaatatcccttaaaacctttatagccttgttcaaatgttagttatttgttattaaagtttttgagccattcaatgttgatcaaaaaaaaaggtttaagatgaaaaagcacatcgttctggcatttgctttctgaagtagaagtaaaatattgtttctctattaagattgctagagcttgatgtcattggttttctggtttatgtatgtttttgttatttttaccagaaataaagttttaattaaaaaaaaaacagagaaaactctattgggtctgatattctcattttcaagatgttgttttctaacatgaagtttcaagaaaatgagagagaaaagctgaagggttacagggttacctgcatttcacaaaagcaaccattttggtagggataacttgaaaaaaaaattctagatatcatattcttgacattagtttggcaagcatatagcacagatgtggcagagagaacattaaggctaaatttataatattaatctgttgtcatcagtatacaaataaaattaaacccacattgacagataaagttagtaaagggagatctgtgtcttagaaaggagcaaaggcctgagaacataaactctcatgacacctgagacaaaatggtgagtgtcaaagtctgggacaccaactgggcattctctacattgcaatttttacttgactaaaggttctgaccaaagatataatgtttctgttcaaaccgagaatctaagcatctgatggaagcagctgtgagatctatgaaagcctctgcaagccttctcagctgcatctccctggagtctcacatggctttcacaagtgacattccatgactgtgccacagaccaaaacaaaccagaaatctacacgcaagaagcttttggaaaactggaggaagccaactcctacatccccaaagtggaacttttaaaagcagggagaaataaaagaaaaggcaaagaagttttttttaagctgacactgctagaaccattatctatccatgtcagaagaagcatttagaatccatctttctatcattattaatttattaaagaagtgcaaaaaataaatttatttaataagcaacataagatgacagaaatgcttcacagagcctatgacttcatagctttaacatagaaatcacattctcattgtatctttccacctgagaacttgcccataaatcatcctttactttccctggttctttagatgcttctgtttagatttttctccctctgaagaaacaaataacaaaacaccatgattatttccctttatcttaaaatacttcccttgttactcttgagctaacacctcattttttgaaacactttatagaaaagtcttttccacaagatggtctacacctgctgcctcccctctctccccaccttgcctggatgtgacttcctcctctggctcctagttcccaggaccttgtcctggctgtttcttcctgaacttctttctgttacatatggcccttttgactacctatctttcttaaaattctctattgattatttccaacttttttttatctctccctattcttattttctctccctccttctaattttctctgctttctttgattgttttgtttcctaactcctaaaagtgcacatgttctagagttctgggttttgcttcattctcttctatatacttacattttattgattcaaaatatcaaaagtatatatttttatcttccttatatgcctgtgctcttaacgtcaggcactgtcagcatcactgctctcttgtctgttccaggattataaccacatgggtctcaatgttattaggtctatcctaaattttgtctctccttccatgaaatttcttttataacagaattttcattatgaccctatttcctccctgaatggactatttcaactacctccaggatattcctacccctttctaatccgacctatcatttcatcaaacttaacatatcttctgttgtctacccttccatttaaaatgatacatgttaagttttccagaaatatggcatcaccatcactactcagacatcttatccaggaaaaactgagctcttctctatagctctttgtattgtaaatgatgttcagattgtgccataggacaccattcctgcatgccagcttgcctgccagtgtgatttgcagtccttcctcagtgttctacagaaccagaagttgaagtcactcttatcttgaagatatattgtttttgctcattcacaaatgtttaatgaggctatgttttggtcacaaataccctaatgttgataggcaagttgtctcataaaaatgatgttttaggtttccatttggcttttcaatattaaggacaattctgagattgaactaatatttaattgagaagttatctatggtatctaggaagggttactaaaacctctatacttttctatatgctgaagtggatcctgactgtctttcctcttatatttagggcattaacacttaaccagttgcattattccatttattataaattctacattccaatctgtactacccactccacttgaaagagagagagagacggagagagagagacagagttttcctctgcttgtctcaaaattgtcctataaaccacaacttgcacctgcaatattaatagacttttcacaggtagactcgaatgtattcttccatatacctaaataacacagtcaagtgtcctaattgagatttcaagtaatatttagaactaagttaatctcccacagatagttgagggttgactatgtaggtagctgaatttttatgaacaacatttcttataactactgaataaagaaaagctgggtataagaacagagggcatttgagaaatcagatactttattggcagctaccagaaataagtacctactggcttcaacttccctggttgaaaaagtgataaattccacagaagcctgaggagttgccagaagaaaggctttctggcagagcacgcaggatgtgatcaaatgctttagcagaacgttggagttacatgacctttaacagtaatagccaagtaataaattagtctccccagctgctagttcataatcataacagcaaatattatgtgaaaattaaaaccatggcagatagtagtcatggtaacataacatagtgatcacagccattaaaggatagagtactgaggtctgagagaaactcagttaagaatacagatatttgatttgaaaaaaacaaacaaaaaagctacttttgaaattagcacagcataatgcagagaggttgtgaaaacagttttaaatcataccttaatcctggaaagtacaacggcattgcctggtacatcagatcattactgtggttttattatcattatcattgagtaagcttttagcaactacaccttgttataacccattcatcagcaaaacaggcattgccaggattgagtggtgaccttggtttcaggggcaaataataacagagccctttatcttgttcttctttcctttattccttctttctattagtctctccattgtttttgttttttttttctcttacccatatttaattatactaaggcttcagacatgctatgaattattggagttggtaagaagtcatatcattgtttcttaaaagctctcaatattgcaccatcatccacaagacaaaggcaagtcttgaaaacgtgaccctcaagattctttagttggtccctgcccttttctgcagccacaatactttctgcttcctgcctcacacattattctctgtaacatctacttactctcatgtatcattacatctttcttctaaactaacaaatatgcataatccgcacaaactgagcctcatttgccaaagaccaggaaattcttttgaatctcatggtttaattgatttcaattggccactaaaatttcgtctatgagtaaatctagtgatccttctgctcttatgtacagaagccaagaggtctgctgctagatttgtatatacgtgtgtcttatttcacttcagatttttcatttgagagtgttcttagtcatccttaagataattaacagctttgataaaaggaacaaagctagcattttttttttaacaatcccaaagctgtgccatgaacacatttagtttttaataactggtatttaccaactgactggctgaccagtgatgcactaagaataagcactaacctttcttctggatacattaacttaaagtttcaaagcctctctgagacttggcatggctttcaagcctaaatgttttgtgtaaaatataaaaagcccaaagtcctcaaaatgtttttctctttccatgaagcaaagtgtttcctttggacattatatttttttattgatacttaaatcacattttttttcctgcaacactaataaaaacgattatgttgccaaacattaaaaagcccaaagtatttaaagacctgaataaccatacaacattgaaccatatatgtgccaatatggcaattgagtgtcttcagttgtttcttgcttttgagtttggtattctaaggatagtgattaagagccagtctcaaaaatcactcatttggctgagtggttaaggcattggacttaagatccaatggagtagtggctgtgtgggtttaaaccccactactggtatgtttagttttcatccctccactctttccaataccatcatttgaaaaatacatgaagagctgggttcataaaattaatttgccctgctcagttgctttgttcatattcttattttttacaaaacattttatctagaaattaaaagaatcatctcctattgccaccgttaattgttgggttctttttttcttttttttagcaagtcttttaatctctctgaccccgtttccaagactgtaaaattatgcaactgttttaaattgttgtcaatttattttataaccccaatatgagtggacaatgttaagtggcacttaaaagtagatagtaggttgtatgtactttataggattttcaatttctgaaaatcatactgtgcctgttaagacattcctaatgtaaccttcagcaaaaggctggattcattttatattaagttaaaatttttcctgtaatatgctcatacactttttccattaaaagtaaatgctaaataatttgtaaaatgtttagcatattgcaaacccagccaggaataagcttcattaaaatagaactgtgtagctgaaactgaatattgcttaacactcctactatcaaaatattgacttaaaaagctaatgtccattcaatataaggacattttatttaactcaattcacctggggtcctcattgctgcggcatttttctcccctctaagaagatgtcaggagagtttcaaagctactctaaagaaagagaatcatcatgctcagttatactggccctatgaattgaagactgagactgccactgatattgtcttttctgtagaataaaagaccttttttttttttttacctgagaagatagcctcatggttaaaacaaacaaacaacaaacaaatcaaaaaaagtacagtacccagtttcttagtcaattttctatacctacatcagaataccacagactgggtgatttataaataaaagatgtttatttgcctcatggttctggaggctgggaatttcaagaaaatggcactggcctctagtatgggtgatcccatggtgaaatgtgggaggcagaagctattgtgcaagagagggcaaactcttgggccaaacatatctttttatcaggatatgttttactcctgtgataactaactcacttccacaataatagcattaatctcttcatgagggcagaaccctcatgactgaatcatgtaatttttttacattatttttaagagatgagtctcaccttgtcacccaggctggagtacagtggtgtcatcatagctcattgctgcctcaaatttctgatctcaaaggatcctcctgcctcagcctctcaagtacctgggactacaggcatggatcaccacaccaagctaattttttttttttacattgtattagtcagggttctctagagggacagaactaattaaaatatatatagagagagaataatatatataataatggtatatatatatatatatatatatatatatatatgagtttattaagtattaactcacactatcataaggtcccacaataggtcatctgcaggctgaggagcaaggacagccactttgagttccaaaattgaagaacttggagtctgatgtttgagggcaggaagcatgcggaatgggagaaagatgtaggctgggaagctagtccagtctctcttttctcatttttctgcctgcttatattctagctgcgctggcaactgattagattgtgcccacccagattaagagtgggcctccctttccccgcccactgactcaaatgttaatctcctttggcaatgccctcacagacacatccaggatcaatactttgtattcttcaattcagtcaaattgacactcagtattaaccatcacaagtccaccctttgtcaacttgaacccatacacacctcctgagattatacataaccttcagataaagagaataataaggtcataattatgtctaacataatacaactatccttcgtacaaccagaaacgcaccaatccccaactcaaatattattacctaacattaacaatacttaaatgatgatgtgaagtcaataaatcttatgtcacatgataaaaaagaaaagaaattaaatgaagaaggaaacaaaagaaggagaaaatactcatgagagttacagtcctcgtttctgcagctggtcatgtggtcatagctggtattgatgactaccttctactacccattctgtattccctttgcctttagcaaccacctcagcaggttgtgattatttttcctggtggagtgacccaaactttctttcttgaagggtctgggtcatttgtagtcctggattgggcttttgtagttttctattgaccttaatcacagggcatgttaataccaagagacaccctaaaggatctcctgtattccatgcatactcttcctgacctccactgtggagtagtagactgatttcatcttgatagtctaggtcattcacgccagccaacactgttactcccttctaagcctgttgacttaaaggtaggaggagcccaaagtcttaacttccagtctaatggaattgttgtgtctcctgggggcaatgttcctccctctggaactaagacctctaggccagcagaatgtaatgtcgcaggaatgggaagcaaaaaaatttgctagtggatcactaggggagatggtgagtggtgccacttccacttccatcccttgattctggaccccactcaaaactggcagccttttgggtcagttgataaatgtgccagagtaacaaacccaaatgaggaatgtgtttcctccaaaatccaaatagcccccctaggcattgtgcctttttcttggttataggaggggccaaatgcagcaacttatccttcaccttagaaggaatatctcaacagactccacaccactggatccctagaaattttactgaggtagaaggtgcctgaattttagtgaatcctgtctataagagaaacagtaccatatattggatgctgattcagagcatacatggccttctggagaacttttccccagccctgcaaagtattgtcacatagttagcattgtaattgtggacttcgaaaggccattccccttttctatctatccagctgcttcaagatgatggggaacatggtaagatcagtgaattccatgagcgtgagcctgttgcctcacttttttagccatgaagtgagttccttggtcagaggcaatgttgtgtggtataccatgacagtggataaggcattctgtgagtccacagatggtagtcttggcagaagcactgcatggagaataggcaaacccagtggggacaaatctctgccctttccatgatgaaagaggtccaatataatcaacctgccaccaggtagttggctgatcacccaaggaatgatgccatatcgagggctcggcgttggtctctgccactggcaaattgggcactcagcagtggtcatagccaggtcagccttggtaagtgttgaccatgttgctgagcccatgcgtaacctccattcctgccaccatggccacattgttcatgggcccattgggcaataacaggggtggctggggaaagaggctgagtgatgtccagagaacgggtcattttatccacttgattatcaaaatcctcctctgctgaggtcacccggtggtgagcattcatataagatattaatatcttcacagtttttgaccactcagggaagtccaccaacatacctcttccccaaatttctttgtcaccagtgttccaatcatgcttcttccaagtccctgaccattcagccaaaccattggctacagcctatgaatcagtatataattacacatctggccatttccccttccatgcaaagtatataaccaggtgcactgctcgaagttctgcccactgggaagatttcccgtcactgctatccttcagggatgtcctagaaaggggctgtcatgctgcagctgtccactttagggtggtgcctgcatatcgtgcagaaccatctgtgaagcaagccctagtcttttcttcctctgtcaactgatcatagggaactccccatgaggccatcagtgcaggcgaggggagagaaggcagggtggcaggagtggagaccatggccatttgagaaacttcttcatgtaacttacttgtgccttcaggacctgctcaagcccaatcacatatataccacttccatttgatgatggaatggtgctatacataacccattttatggcttgatgggttagaaagcacccagttcatgataagcagttcagttcacagggtaacatgatgacccatggtcaaacattcagtttccaccaaagcgcagtaacaggccaagagttgtctctcaaaaggagattagttatctgcagaagatggcagggccttgctccaaaatcctagaggcctccactgtgatttacctatgaggtcctgccaaaggctccaaacagcatccctatctgccactgacatctcaagcaccattggatctgctggctcgtatggaccaagtggcagaggagtttgcatagcagcctggacctgttgcagaaccttctcctattctggacctcactcaaaactggcggcctttcaggtcacttgctaaatgtgccagagtaacacacccaaacgaggaatatgttgcctccaaaatccaaataggcccactaggcattgtgcctctttcttagttgtgggaggggccaaatgcagcaacttatccttcaccttagaaggaatatctcaacagaccccacaccaataggcccctagaaattttactgaggtagaaggtccctgaattttagtcatatttatttcccatcctctggcacccaaatgtctcaccagtaagtccagtgtgtttgctacttcttgctcactggatccaatcaacataatgtcatcaatgtaatggaccagtgtgatatcttgtggaagcaaaaagcaattgcagtctctctgaataagattatgacacaaagctggagagttgatacacccctgaggtaggacagtaaaggagtattgctggccttgccagctgaaggcaaattgcttctggtgggccttatggacataaatggagaaataggcatttgccaagtcaatggctacataccaggtaccagatgttctttggttctccacatatggtcaaagctattatgtatagagtcactaaacttcttgcctctcgacacgagggatgaatcaggataaatcaaattcatttattttgcataactctctaaacagttcatgccaaggactatcagtgttctccatactattagaagaagagtccttagtattttgaggtctaatcatattaagcagccaactccagaaaccccaaaaccaatgaaagaactccatccttaatactctgctcctctagaaccactcctgctaccaaaatctgtattaatcagggttctctagagggacagaactaattgaatatatgtatatagatacacacacacactcatatatatcatatattaatatatatcatatatatatatatatatataaaggggagtttattaaatattaactcatgatcacaaggtcccacaataggtcatctgcagactgaggagcaaggagagccagtttgagttccaaaactgaagaacttggagtctgatgttcaagggcagggagcatccagcatgggagaaagatgtaggcctggaggctaggccagtctctcttttcacatttctctgcctacttcatattctagctgtcatggcaactgattagactgtgcctatccagattaacggtgggtctgtctttccccgcctacggactcaaatgttaatctcctttggcaacgccctcacagacacatccaggatcactactttgtattcttcaattcaatcaagttgacactcgataataaccatcacatacattttaattttttgtagagatggggtcctactgggtggtctaaaactcctaggctcaagtgatctcctgccttgctttcccaaagtgttgggaatgcagacataagccatcacacccagccaatgacttaatcatttcttaaaggtcccatctctcaacactgttaaaatggcaaataaatttcaacatgcgttttggaggggacgttcaaaccatagcacccagcttccctgccattttaatctgcctagtcaatgaaatataagcagaacggccaggcatggtggctcacgcctgtaatcccagcactttgggaggccgaggctggcggatcacgaggtcaggagatcgagacaatcctggctaacacggtgaaaccccgtctctaccaaaaatacaaaaaaaaaaaaattaaccaggcgtggtggcaggcacctgtagtcccagctacgcgggaggctgaggcaggagaatggcctgaacccgggaggcagagcttgcagtgagctgagatcacgccactgcactccagcctgggcgagagagagagactccgtctcaaaagaaaaaaaagaaatataagcagaagttgtgtatgtgactttcaggacatattcttaagaaaagggagaaagttctctttgttttatttttcactgtttgctggaaggaaggtcggcaacctatagctgggtcagtcatcttggggcctgaattggaggtcatgcgtgatagagccaataaaagaaagggaatctatacccctgatgcagtggaatatcatacaagctgtgggccatctttcttcagattgtagatgaaagacaataagatttgggcttttctgccaaacttaatcctatatatctttaatgtgtttgtttgcgtgtgtgtgcatctagtgccaagtaacatctaaaaaagttcctgtattataatatttaatgtgttacaagaacactatcaggtagaaaaatatcataaaaaatgtaacaactgagcttaaagaggccaactctaacaagtagaagccctggaccttccctgtcactatgtccttatcttcctctcatttatattatataagatatttattagtttatattatcatcttcttctcactcaaatgtatggccagagacttttacagctatattcccaggacctaaaacttgacttggaatattatttgttgaacacaagaatagacgactccatacccatctccaaaccacaaaattatactgctatccactgtttcatctttcataaccaattctatatggattacaactgtgtgcattacaatcaattctgtatggattacaaccacatgtattttacatagtctagcatttttgattataaaataaatgcttagatattacataattcagagaaatgtacagagagataagctcaagtttatactttgttatttgatttagcagactgacttttattctcaaatttataagaagtttaatattttctgaattccataaattctgatgcaagaacataattaattttcagtattagcataatgaatttgtaggaaatcaaataaggttactgtaacctcactttgaacagtacagcattcgaaaaaacatcaaaactcatttttgttgcttatttgcctgtgaaacgtgttttatgatggccttttctaatattgccctctaattagctttcctgaatttgtgaatacataaatcacacagaactacattttaaaaaattaaaatggaaacacaagttcaattagcctgaaataggagaaacataagactgtttaagagtatttcagaccgcactatcgagttcccattttatgtggagcactgaatgtttttaaagatgacccaataaaagagctaaattacacaattttcaaaaagattttaaggttaaagatgattattcattgtattttttccataaaagtgttattttaaaagaaaaaaaaaataaaggatccccagtagaaactgaaacatgaccttttcttttattcctccagacattcatcaaattgcactgcttgattgtcctgttccttccttgatttggtaggcagaatatttgaaatatttaattggccagttattcctatctaaaatcccattgcagacaatgaaactactggtttggtaagaaaacttaatgcgttagaaaagaggaatgggtagtgtttgattaagggtctttgcatgtaacctttatcagcaagtcagaaccagctttttatcttgtttattgtagaactttctcgatctgtgggcctgtgatacctcttttcagcagtagaaaggtgataggaggtagcagacattattttagtttaaagtggataaagaggagtgataggaaaaaatattatcttttgcaaggaagctgatgcatagcttgacaagtgttcctgtaatatgatcccataatgtttcagtttagcccacaaatctaatgagatacattagtgcggctatagatgaagtattcattttataaagacatcactttattttgtgaagactgtgaatacttagcacaaaattaaagtgcatgcacatgaacaaattcaagtacttgttcatatctcactctccccacttggcttcagaaatctttcaaatgaatgtaattttcttccctataaattctagaaatgagaacattcaacaaataggagaattagtttgcacttcactctcacattatatttaccttaagggtaacctacctatttccctggttccaaagatgctttgttccaaaaatcacaaatgtaaagagaaaactggtatgtgcattgcttcagtaaaccatgactggcaatcattaaataacttttgcatgattcaggattatacctgtattttaattttagaaattaatatttgctatacattggcttttgggtaaggaaattctcatggagaacattctcttgctatatagcatagtcccatgggtttcctgacattttgaaaactatttttccatatttatcacaggctttatttagactccatctctagcaaaagtacagacagtacaacatgcgttttacttgatacactcctggctccttcctcctacttctattttttcatatctatttttgtttaatattatttttatcttttattgtacatgttcaaatgccaccttaaatctttctgtaactggaagggtaaagctagattagatagatggatcaataaatagattgatagagagaatgtgatacagcatttactattttactatattccaagtttgtacctcctttgctcaacgaaccctcatttaccacccaatatgttcaaagttatatattgtgattccaaatagaataatatggtctctgatgttaaggacctaaaaattgagtaggggagaaagtgacctcaataactaaccactatacaatatgctatttataaatgacatataaaaatagctatcagaacacaagcagccctgggcatccctgggtgtaaaatattaaggaaagttttacagagaagagggtatttgacctgaactggagaagaatatcccatgcaggggtagaggagaggaacaaacagcattagcaaaggcacacaatgatggacaggaatatgcaggaggaatttgaaaactcgttagttccctttttgttacaattgtcagttggaagtggtgtcagctgggtgtggtgctaccctgaggcatcagcttagtaatacatgactatatgaggtacctgatatggcttttcagcagcccttgagtattgtagtcagtgctgcttgacccactgtagagttaaagcatcctccgtctctgctgattcaggtctattttattttcctagcaggcaaaacagactgcaaaacatttgggggacaggtactatattaaagagctatgttttattaacagaagaaatttctggcaaagatcaaccaagaaagtgactaaaacaacaaccagactggtgattttagctgtaaagactagatcccccaaatctacttaggtttaaaattacggtgagcagagtcttgttggactgtggatatgtgactttgaagcatgctgggtatcaggagggaataagaagttttctagccctaaaagaaatcccccacaattgcccatgtctcagtttctgtcaggttggtgcaaacgtaattgtggtttttaccattaaaagtaatggcaaaaaccacaattacatttgcaccaacctaattttaaaaagctcaaattcttaaaagaaaatacatcttcctaaaatatactttttaagttacaaattgaaaaagtagggaaacctgggatcagagctaacatcatctagtgaggaacaagacctacgcatagcatatacttcctgatacgatattccaagaaaggcaaaacatcactctccatctactcttgggaaaacacatgccgacctaaattgagggacattccacaaaataagtggtaaatactcttcaaaattgtaaaagtcatgaaagacaaagactgagaactgtcccagattggacattgaggagataacatggcaatgcagtacagaaccctgcagtagatgcagtgtcacaaaaaggacattagagatacgattggattttgaaggtttaaagattagttaatagtatgtgctaattttaactttataacattaattatactgaggttatgccaaattagcatagaagaagagctgagtgaaggggatatctgtgtactatttttacattttatgtctaaaattttttcaaaataaaatgttaaaaagaaaatatatgttctagttcccattttctttttttcttagttgtagctttaaaaaagaaagaaaagatgacaaaatgaacagaaacgtgtgtgtgtgtgtgtgtgtgtgtgtgtgtagatagatgtagatagatatatctctatagataattcagtccttttatgaaatatccattgctttcaaaagtgaagtgttttcaggaaaatattaactaaactcaaccttttttgcttgaataaagaattataagacctataagagatataatgtagcctatcccacaattctcattagagacatttcaaagacttcggggacaggttaaaaaaaaaatcatccaaagcctattagttgtggctttgtccattctctcacaataatattcttacagctgacttaaagatctcctcccttggttaaaaccaaatttctctggcttgttagaggaggagaagagtgggtggttgtcttccacacagtgaaataaatttcttaggccctaataatcctcaaactggatgttgctaactcctttaattcttttccacagctgacatagatagttaatataaattcaaatctcctatctaccttgactactttctaggacacaaagatggtttttcgtcttccattgggataggagattataatctaaataagtgtgtatcctacacagcatattttttggctgctactaaatactgactttattttaaatattataatggttttggtggcagagtatcattttcaccttcccaaaatcctagtaattgcctgaaaataggtaggcactttatttgttaagtggatggatggatgaaaagctctaggctaaagaatgtacttgattgaaagaccctaataggtctaaacagaactactttccatctctaaagactattgcttggggccacttgcatttgaatacctagaattagtgagaaaatttacctaagactgatttaggatcaaggtttctatcaaaaagccaagtaatgtaatttgaagggcttttaacaccttgttaagggaaaagttacctacaggccctggttgtggttatcagagggtactcctgttgccatcggcccaggagaaaggaagcacaaatgtaaataaggctgaactaaacactgagcaacacccacaggtaaaactaggagtgtgaaaaagtcccgaaccacagaatccactgtgagtgacctgaggagggagagaacactgggctatctccagagcaaagccattccaagaacacagaaaatgaagccccatgggttcagttccagagaaacagaaaaatagcctagagagctctggaaaatctccaaggcagaaagaatcggcttggacagaataaccagaaagaggctgaccattggttgtagagtgacagtgattagctttcagggacatggggtcccagtggtgttattgtctattttaaatggtggtcttcagtggaatgatgaaataatctgtcaatctggataaagagaggaactgcacgcattcaggtttggagatgaagagggcacagagctgcccacacaactctcactcctgaatgctgtcctacctgtaacctgtcttgtccagaaactgggaaggggcttattgaggaaaaagggaaaagacatttaggaggcatgattcttattcttgaagcaataggggtatataaatcatcatgtttcctttcagccactctggagcaagtccaactgaatgaatgtgagaaaagggaccttcagtttctttgagtcctgagtgggtggcgcagatgtctcacccaaaagagtcgtaaataaaggtgaatctggagacaagaaaatgtggtcctttttaatagtcggtcatttggaggctgagctgaggtcctggcagtagtcaccaagaagcagagagttcttatcagtacttgtactgaaggaaaggtctgagatactgccctttttaccccaagcctctaagataaatctgtataatgattgcaaataaaacttgtatgggagaaaaaaaagatttttatgatgtgataggcaacatagaataaaactggcaaaatctggccttgagcatctgcttttctgccccttatttctgagtgttgcagtcataaattatctatagttcagtaacatggctggtaagtaaggctgcgtgatatagcaagaatgcagtgctctgttcaaggtggcctggttgcaaggaaaggaagcagggtgtcgcccagccccatgggctgcagcacatctcaactctggttgggcagggacttagatttacctgaaagatgccatgggagattaataatttgatgtaagcatgttctctcctttgtgctataggatgattaaaaaccctgatttgcttctcttcacagcccctttggcagtcagattgaagagccttctgtccttgagtcctccctgacgtagatctgagagtgagatgtgaactggacagaattaacagtaatgtaactatagcatttttccccagctttttagacagacaggtattcagttttaaaaaaaactaaatgagtatgatacaggtgatgaggagctcgcctcactcttaaacaaggatgcaaagctctcatatctgggaggtcttgagatatacatatttttgcatataacattaacatattctggtgaacatgtaaaagccttaactccagctgacaaaaaaaaaaaaaaaaagaagaagtcaaaacctttcaagcctgccttacattgcaaaaaaagacaaaaaaagaagttgttcttatattaatatgagacctttcctccaaagtggtctataagtatgtacaattgaatatgttgaacccattaacgtcaggactgattctggtaccaaaaggagctactcacattttaaataacagtccaatcttagactctattagtaaattttttccatctataatgtccccctcatatcataattttatataaactgtagcccttggcagattctgtccagtgtggatatataaataggaatcacttcagcctgtactttgacactctgggaagagggagaagaaaagagaaggtgcataaatgtgaacaatagtattttctatattgtcatgtaagatatgaaagaaaacctaattattagggatactaataggataagttactttaatgacatctgcattaacagcctaagagaaatcacacctaactactgtaatatacccagcagactgaaaaagtaagttcttcttgttcctgttctttgtgcttgactttctatagagaatctgtttgtttttataggaggctttgttctgcaagtctggtagcaaaatgagcctaattaggtgaagataccttaggaagagaatgaaagttgtagtcagtagacaaaatcggagccaatgagaatttatggggtcatacacaatggattttctgtacaacaactgagttcttaaatattttctcaaaaactgcatttatttcatggaatatcatcactttcacttgtacctgccataaatttctgtcagtatttctctcatttgtaaaaaggtacagaagccactttagtaatataaaactactgctccacaatgtagttactgtacttcccttcctagggctgttctttaaatctcagtctgtctcttagagtggccacagttaaactctaggacattgaaaatatatagcatagcttaagttagtgaaatttgaacataggtagtttgttcctttatcttgaaattgcaaagatgaaaattgttctgttagtaaagtaaattttatgtgctaccctgagaataaacaatctttgtaccggtctttctcaatgtttcttcactaggaagagtttggaattcctagggttttctgtgtatcctagatagttggctacaaaaattggttgtttatatcctggaacattgtattgatgcctgattctttttggagaacttggcgtcctcttctccagatgaactttatatcagtaacagtcaccatatgacaaccattcttcataaaaccaatcaactaaatatgctagacatttctatgctttaacttaaaaatacacacacacgtatatatatatatatatatatatatatatatacgtgtgtgtgtatataggtatatatgtgtgtgtacatatatacatgtgtatatattcttggctgtaggtaagagaaaaacagagctgaaggacacaaggaacacaactggagttttcaactttgctaaatctttgctaaaagattatgtaactcacaggtaaatgtgcatggtgtccttggttttatgactgaatcagtaagcaaaatttaaagtagtggttgaactacttcagtatctatgtggattattaatgctcacatcttagagaaaacttgagctatgcattcttatcaccaagaaatcagtgtcaaaattcccttacattttacatcctttaccttaaataataatataaactatattgtgctatatgtgtaatgtacattatagtaatgggtctgcagtagtcagaaatgagttataaagacaggagaagcagcctgggttttatattagtgatgctatattaattatgacagagaaggcttttccattataagcctcatttttaagatgcttgaagctttcccacaggaatttttctcatgacagtttttttttcttcttttgcctagtaatgaaaataaggatattggtttttaatgtttttgggagattttctctgagaataaaagtttttttctgtccattagaccatttttttaggtactttgctttctgaaatctcaaaacaaatagctttttaatgaccttttcaaacttgtctccaatgaagaggtttcgtacctttggtgtattaggcaaagcttgatttgcaaataattaaattacaagtattatccaatacttcttctgcaaattgttgtgtctccaaatagcagttagctactgtaccttgcaaataaggagaacttacaattacttggtcagttactaaaaattagccactcctggattatgactgttatgcgtacagtttctgtgcataccaaaaaagaaaccagagctgaaagtagtcattgtactctgatgtggtacatcagaatacaagtgaactttcctaacaaaggagagagcagtagcaggctgaaactgtggcctgtatgatctattgttatttaaaatctcactaagatagaatcacctcattctctgagctcaacagattgagatccactcaggagacacacagttgagatccaaaacaggaaaggccttcactgctcattaaaatgttaattacgccattgagggttcagcgctgcccttcaagaaatttcaaaccacttcccttattaacatattaagaagtaatagttcaaaggagtaacagcatgataggaagatagagtatatatttatttaaatacatggcaatgcatatttctcaagctttttgagaaatggaatgatgcattcttcccctttatcactaaatcactatctacacccctttatcactaaatcactatccacactcctacaatttctgattgggttgtaggtttcagatttcttaattggggttgtcggtggacaagctgtatatttgtctccacaccacacttgagcaaagggactatgtttatcttctaatctatgcaatcccagtgtgcagtactgtccatagcacaaaagagggactaaaacatttatataaattttcaaatgtatgaggttaaagcaaaatttcctattctttaaattatgatagtcattattttaggctgtctaaatcagcatcaaaaaagccttaattttatctacccatacgttcataaaagaatattgccctttcagatcttttattggaatttaaatatcaacttgcactgtatttaggaaatgccatactacaaaattcatttaaagacactccttcctctttgttttcctttcagcatgtgctattattgaggaagtaagcacagacttatattgcttttccactgctactctctggtgtagttgccatgcagctaaaacagtgagtagtctggcaaatgactggctggccaggtgggtgatacagggtgttctggaaccttaggacagtgcttcttctgtgaacgcttgtcaactgaagcagctactcttccctcatttacctaacatcttattgttttataggcagtgtgtaattcatggcctcttacaaaagaggtccttcttcatatttccccaaagccagaagtttatagaaattactagttttgtggaatttcgtatatggttctttttaactatacttctcagggcacttattttaaatactcataattttgaaagaaggtgttcttctgagtggaaggtttccactgataatttcttggtaatggtagtgtttagaagataggaagattacattctttgcatttcatgccagaatatatgaattcttcccttcggtagcatataatttttctgttcatattttactggccacccatgacttaatatgtggtttagctgatcccaaaagatttggttatccagagttccatttaaacttcttaaaatcttaacagtaagaaaaaaagaaattcatggtgaaaatcaattcattaaatttctttatttcttcatgaaatacattaattattttatttctcttaaatttgagtcttccaaatctgggctcaggtattctcctctcaaacctggaaatgttatggtgccaacataagagggataatccttgatggataatcttgttcatgtcacttaacccctctgacatggctttcttgtcaaaaataattgtacatgtgatcatcgtgataatatgttgtatttatatagaactttcaatttgtagagaaattatttttgtccctactaataatgccttgtccatacaaccactaaataaataattgtccgggatattcattatcttgacttttatcaacacgatattcctataaagtggatagagcatgcaactggctaattttataaatgagcacactggatcccaggttaggctggtgatgtcctgatgacagtactctggttgtgtagaagccaagtttcttattatcacatctggaatttaaaagtaaaattcaacttaaagattatatgcaggacaaagatgtttatttcatagatcatatagatcatgtaaaaaggtagaaaaatggcaagctttttgaaactgatcacaaataaatctaaagtaatttcaattagaggaaaaaacattgaaaagaaaatattatctaatatttattgaagccattatttcaaattttgatttggtgaatgtacttatttctattattgagtaggtacaaaacattttcagctggcttttattgaacgagctttttcactttgaacactgcaatgctgaaatattgatttttaaaaaaagaattcaatagtttcaaatgagtgatattgggattgttgcaaaattaatattagtttagtatatatatgattatgaaccacttagtttaaggtgaacagattattttcctagtttacattttaattgaatgcagtttttcatatttctttatttcatttaaaagtgcttacatatagtaatatttcgtgcagccactccacccatctctattttctctctactactaatatttgagttcccaacttgcacatagtacactaaggaagttaaaaaagaaacattgctctaatactgaggactcccattttcaaaattataagaatatcgtttcactcaaatagctgtttatataaatgtccagtgaacccttatttttgcattttgtatgtaggcaatgatgaatcataattttgaagtatgattaactcaagagttaaaatttctgttttttgaaactaaagactctgatatcaaaatcacatattcctggccccatcccagaactaatgaagcagagtttttagtgaattaagcttaacccttaattgatatctcagtttgatgtctcaacagttatttttaagcactatccttccattttggggtagccttgcaggaatgtgctcagatttttaacttagaaagcaagctgacccatgatcccatgccaaaagcatgactcagtcaggtatagccaagccacaccataattataatttcaaaagtaaagaaaggagaaaaaggtgtaaaatataaatagctgtctgtgttagtttggtattattttacataatttttttgaatctctctctctctcttttttttttttttttttttttggcagagtctcactttgtcactcaggggctggtatgcagtggcatgatctcagctcactgcacccttgacctcctggattcaagcgatctttctacattaacctcaaaagtagttgggagtacaggcaggcaccaccatgcccagctaatttttgtatttttagtacagtcaggatttcactatgttgctcaggctggtctcgaactccttgcctcaagtaatctgtccaccatagcctcccaaagtgttaggattacaggtgtgagccattgcacttggcctttttcttttgaatctcaaaagaattttttttttcagattgcagaagtaatatagttacactggaaaaatggagaagtataaaaatataacagagcaaacaataatacctataatttgtcaccctgagataattactcttaattattttttcaatatatatttcatgttttttcatgtgtatttttctaaatgtatcatatttgagattaatcatttttaaaaggtttgtgaagtaaaagccattagagtcaggaagtgagctagttgatattaaattggtgagatcttggatgcactatgttataaattttacaatggtccggtcaaatctctggagtggctttttgtccagatcacttgaaaactagtgtagaaagtaacatatgtttaaatgtgctctattttagttaaataattctgctttttcaaggttgtgcatctcaactgttgcaaattatattaggcgaaaaattggttcctagcccagaccaacagtttttttgaggaaaaaatatacaaacagaatgaattattttatggcttttagattaacaaatgatcaatgttcgaggcattttaaagtattttgaaaagaaatgagagaaaaaataatttaggatcttcccctacctacacccaagaacaaccttggaaatcttttttaatctagttacatacagaactaaaatgtattttgatgttttattaaacacatcacatataattgatccatgaactaatgtatatagcagtactcttcttcagttttattcaaatttccatttctattccctcaaattgtctgttttttaaaatgtctgccgttttttaatggctgaagcaaatgttttgaaattttctgagaaaaaaatacttaaaattacataaattaaactttattcttggattttcttccatctcattgagagcaataatgattttccccttgcaatttcaatagaagatactttctgtctttccttccttttaatattaacactctcatcattattctgaatcaaattataagattattttctcatcatcactacatcctgtcatgatctctgtctcctggactgttttgatctgcattgtaacctgttgggagattgatccccacctcaaagtaaaagcatacttgacaaaaatataattttttgtgctatctgacttgcattcagtcttttgacttttgttgataaactctttgatatcacaagatttctttttttaacttctagcaatctaatttatatctgacccctctgctaaaattattcttcctaaggctcttaatggctcaatggcctcctccatgcccaccatgaccatctcaagcttcatatttttattttcttatttgacctttgatcaatcactttttagtgaaattctctccacttattttctgtgagatattaattactagttttctttcaccatttctgagtactcttcctgtatgttcctaactttggctgtgctctctcactgtgtctagtcctcactgagagaacagggtaaagggaatctgctctggagtcatacttgagctcaattcctggcacaaccctttaccaggtagatgtccttaggaaagtcacaacctgtgggctccatttatttattttaaacataaaatagcaccaccaaagataggcagtccagggcttgcatggctatattacagaaattgagatatccaggcaacttttgcctctaggctgtttcatctgtaaggtcctcaagatcctggatggatgtgggagcttaatttatctccattttcctatagaggaaataacaataatatttaccttggtatttagtgtaagaaattttttaaagtgtgttattcaccacaacacctaacactgactggaccctgaataaatgttagctattttcactagtgtgatgatgatttgcctgttgactaattaatgatggcaggtagcatattttaaccgttaattattaataaatcatgctgtaaagatacttatacatatttataacccagtagattggcttccttaatgttatttcttaccatactcctttctactctcactatttccaatttaaaacaacaacaaaaaaagatgttactggcaataaaactggtgctaccattcttgtaaataatgttcatgacctcaagagtgacatattcttggttttaatgtgtattttatgacacaaaagcagtgacactacacctgtgagataatttccagtgaagctctcgagctctgaaaagtggccaagtagaaatctaatatgtctacacaataacctagcacagcacctgcatcatatttaatgatgaataaatatttgttgaataaatgaatgaatgaatgatgtaggaaactccaactatatcaaatcaaaatctttaacagctatttattcaaccaatatttattaagcacctactatgtgtcaagcagtatgttagaatcaggtaataccaaagtgaacataacaatatacctgtcctcatgatatgtacattctagtgagcaaagatgggcaaaaatcaaatgggaaagtatataatacatcagctgtgataggtgcaatgggcaacaacagatcagagtaagggcaaagggcactttggaaagtgcttgtattgtgtatcagctattttataacaagtcacctcgaattttagtggcttaaaacaacaaccattattatttgatttaaatgttatggcgtagctattaggttgagctcagccagttagtttcatctggtataattaaagaggctgccatctggaagcttaacttggggctggttaattgcgtataacctcactaacatgtctagtggctggtgccagtctctcatcctcagtagggctagcctgagctacctcacataataaagcacttcaagatgataagagtggacaccattaagacctcttgaggcttaggctaacaagtcacacatcatttccactgccttcttttgatcaattcaagtcaccatacatatatccagattcagaggaggaggtaatagactccgtctcttgatgggaagtgttaaatataatttgtagccattttttacctactacagatgggaagttactgatggatagtcagtgataacatctctgataggatgacataaaagcagaagcctacataatgtgaggaaacaggtaatgtgaatatttttgaagagtgcattctgggccaagggaatagctagcacaaaatgccaagaaaggccaataaggagctcagagcagttgggagtggtgggcgaatatatgtgtgttaggagatgaatgtgggaagccaatgagagaccagatagtataattccttgtagaccattgtaaggaccattataagtagacctttgtcttttactctgagtgagatcagaaaaaccattgatagttttcaaaggagtgacatgatttttagtggagtttacataattgtcgacaggatctctctggatttttattgaagttaaacttgagggtaaatggcgagaaacacaatgaagagattatcccaggcaagagatgatggtggcttgaaatagaagggtaggactgacaacattttctgggataatttgtagaactgattaggcagaaaacatattattagattgtgtatagtcatctgtcagcttctctaagaaactaactacattttgttcatgtgtcttctacttcatctggtatttgaaaagcacccactaaatacatattgactggttagtaaagattcaagcctcactgttgaattgaacataatcaccacaggatgctgaaatcctacagagttcatcattaaatgatgtttgaagactgtagcaagtagaagaccctattaagagctattgatactcttcagattacatgtctgctatatgctaaaggactgcaaatgaattacgacaaaaacaatctgtctagatcaaactcagtattaaaagttatccattaaaaggtaaaagatcattacatgggccgggtgtggtggctcacacctgtaatcccagcactttgggaggccaaggcaggtggatcacctgaggtcaggagtttgataccaggctggacaacatggtgaaaccctgtctctactaaaaatacaaaaaatgagccgggtgcagtggcatgtgcctgtaatcccagctactcgggaggctgaggcaggagaattgcttgaacccaggaggcggaggttgcagtgagtcgagattgcaccactgcattccagcctggacaacagagcaagactccatctcaaagaaaaaagaaaaaatcattacatgagctgaacatttattattaagactagtaagtgagaaacagtgtcagggattcaaagtcgacataatatagttctcaaaagcactagtattctcatatggcatgtagagtgttaattttataaatgaaagaaagcaaggtgaacgtatcaactaatattatgatgttgaatggaaagcattaacaggtatagaggagcatgggggaagatctaagtttagagaattcctggaactagctaatttttagataacaaattagaaccttgttgttatggtatgaagaaactgctgttaactccaggcccaacatagtggatgacaactgtcctttctggtgatgggaaagtacctgcttctaaatcttatccaagtgaatgaagtgcatatatatgttttatgttggtgttactctttttatcataaaatatgtgtttacaatattagatctttaaatcttcttataatttcataggacatgttcagtacattctgttttaaaacagattacaataaaagtttagcattaaaattcacctggaaatgaaaaacccagctttgcttctcactctgtgacttaaaacaagtttctaaattcactaaacttcactttctttatctataaaactaagtgtttggaaaagatcagtggttctcaaccctgactgcacactaaaatcatctgaaggacatttgaaaaagtaatatcccaagtcctatcatagggtttaattttcaatgctcttcaggtaattttaatgtacattcagtgttgaaaatcaatgggctagatgatcactaaagttacttctagtaaaacttcctgattttatgattcattgtattttgacatagtaacagctgctgaaaaaacaatgttctcaatatttgcaatgtcttttaaagtagaaattaacgtcgaagagtgttcttgctcaaaattgagaacattttcacatctagactaaaaatccttctatattatgagaataatttataccaaaagccatatatacatcatcatttgggtaaggcatatgcaccaaaagtaatatagatttgcctaaattttagaaattaactattattatgatttggaaagcaattactttctgtcagtacacatacaatgtgagggtagtgtagttagaaattctgtgtaaatttaaaaaaatgctgctacagctattttgattttgaataaatgtattcctaatatcccaagagttaataaaattcctaaagtgtataacttattcataataaataatttacatgctgatttattatgaagagaataaacagttttatagaagactgaagtagaatatctagttttattggtatttggaaagatcaaaagtatgatttcttgaaacagttttgaaatgtgtcactatgaatttttgctatcagtctttttactaaatagcttttcattggagtaagctgataacttttctctttaattttaaatgccagaaaatataaacacatgttttaaaacttcatgaaaccaaaaactcaaccaaatactcagatccaaaaagaaaccatgtagactcctaggaaaccggggaaaggcatcaagtaaatattaagctagaaagtaatagactttgtgtcttatattttcacatcattctgtgtttttgaatatgtacttttgaatacttgggacaggaaggctccttctgttagccaggctaatatggagaagaagaagaggtacagtttacagctaacagctaacatgggtgaatgtaggtgtagtcaacaaagaatgggttgtatggaatttctgcaaacatagttacatttgaaaaccatttgggaaaaaaatgacttaatgcccagataggacactatgaaaagtaaatatgttattttcagtatgatgtacatgcctgcatcatcattctgtttttgcttctgatatcatcagttattcttatatctttaattttcatgtatatttcactgtttttgtttaccctatcgataacaaactagacgccataattaagaataatgcacagatatacatttattatagcatgcaaaactgtgacattggaagaataatgtgactgctggaatacttcacatgttcagaaatcttgccctgtgtagaatggagaagttgttttgcttcacatttgctctgccacatatcaatttgctttacaaggcctccctgaaatcaatcagacatgtgtaccatgctttcaaagaattttttacagtaggaataagctatgaaaagtttgaaaatacagactacacatactatatagtttgtaataatagttatatgtatgctagtgagttaaaaaaaactctcatgagttttatatgatttaaaagtaccaagaggtttaatgaaacaatataaattttatcatcagaatgatatcacacatcttacttatctcttgggagtgatgaaatgcagaacttggtggttacccacccccctcctcacctctcaaggttttctctcctacttacctgctccagattctgctcttcttgtagcagatgcagtattgtgttttatatatcttcttttaaatttggtaaagcacattaagctgtactcactcactcagatgctattgtatgttagtttaatcagataaagtcagtgaggggaatatagttctaaagaatgataaggacagaggtgatgtagcctagagaaagtgtgcatgaaaagggccccagtgagagtagaagcatttcatgcttggagtgagtgaaggactaaaacatgaacatcggcgttacttacttcccagttttgcctggggctcggccaggtcagcaatgcaatcattgcacaaagtaaagtaaatggactcacatttctaaacatgtcatataaaatttacatgatcttcagaatctagcaacatgatattgaatatagacttcatatgtaacagtcaaagtttgttgatgctaacatcatcttgagtaatgaagtctgattacatggatataagtatataactttgtctcataagagactttatttacataaagatttttcttgttaagatattgaattgatttattgggcatagctgcataactgaaaagtgtaagtactggactccacttgaaagcatatgtactgcattaaagtaaagctgccatccagtatgaataatgcagatgttatgttttaaagcatgtcagattctcttaagtgtatctttcttctttaaattttgatcagctgagataaatgcttttcatttggccttaactgtttgtcacaggaagataagagacagagagctaatgaagtaaattgatgtgctgctacagttagggagaattggagtttaatactgttgcagttgataatataactgcttttttaaaaaattggcatggttgcatgacattatgagaaagaaaagagacctaacacattcaaaaatggccaatacttagaagtattggggtaaagttaggtagaatttttatctaactctcttcgaatacagtgcattttcttcttcaaaaaagttgtaattaagagtatattaagtcataaatattaatgatatcaaatcatgaatattaaaaatatattgctggtagataccaaaaaaggatggtgtgaattatattctgtagctcaacttggaagttcaactgtcacaaagaaacctgtctcattgaaatctctctgaaattgcatgcatatttaacccaatagcttcaggcattcagagatggaggaagcaaaatcaaaagcaccatatcaaaattaacatcaagccatgtgtttttctcttagagttttgaagtaatttttaacacagatagtaacttggtttgaaatttaaacacacacacatacaggtttgctagctggataatttccatgcctgggggaggggaggtgacaattggtgcattcagtacagaacacgtgtaatgataataaagttgattggttgagctctatagcattttttttttttctttttctctcttcctgtagtgtagttctgctgggggtggaagggttctcccccatcccccccaccacgaacaagacgtaggttgataccatttttattgttctgctggggtgggaaataaaccatatgctttagcattttaaatggctacaccaaagagaaaattgaaccaggctctcttccctactcctactggactttggggtggggttattcctctgaatgttctagcggacttggggttagcttaatgcttctgccccagggcaaagaagcagttgagggaaagaaatgtcaaggacgtcagaggcgagctggactgagtgaagtgtggagtaggaagcttaggtctgaaacccacccctcccctggataccaggcaaaggcaatgagagtcggaaccagctgatgccgctgctgctgcttcccgtttccagggtgaaattttcacagcagctattctaaaaggaggaaaaatccctaaccagcagcagagaagatcctatcacccaatccaagctatgtaaccttttagtcaggcttttcaaagaaatccgcattttaaaagccagcatttatggtccaaaatatgggacgggaatcagagctggtagaaaaatatgaaaagcctctttacaccctgagtatttgaaacaatccgatgagcataggaagtggctgccaacgctctggcggctgctcgtgctgccgccgctgccgctgctgttcctcgcatagggctggacagagctagtcccggtttcagcacctccggcgctggacagctctctgcacgccgcaccgccgcctgcttgctttttcccactctcgctttgcattactggagatgcatctaaattacatcctgttcaacaacaagtagatttttttttcctgtacaggaattacagtagacgactctctcaattaaactgcattttcttctttacggatttggctatcaggcgtatttatcccgatttcctcccccctcactcccctttgcaggaacgagtctttgggaacgtggtccacccagggatgtaaaactgtgcttaccgatgcatcccatacgaaatgcttatgtgatcgtctctctaccttcgccattttggctcagcaacctagagaaatagtaagtaacaaagggaaaacacggctttaacgcaaagacagggatattgtggctagtgtttctccagggaactgcattttaaatggggaaatggaaaatgttgcagggtacaaaattgggttcgtctcctccttagctatagtagcttggtggaatgaattctagttggtattctataactaaattctactcaattttatgtcttctaacttgaaatttctgcagtgtagtttcaaggatgaagtccaatcatgtcactaatatgctgcaaactttcaaataaaaataattgtcaacttaacctttattttaaagctggaaagatattctggggaattttagagggtattgttagtagtagaatgaagaccccagacactatagtgaaacacattgcatatctgcattggatattttcagtacaggttttctggaagtgtccttggatgtaaatataaataaataaatatatatgttaatcaaatgaagtttttgtgaaagcatggctgtcaggaactgtaaaattattccttaatagtatatagtttttcaaaaatagtttctgaaagagacagctgtacataactgtctgaaagaaaaataatattctcatcaattgtattttgaggaaatataactcagaatgaatgctgaacaattattattcaggtaaatgtgatattctgcctacatttggcctaaataagcatcactcttcttactaattttgatgacaaaaaactaatacaatttgatgtgcatatttgaggttttagaacacgcttaaagtgtattccttcaaactctcaatgttaacaatgtgaaaaccaacaaatttaattaattaacgtcatgtaagtgtccaaggaaagaaaccttccagatcagtgaatgcatgtaatctttacatatgttttaaaagacagaaagcttatttttcaaggtcatgcatttagggactgatactggcattgtcataattatctccacatattttgttcattgaaaaaaaatcacaaaatatacttgaaggttttaaatttgacgtttgattttcttctgtatcctcagaagccaagcaagtacaattaaatgtgagaatacttgacttagaataaagttgtcaaaaagtcagaaagtttgaaaaatcttcaatatctatataccagatataggtaacataatgagttgtaaatagtagcatctagataaattttaccaagaatcatattgtgaaatgactaacctgcagttagttaaagaaaaatgagtgatgctttaaattttaggtagagaaaatttaacatgtgaatgttgaccaagttgtagttttaaggtcttgattttcgaaagttataaggatgtaatattccatagcccaccatttaaaactctaatgactttattacttcacagtgggagagagggggaagctgcaattagtatttttagaggttgagaatgcaagaacagagtggattcatgggtaactatctggtaactataacaactatataggctatttttgagtgataggttagctttgctgagtctagaagttattttaatttattaaaaaccaatttgtttcttttttgttttgtttaattcacagatcatggaatcctctggcacaccttcagttaccctaatagtaggcagtggtctttcttgcttggccttgattaccctagcagttgtctatgcagcattatggaggtaagtaatcaattgatagacctgaaatgcaatgcttagttgttcatagttaaatcaaggaatgtgataattattaaatgtctcctgtcttcttaatttactgaaagcagtatttttacaacagagttataattggtgtgattgagctttaataaatgaattatgtttacctaattttcctgtatatttgcctgagttaagaaaataaacagtacacacataaacttttattctcatttcaaatgttagtagccttcaacaagttgcttaccccaagcatagtactcttacaccacaagttcaatctatttgtggtttctatttatcccaattgctatggaggctgtgagtctaactggtacagtcaaattaatttatctgttataaaaatatgatctcaagtacttaagtttcaaacacatgctttcagtatgtcccagacaactagtgaacccttctatgctattgaagcactaacataataccaatatattccagaaaatgcctgttggttgagtgtgtccaagaagtcagactttgacaaattgattaaaagaagtcataaaaatacataaacaaggggaagttattgaaaaatttttttctacaatagttgaaatcacatctactgatatatgaaagcctagtattttttaagacttgtttttgattgtgttactaagaattagacctgtgaagtttatcgtctactcacatattgataaaatatatagacatatggccaaagtactggatttttctagtggatttttaaatttttaaatgttaaacatttttatatccacttttattattgaaaaataatctaaatatttttaactatattagtatatagaaaattacctaatattttcagaatgtttgtaatattagaattgcaaaagtagatatttctgcctcagaaatcttaatctttattcacttaagataaaaaacattcagttgaaaaatgaattacaattttatttaaaaagaccattttactttgttcttttaagaaaatgtattgttcttcattataatttttactcttttgagagcaagaattaattgtcacatatttaaattgtcaaagttatgaagagtttttatgcttcatacaaaagtaaaaattatgtatctcttgacccattagcactggtacatgacagaaatccttccttccggtgaaggaattatctagtagtgagagacactgacaaagtgggacaatctgataaaatatgtccagctctaggaaatgaaataaatgcttagtttaaacatgacattgtaggcagcagaatcttgggttcagggctcactcaagcagacattgtctcagtaatgcaaaagcaagaaggataaacatttgaaaagtagacaacttcctctaccacaattgtttaaataacagttgttcaaaaattaggcagcatttaaagactaggaatttggtaatcacaatagtaacataattcatgctcactgaagtatttaaaactaaattccttttatcagcatttagggttcaggcaccaattccaccttctctttatccctcaatacatatcactaacactagcatatacattgtcaggataggtgatgtgtacatttaatcaaggaaacatacaattaattagtccataataaagttttctttaatgcagaaagttcaagaaagtcactactacaatagttttctaagaattaccaaaacaattcaaaggatctgttaacacttgagatgaacttgagaattacagaagagagtaccaagaaacaacacaaatctaaatccctaaaagttagtggtcatcaactcattctctacaaatagaattgaaataatattcatagtttgaaagaagtgacaagactccatgaattattaagtgaatcttgataacatgatgaattaaatgcagtttataagcgcctacagaaacaccaatagaaacttcgagaactgaaatttaaagccccacacaattgtgaagtattatccttgcttactagaaggatgccattatacatgtagggtatatattgtgtactgtataatattactgtatgctaataagcatgttaggttcctaccaccttttattctcagtaaaaagtttagaaattttgatttctaaggagttgtaatgtgtacaagcatctcaagtattttatacataataggctgtttttaaatttggtggcgttgcatgtagttcatcagaaatgttcaccaaaaatttaatacattaggttatattctcttcacctatagataagtttggcagagttacatttttacatgaaaaaataatgaagcatgtccttgtcatcactgtattaacataaagcattcttaaattttgtttaaaaaatctaacatggtaaagaaatttgtgaaaattgagacatttcatagcaattatgaaggcaacaatagggctcagttttgataaaaatagaaacatataaaaacttcagcctagtcaattctggatatttcattatcatatttttgtctatttacagaacaaaaagtttcactaaaacccttttcataatgtcatctgtgtgtttgtgcttccatggaagccattaacatcaaacaaagggttaattttatgaagccccttaactttttatattatattccccacccacaaaaaagagacaattaatagttgatgatgtcttcagcatctcagtgtgtggtttattatattgtttgccactgatgatacaggaacaaggttcagcaaccctgaggccattttgtgttaagatttgatctaagttagtcccatttgagtttgttttgtgaccaaagggaatttctttttatattacaaaaactcctttgtgtattttattgttattcttacttttgtgttctttttggaaatgtgtgataaaacgtgggggttctaccttgattgtcctcaaagacagggagagagagagacagacagacagagagaagtttgacagatttttaccttccagagtgcctccagatcattggcactcctgtctaatgctgcatagaaaagctcatgcctgctgtggaatgtgattccacgttataatacaaattgaatgggcctaaacacacagcaaatacaacagtgtctttttgttactgtcactcagtgatttaccacagaatgcagtgaagcaaaatagctgttactctttcagggtaaacagctggtagaacatttgattctgagcagttttctctatggcttacattcttggtgcacttaacaactatataacagactgtatataaacacttcttcataagggtaaaatatggcagatgtcaagtgattttccagcctaatagtgaattatcatttgtggattggatttatttttagaaataaagattcatttttttgaacaattattcaggaaaaatataaagagtagcagcctaattacattcaaatgctggagtggataaaagtgttcacagtttcatgaaagtaatggtatccttctagtaaataacaataatacttcacaatttgagttttttctttttggttctcaaagtttatattggttgattcatatgataatgctaaacatacatacacacatacacacacacgtatataaaggtattatactaattgatatatttccaagaagctttatatgtttagttaaaaaaaagtgtatcatgacaacagatgggcaacttaggctctatcagaaatgccatactgtcccaccaatgtctaagaaaaaaaaattctaaaggacgcttgcacatgccataccactgtaaaattgggtctctaaaagtaattttttattttagaaactatttttatattttttatttttgtaaatattcctgtgctacagtacttatttttccagatgaatgccatcagtttgcacaatatataattcttcatctttctgttggattttaaagttgggtaacttttctctctctggctaggtacatacgctctgagagatccataatactaattaacttctgcctgtctatcatctcatccaatatcctcatactggttggacagactcagacacataataaggtatgactggtaattattctgattctttttttgtgtttatattttggcatattgttagttattgataatctaaacattcattctaaaatggagaacttctgacaaaattatattttaaagcaaaattttgttattggtttatgaataaaaacattgtctattccagttcagaatgtatacccttgatttaattccctgtgggttgagaggttgttcataagagtaaaaatgtatgtttattaaacattatatcaaagctctatgagttcaaagctttgggacatcaaagcacatattttgattcattagtctaattgtaagaagatctaattgtaacaggatagaaggcttttgttttggtctaatttattaacatattgattcctaaaaggtaactataaattgcttacaagtgtaacatctctcttgaaaatccacctgaaaaatatccataggcaataattgaagagagtgttagatgaaagctactttagattttatgcctttcaaaatttttgcttcacctaaaggtattttgatacttagcagaatggaaaagtgtattttctgtttatatgaatgaaccaatttatgagttgaatgaccatgttttttcccccagaaatgattgtctttactattctgaaatgtattttaagaaacccataatagcaatttgaagtaaacttacccctgcctcaaaaggattctgttaaacaccactttgataacttatttgtcaatcgatcacatgcctgcaggcctgttatttttcatttttttaattttcaaatacaaaagcgaataattaaaaattttcccataagccatcattttaaaataatcatatacactttgataggttcttttcatgtattatatattcataggacatgtattaatgtcaaggataatggatagtctgtttattttgctaacctacgttcctaagactggtgatttccaccaaaagagcccaattctaggtccgggtaggacctaggaggctgctttaagtgattctgataaatgtttcttcttggcccacattgccctaggccaggggaagggcccaaggggtaggccactaatcctgaaggaaaaacaaaaatgacaaccccatcaagggccctgtagaaataaaaattactttcgtgtctttgagtgtttaattttcctccacttatttcctgtatcttttcttcttaaagaaagaatccgaaagaaagtaaagactattaaaatatagttcaggtccatgttataaacatttaatacaaattttaaaaggaaatacaaagtaaagaaaaaagagagagacagaatgactaaaggtgagagggatgccaatcagaattgggagacaagaaggtacaaaatgaccaacagaataaaaaatgagggtaaacatggatgtaagtgaaaagaaaaagggaaacaaaaaggcaatgataggaaggaagtagagataaaagggatgagatgggaccgtaaaccttaaggaattattaaattactcatgtcattctttcctttttgcttgttcacttgggctgggcctcagatctcttagaaatgttcatacactggttaatacctattcccaattttttaactacttgtccttcaacctccacccagaaaaagagagctttcctctgaaataggaattatttattgggatcaggaaccagaaaaagtcaagctaaagccagctagagctcagagtttaagtttttttcacaaaacattcttccttttctgccattttttactctccaaacactcttgagttatacctccccttagactaggaaaactgcatgatccacagtacaaaatatgcttttaaaactgtttcatgctgcttggcaaagttttgataagttctgagccaaatggtactacagacatttctacaaggtgtacttcacatcatagtggttatgctctaaatcactgatgtacaatagaaatgcaatgcaagacacaaatacaagccacatatgtaatttaaattatattagtagccacattaaaaaaatttaaaaacccgatgaaattaattttaatatatactatttacctcagaatatccacaatattaccattttaagacataatataaaatattaatacaatattttacaatcttttttaagtcttaagaatctggagtatattttatacttatgatacatcttaatttgaactagctacatttcaaatgtccaatggctacatgcagctagtgtctacgacgttgtgtaggtctaaatgccagctatattcagaaactaaaattatctcaaaaaactacattctgtctgcccagtttgaccttcacaggttttcaatgtcctctttgttttgtaataatgtcttttaagatctgcaaatatgaatatcaaagacaagatgaatttggtttacttttcatttcttattttgaggaagggctggtattgacttactaccaaaatatgagtttgatgtagcttctccccaagtaattaactacagaatagcttctatgtagttttgcaaccaaagtggttttgtatcagattgactaatgctaatttttgctactatagttattgatgcattcggggaggagtgggtggtaagtggtagtattgatgaagaaaataagagattattagtttgttcttatgctatattaattttgctttactagctcttagtagatgttcttacaagcctgggacaattcacattagagtgattagaagagaaaaatacaaaacactggaattttattcttagtcactcaaaacaatatcacattttctaggggaaataatcttgtgttttattagttgaattagatggactctatttgtatttatatatgagaatttggtatgtgaaaggctacatctgtttgactgtatttgggattaatggtgtctcaaaaaaatagaaaagtacaaagtgtgttgtctgtataaacttatgatgtgcataaactacaaataactattttttgaaaatgtaaaatattgttcaataactaaagtattttattttggttttgtataggatccctttgcttctgtggggattttttaattgatcagatttgtatctttgacttccctgataagttttaattgatgctttagtattcccatcttagaaagtataaacatccgagagagctttttgatgaagaaattatttgatactgcttcagtgagttgtcatggctagtttgtatgaaagctggtatctgatgttgatgtacagaatagttttgaagtgtaatatgagggcctttctttgaattgcttattgaaatataattgacctgattatcttgctactgagtatctctgcttctttttgaattgaaatgtaaacaagctgaaataatccattgcataaaataaatgtattcaaattttttgactgtatattcaattactggcaacaaagtaaggaaccaagtgcattttattatatcttttcttaaaatgcagttgtaatatttaattataacccacttcattatattttgagttttctcataaagtgatatttcccttttatctctttgtgcatttaaactttcaaccaggatgtctttgtattgctcaaatgttatttatttgtaaagcatttcctttacacctttaagtatgcatttgtgtttttgttgttgttgttgagctgagtagactatttttggtactactgttttgcagaaagcaaagattattttgaaaacataaatttagagaatagtttttcttaatgacaaaagcatgtattgcttttgcttcaaaggactttaaggatttaaagaatttatcatattgaagatttcatagcactctttttaactgatagaagacaaatctggcaaaactcttggttttttggttagataaggataaccacccaagaagttcaaagtggtgggagatagcttctctctctcacaagctcactaccaggttataaaaaaaagcaagtctaagtccaaattttatcacacatttagatatttattagataatccctcattagcaaatcaggaacaaaatctattcaggaagctcaatgagggcctaggtctttgaccttttagatactttcacccaccctgtatgtaacattcagtgaggtggacatagcaacattctaggagcaggattctgtgacctttagtcagtgtcattcagtcagaaatcctcctaatccaatgtctggacacagaatgattatggataaaaccgtgggccccatcgctaaaagatatgggatataggccacaatggaatcttatgtacagttcatttaagagtaagaagtgtttaactgttttagccaatacacatatcttcaatgcctttactttcaccaaagggaatccattaatacattcattatagtgattaaccagacactagttcaccaataaagactaatcttttatatttagtttgataatgagtaaagtgttgattgtggctagatgtacctcagtaagaaggacctgtagttgccctgtatgggccttctagatataaagccaactgaccaactagtctgggcattcttggactcctcctagaattacaggttaaactaactggcacatatatagtatcatactgaaaataacaaaatattataaaataaattgtagatattataacaagcctacaaatgttaatattttgggaactactagtcaattgtgagagaacaaagagatattagcttgagtcttaattgacctaggagtaaagcaaaagttctcattgatagataaagggaagtttctaaattatttggggtggtcaaacattttcttagcattatttaggaggaaattgtctcatggttctttatgtgtggagcattgtattacataatgggctgtgtcttttaattcagacttgcaaaagatacaaaaattctctgtcttaaagcacttttaaaagtcccgttctctattatgttttcttctacttcatcttgtggttatttaccttttataaagatgttatatttttgttctgtagtttgaatagagagaattagaaaacatgggccaaactagtaggttatagtcactctaatggaagatttttttgttttgtcagaattgtgttttttaaaaagtaaaacctcgaattggaataccttaacttgggtcaagcactctctaattcaactatttgtcccatgactttcttttgccaatagtcccagcttctgcacacatttatgtacatgcctgacctctaaatatctatgtgttttcgacttctgagaaaaaatattgaacatgtatttacagctatccattcagttctgcctgataccctttgaagcagactgccccctgccccagagattcagtgttctacatgcttctttgggagatatcagtctcagatggggatggttaagagaaggtattgtaagccaggtagatttaaatatcccaaatctgccagttctcctagttgtgtgatcttaagcatgacaccctgcatctctagacctaagcttgttgtcagagttacatgaattagtacgtatggagcacttaacccagaggctggtatcagcacttaacccagagagtggtatgtttaagtgtaagtaccacttaaacagtagctgtaattatggcaaagataattatgacacccagatatacatctgattctgtccttctcttcataccttcatatttcctcatgtccaatttcctgctcaccactaaattcaccatttctgtctccaccccagtcttttgcattcggaggcaaaatttaatgccttttctgtagtctccaactcaattacataagctagaactctggaagttatccttgatgtctccttctcgctcatggagtaaatctaataaatcatccacctatgacaatttaaccctcaaatatttctcagatctagtttcttgtctctatcaggtattgatcatactgcttacagtattatcaatcccattctctattctgtagcccacgtgatggaacaaaaattcaaatctgaccactcgatttctctatgtaacatttattgttgtctcatttcctacagaagtaattttcaaattgtgctcagacacaagcattgaagcatattttgtttatctgtgaagatttttttattcactgcttttcttgtaataatatattggaactcaggaataaatcgtacaagagaaaaacttctggagcttgtaaaacctgagaaaaagcagatcttaaaaatggcccatgctgacctctccatactgtttctattttactgacttttgttataccagcaagaccaaacttctaatagttcatcaaaattaatctatttttttttgtttcatgctatacttcatcctggggcactgttccttcaccccaaccccacctgacttcctgtctttatttgtctcaagctcattctctgacactctgatgagttttcccattagagaaaaccctgcttatgcacacctgctctgggttccaggatttccagtgcatacctattctcttgtattatattacctgtttataatcagactatacacttcttagggcaggactaagtcatactcattattaaatctcttgcaagcacattgtctatgtatagtaagtaaataataagtattattagatgaatgaaataaatttgaatatatttgtgcttatatctatgaatctaatagctgttgttagtcttacgaaaagtagagtcccccaccctagacaggatctcagctaatagtgatagattatttttctagggcctgttttagctctaagtgattgatggcatgctttaaatgtgatctggcccctggattttagttaaggaaatgctgaaaactagcaaaagttaatcttttttcttcataagaatataatgttcatagccttaaaaagaaatgtgcgtagttacaattcttctcattggagacatatcctgccaatagtgtcccaagtgtaagtctattatgcctcaaatgaatgtgtgattttaatggtcgaggctaacacctatttagattcattaaaatctaatttgttgacttgctatgacgtttgtaaaatgatttgaaggtaataagcttatgtgtaattaacttggttccgttttgaagtatcttactaacttagagttattctggattcctgaaaaccttcatcaaaccaaggagcataatggttggctagcttcttgatttccccaggctcccagcaataaaagatgatttcccaaaacagattcccagtgaagtgagagacagtgagatagcagagactctgttgtcctactataacctcctagtcccttgattattcatttccagatttgtgtggtaaaagccagagaccacattattgtaaatagggcaaagatcaatatgaaggatgggctcagggcaagcaaagaagatgaaagtggaattacttgacaataggattactgaaacgattgagatgtcaagagccaaatgaccttgagggacaaggaagcagtttggacattcagtgagtattcttagcttcaacttcaaagccgatcaaaactcctgaagagtgagaactcactcaacagggaagaagcagaacacgagtctcagcctagtgtgcaggtgattgctttgagaatgtcaggcctactctcattaatttttgttcatttgtgctgagggaattgtacaaaagccagacaatgcaaagaaactccatgacttgatcaattctactctccatccccaccacccctgcattagacttggccttcatgatttctcactttgaccactataacattcttctaactttcctctgcaactaaagcctttccatgagctcatcctccatatcactttgagaaatatcttaaatttaaagaaaaagaaatacctgattgcgtaattcccctgctgcaaactgtatgatgggtctgtagggcttatgagattaattccatgttctgcatatcacctgcattcagggctgcctgaagtacctaagttgactttgtgggaaataaaaagggcactccttcagggcagatgcggatgagttataaaatcatcctctccctccagactgatatagcctctagcaagccttctggcttggcaacaagagctagatttcagcattccctttctgttccctcctagggaccgtgtctgtgtgcattccagctttcttatggctatgggagttcctcttgcttgtgtgcttttgcccttgctttttactctgtctgataaactcttaccacacttcagagtggacttatgaaaccattttagctcctacaacactcctttctgctttcatagcatgtgatacatacctctattgttagcaccaatcaccttattctataagttatcaattcctgatcaaccctgctcactgtattgtgattctcaagggtagtatgtctctctttttactggatttaaaaaccattaatactagtacttgttttatatatggcgtgaaattaataaatgttgaatgaatgaatgaacttatggctatacctattgaatgagggataatataataggagtatagccacttcatttttgggggccccatttggaataattataatggaggtcaatttttttttattattgttgtattgttgccattttatgatgatataagggagttgaagaaaatactgaagacttacagaatgtttttgagaccctcctttgatgagagatggttgagttaaatcagatcttatctttatgcagagatatccaaaagagaatttgagaaattgagtgtccttccaagagtctcacagaaaggttaaagaatatctgcttttctcccctgaaatcaaaccagtagagaaattacaaatttctccctatgtattatttttcatctttccccttcttgggacataatatgaactggtcagaagtttggctaatgtcaatagaagaatcatgttggagtatagctgataatgtttatgagaattcttaatacaatgtaaaatactgaagtactagataaacatcacagaaagtgaattactttaatttacagatattctcacaaaaaaaatgaaaagcccttgagataagattacaatagaattttcaatggcccatgatatgaactttgagactatgtctctcagggtgaatatgaggtgaagagagtagaatttaagttatcactaaagatctgttgaccaaagtaaaatttgtctcagtacgacattggaatggtgtgaagactgtaggagagaactcctttgacaaatgctccataatgtaattcagaggttggcaaacttttgttgtaaagggccatatagtaaatactttaggctttgtaggacatatgctgtctgttgaatctattcagttctgctgttgttgctagaaaacagttatagaaataaagcaatggatgtgactggatttggcctgggacctagccttaggcaattttgagctttctagaagtatcttatgtgcataccaacagaacaactacaatgtaaggtgaggccagcctatttctgggctgatgctttatgtaaaaataacctccagttctgacgtgtctacccaagggttagcctgtgtagcctgcagaactggaacagagggaccttggcagtttttgaaaaggcttctgccaagatgaaaaggagtgcaaaacactttgaatttcttcttcttctttttcttttttttgaaatggagttttgctttgttgcccaggctggagtgcagtagcgcgatcttggctcactgaaacctccgcctcccgggttcaagcaattctcctgccttagcctcctgagtagctgggattacaggtgtgcatcaccatgcccggctaattattgtatttttagtagagatggagtttcaccatgttggtcaggctggtcttgaactcctgacctcgtgttctgcctgccttggcgtcccaaagtgccaggattacaggcatgagccacggcgcccagctgagtttcttctttggagcactctggaactaatcacagaatgccttcacttatgatgccgattggttaccagtgtataaaactatggaaaaaaccatgaatcaaatccctcacaaccaagctggacattttataaattgaagaagttaaaagtagctaacaaatacccagtgcatgagacaacaaagctggctggctttgtagaagaaaacttcttaatgtacagcagtatttgttaaagcccttattagagaaactctttcatctgacagtcttgggcagagaagtaacatctgaagcagaaaatagagatggcagagtcaagctaattcccaatcaaattcatgcatagacagagttctctttttacctctctacctctatcctatctcaccctaccctaaaatttggattgttattatgtatatcaaatcataagcattgctatggcaaatcttggaactaaagtccaaacactaatgcctataataaaaaaaaataagcagattaaagttcattttttacttcttttgtggtagctagtcagttaattttaaatcttaagccttgaagaaagaactaggcatatgactgagttgagtctgggtcttgactatgaaatttaagatgtatgaaattcaaagtaagtaaattaaaatatttatagttatcttaggctgctagtggattgaatcaaagattaagacttcaattgtaatgtgaagaagaaatgactagctttaacagtaaacacataagcagaagaattttaatttgttaatatgtgtgataagggcctgtgtaagtgttctttgttaaactacaatacacatagttttcatatatctctatagatgtgtctttggtagatgatacatcagtatatacatgcaattaggactacagaaggttttgaatggatcttatttgtatctgttttgttgccaattaaattctatctgtattttaaggtgatttttcctaatgaatagaaagatgtgtattgcttttacaaaatacaaattagttctgcttttcttatttacttatttttgtttatttttattagaaataagaccacctatttctttgtttagaaatttgttatatattttcaaaatctccagaataaagctaaaaggtgaattctgtatgcctaagaacagcatcctttattacaatgaaaaggacaatctgtaccaattatctattgctatgtaacaaattacctcaaagcttagtagctcaaaacatatttataatcctcaccatttctacaagtcaggaatttaggagaaatgtagctgggcatttcaggctcagggtctctcatgagactgcaatgaagatgtgtcggagccacaggaacccaaggtttgcttggagctggaaggatctgctgtaaactgactcatcattccaggtgtaatggaagcttcacttattctaactgaagtactttaagctcaaccacttcctgggcatgcaccacttgtcaagttacttaaccattcttcactcaccagcctagtgttcttttacagttataaatcatatcgtgatttaaacatatgtctgtttaaaaccctttggtgaaaataagtgaagcttctattattacacttggaatgaaatccaaaccacataatatggcccacaagccccaacatgacatgggcctatgtacttctttcacctcactgcctcatattcattactcttttctttctgtatatttctgtcacactggccacccattagaaatgttgtaggggtcaataagcccttagtcaagtgaccattattctggtttgtacctgttgccctggtgcaattactagcaagaccagtttcaaaagcgtctcatcaattacatgcttttcctagcatccagctcttttctctgcctcctaacttttttatattcctcccttattagtcttcttccagccttgggctagcctagttaacttatattaacttacgtatgttctgcagataaaatacaatcgtcttagaaaagctttccctaaaatcccactcctctgaaatgagcactctcatggtttttccactaatctgtctaggaacccattttttttttacagccattactttactttgtaatcttattttaattaatatccagaagagaaagaacattatctgtttgatttgcactgtataaccagtgctgaatacagtgcctggcacatagcacacactcattaaatatttttaagtgaatgaagaaaatatctaagcctcagttgtttttaaatctagaagtagggaggagatattataagaatcaagtaggattgcacctaggacagtatctggcacacaatatacttttttcttattaaagtatagttaacaaaaaaatgcacatatttcagacatacaacatagtgttttgatataagtatactctaatgattcccacagtcaagttacttaacatatccattacctgacatagctaccctttttgtttattgttttcaggatacttcagatttactcctttagcaaatttcaaatatgcaatgcattattatcaactaagttactgtgatgtacattagatctcaagaacttattggtctcataactggaattttgtaccctttctaattgaagttaaatgtatatacagtgaaatgcacactacatacataatatgatgaggttggaccaatatatacttatgtaaccaatacctgatcaagatatggaacgttgtcatcaccctagaaagttctctcttgtctcctgccagtcaatccccatcccctcataggcaagcgttgttctgattcctgtcatcgtgaattcattttttctgtttcaggattttatacaaatgaaatcatagcatgagtactttttcttctggcctcttttgctcaatatattttctttgagaagcaactatattgttgtatgtattagtgattaattattctttattgctgagtattatttattgtatgactatatcatgatttgtttatccagtttccaattgatagacatatgaattgtttttagttttttgttactatgaataaaattgtttcaaaatttttgtaaaaatctttgtatggacatgtattttcatttcttctgggaaagaagctaggagtaaaattgttgggtataaaggcaggttagattacttttaacttaaaagaaaaaatacaaactgctgaatggttttccaaaatggtcataccactttgtactcttaccagtaatctatgataattccagtgttacatattcttggcaacattttaatttacattcctctaataactaataaagtttagcaccttttcatgtccttataggccattttaaatcctctattgtgatgtgtctgttcaagtcatttctctcttttttatttagattgtttggatacaaatcctttgtaatttataatttttcctatagctagtgtttacacttcattaatggcatcttttgctgagtagaaatttttgtgaagttcagtgtatcatttaaaaaaatagtttgtgtttatgactccaccataaaagatcttcattactcctctaggtcataaaaatgtttttctatattatcttatctatattctaagttttcccttgtcatcttagcttttatgtagatctatgtctcgaacaaaattaatttttgtgtgttatatgaggtaggtcttggggttcattatattctacatggatatccaattgttctggtactgtttgttcaaaaaatttccttttcccattaaattgctttggtagctttgcaaaatcagttgactgtatgtgtggatctgtttctggatttctccattgtttctgtgatctatctttccttatgtcgatgccataatctttactactatagctttgtgttaactctggaaatcaaagagcttgagttctctaacttcattcttcctttccaatattattttgcttaatctaggtattttgtctacatttgtctaatctaggttctttgggtattcaaatacgttttagaatcaacttttcaattttatacaaaaaagtgtgttgcaattttcttagtattatattgattgaatcttcaggttaatttaggtagggaccaatatattcttttgataacttattaatcatctaatggcaatgggtatgaattggcttcctgaaataagatcattaggatcattaagttgttgtgaccaattagatgaggatgctgagaaagaaaggacatcccaaactgcagtgcttttggactcttatataatgctcattattaaactagagaagagttgaagagaaattaggagtttatggagagaactatgcactgctctagggcaaatactctgctccaagcagttgtttccttgctcttattgtctttcaatactctgtcttttggatattttatgtgattgcttcctaaatatgttttctaaagcagagtattttccttccaaagtactatatattttcaatatatcaaacaggatgcaattatagattgatttattttctttgaatttcttcaccttgttcattatcagatgagggcaaaaatatttctgagatcaaaaactcatgagccatttttttctttaggcatatagaagggcatgccattttgactaagcacaaatagaatatttgtagaaagttaagaaatgagcagcaatattcccttccaggcagtcagaagcttggtggcacactttttacatggaagcaaaatatttctgaaattaaaaaagtaatttaaaaagagcacaaggaccagaatgtatgccaagcaaacaccctttaactttatttacagtaaatgagagcaagttttaaaagcctttagtgaatattctgtctagaaaccatttatgtttaaatttcactgattagatttttaaaagtaggtagtattctgtatttagccccttttaaactgctcagcatcaaaatatctgaaaacagttgctcttttgcctattaattcaaacataaatgctattattcaagacgtaaaataagacatttacctatctgttattaatacagcctggtcctttttactaacacagtaatcgcatgagcatgcctattacttttttttccaatactagaaaggattctattatgtataatttgtgttttactcttagagaactttttcatttatccctgtgaggctgtttcagcgatatgaaaacatgagtatgtagcataactatctttatgttttttcttttattttttatactgtcaagaaaaaatgatgcattttctttattcattaaatctcgaagctataaatcttccaattatgtttagatatatcttattgattatctttccttattcaattagaactgatttttaaaaaatgcctttgtatttcttttttttttcttttttttattattataatttaagttttagggtacatgtgcacaatctgcaggttagttacatatgtatacatgtgccatgctggtgtgctgcacccactaactcgtcatctagcattagatatatctcccaatgctatccctcccccctccccccaccccacaacagtccccagagtgtgatgttccccttcctgtgtccatgtgttctcattgttcaattcccacctatgagtgagaacatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcactgttggacatttgggttggttccaagtctttgctattgtgaatagtgccacaataaacatacgtgtgcatgtgtctttatagcagcatgagttagagtcctttgggtatatacccagtaatgggatggctgggtcaaatggtatttctagttctagatccctgaggaatcgccacactgacttctacaatggttgaactagtttacagtcccaccaacagtgtaaaagtgttcctatttctccacatcctctccagcacctgttgtttcctgactttttaatgactgccattctaactggtgtgagatggtatctcattgtggttttgacttgcatttctctgatgtccagtgatggtgagcattttttcatgtgttttttggctgcataaatgtcttgagaagtgtctgttcatgtcctttgcccactttttgaggggttgtttgtttttttcttgtaaatttgtttaagttctttgtagattctggatattagccctttttcagatgagtaggttgcaaaaattttctcccattttgtgggttgcctgttcactctgatggtagtttcttttgctgtgcagaagctctttagtttgattagatcccatttgtcaattttggcttttgttgccattgcttttggtgttttagacatgaagtccttgcccatgcctatgtcctgaatggtaatgcctaggttttcttctaaggtttttatggttttaggtctaatgtttaagtctttaatccatcttgaattaatttttgtataaggtgtaaggaagggatccggtttcagctttctacatatggctatccagttttcccagcaccatttattaaatagggaatcctttccccatttcttgtttttgtcaggtttgtcaaagatcagagagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggccgtatggccattttcatgatattgattcttcctacccatgagcatggaatgttcttccatttgtttgtatcctctttgatttccttgagcagtggtttgtagttctccttgaagaggtccttcacgtcccttgtaaggtggattcctaggtattttattctctttgaagcaattgtgaatgggcgttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgactgcctcttttcctaaatgaataccctttatttccttctcctgcctaattgccctggccagaacttccaacactatgctgaataggagtggtgagagagggcatccctgtcttgtgccagttttcaaagggaatgcttccagtttttgcccattctgtatgatattggctgtgggtttatcatagatagctgttattattttgagatatgtcccatcaatacctaatttattgagagtttttagcatgaaggttgttgaattttgtcaaagaccttttctgcatctattgagataatcatgtggtttttgtctttggttctgtttatatgctggattacatttattgatttgtgtattttgaaccagccttgcatcccagggatgaagcccacttgatcacggtggataagctttttgatgtgctgctggattcggtttgccagtattttattgaggatttttgcatcaatgttcatcaaggatattggtctaaaatgctcttttttggttgtgtctctgcccagctttggtatcagaatgatgctggcctcataaaatgaattagggaggattccctctttttctattgattggaatagtttcagaaggaatggtaccagttcctccttgtacctctgatagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagagtttctagtttatttgcgtagaggtgtttgtagtattctctgatgtaaataaaatatctctgtatttcctgtaaataaaaagatgatgtttgaggtaaacaaaatcctgtttacctatttccactgctagaaagtgatgataaactcaactaagaacaattggaaaaaaatacgttacatggatggggaaaaaagttaattattttgcattttgtcttctgatcatcttcaagatttagttgactggtctgcattactgtctcaaagggagatagcatgaattttgtgaaagaagtgtgttttcagtgcagattctcccctggatacccacttgtaatttcttttggtgataatagatcttagctatgcacatcaagggaaaactagattcttcagggtatcatgcagtgtagctcatcacagtatcctcagtgcttgttggcagacctgtctatttgtagaaacgtggttgttatcctatagtggagattgttggagtgtatttacgcagctttcccagtctcatgtccagatataaagaggatccttgttaagcttccagaccccatttgtcaggaaagaagggagaatttgaatgaaatctctgcagctagcgatataaagacgaatatctttaagctctgtttttcagaaatgaaatggtattcgcagagaaggatgaaaaaaatgacaactatttgtgtcagtaggaagaattataagaaaagaaaaaaattcctagagattagaggaaatctagcaaggtacaggattgaaaatgatgaagaggagcagatttttatgcctgtaaaatctcatttggccatgattatttctgttttgtttttggaacttggaaaggacacaaataatgtgtaatgttggtgtcatttccatagaatactgacagagacttgtcaacataagaaatatctgcatattgaattcacatgtatatagaagtgaagaacggttgggaattgtactgattataaaaacactagatacagttaatgcattcagcaaagggaaaaactgcaaattcgttgcagaaataaattacctttatgtatttaaaatgttagggcttacagccatttttctaatgacaaaatggtgtatagtccagagcttcaaagtaggaattattcaattcttacaatgaaatgttacaaacatttttaaaagggtgacttataatgggaaatatatttgagaaatgaagtgcacaatatggaaaagtataccaagacagtagtggttcccaacaagagtaaaaagagacaggacatttagaaaaaccatctggagagttttttaattcaccttccccacaccctctccaaatcctgttataccttcaggagttgaacggatagattaaaaatgctccacaggcgattctgatagacatctcgttagttaagaacccctgccactggagactgcaacaaaaaacagaaagctagataagaaatagaaggctgaagttcacctgtcagtacttctcctgtgttggtctattccacgtaatcttctacttacctcagttttactgcatgtcaaataaggataagaatataccacagcaatattatgaagattaatattaaacactttgaccttcctggagaaaagcacatgatattaaaagacaggaatccagcaaagccaaaaatatatcctttcgaatttgcttaataagaaaatgagtcagtacggtgtaaattaatgcaagttctcagctccaaggagatgagattcagcaaaagctgggcctacaagaaggatgattttaagtaacatggagcttaaaagtcttcaataattaaccttgttgctgccaattctgtcagccttccaactacatttctttaatattttctcccgtgttggtgttcaataacacgtagttagttttaaccttaaaacttctaaaatgggctgggcgcggtggctcacgcctgtaatctcagcattttgggaggccaaggtgggcggatcacgaggccaggagatcgagaccatcctggctaacacggtgaaacccagtctctgctaaaaaacgcaaaaaaatagccgggcttggtggcgggcacctgtagtcccagctactcgggaggctgaggcaggagaatggcatgaactcgggaggcagagcttgcagtgagccgagatggcgccactgcactccagcctgggtgacagagcgagactctgtctcaaaaaaaaaaaaaaaaaaaaaaattctaaaatgaaaatgtttgtggtttttccccttattctctattcgcaataagatcttagcatttaattcaacaaatatgtaaaatattaatggactcagatataaagacattggatatatcagagaataataaaataataataattgaattctttaagctgtaagctttccttgtaggttataataagcctaactacaaaattacaattaacaacaggagaaaagttagccaaaaatttttaaagaaaattttgtttaacacaaattcatgtaatcaaaaaccatttttacatagggataccttgtgtaaagtctgttttaatacgcaaaattatgtgtgtgtgcacatgtgatgtgatttgtgctcagttatagatttttaattttggtaattctccattttatgatggaatcgaagatttgaaggaggaacacattaacagtcaattttctattaaaaattaatttattatgtcatttgaatgcatagtagaccagactggatgagaatggcttttgggtaaagtattttgtctatgattttacatggtaaacctatatactttcatacatttcaccaggttatagggtcctaccttccagaagtcaataattcagacacaaataagtaatagatctccctgctgtaagtgtatttacatttcttcaagcagtgtgagggaagtggtgtccctcattggaagcagaaataagtattaaatttgtattaatattaggacttccttctagacgctatttcagagtcaacttggcatagcaaaaatggttcttgtctcaaatcctaactctgtcaccagtcaaaagatgacttgggcacgtcttctagcctgtctcaacaccagttttcttaagagtgaatggaaatatgtgggtatatatttggtgtctggggtggagtatgaaaagagttggactctgctagtaaaggttaaataaaaaccatctttagttcccatatagctctacgattccaggattcttacttagggagaatcctagaattattatttatattctcatttccttatgtcctgggattaaaatatggacattagcatttgccattgtagtttttcacagtttattgatgatacattaatatactaaagataggaattgttttgtttattatacatctaaactagtctaaactgtatttaggaatattatctctctgcaaatggaccaaatctgccctcagtcttttacacaaagatccttcctaatggcaattctcagtaaatacaatgaagaacaaaattatttctaaaatcatagcagttcatttgctttccaatgtttttatcatcacctccacatttttttactacaggcttttgtatttgaataattatatgcagttgcactattgaatagaaaattgtcacacacaaaaatacaaggaaaatggtagcagcaaggctaatctatagctgcggcctttcttaatgagcgttgctgggaaacttttcagaaccctgcagggaaaggcatgtttttgtaagaaaaaggtctcaagctgttagaactgatagaatttcagaaatgccataagttcagcttgcaagagatttgtaggttttataagcagaatgaaaaaacttcaagatacttctttagaatctaagtttatatagaatgaagaactatcagatgtaagaaagggaaaataggtttcactccaaaatacggatacaggggccactgaatgtaatgggaattgttatataaatatactaatttctgtatatttaatttcatctatttgaaaattgtagagcctcagtaaaattattcaagtgtttgatatgacattttttatactttttttcaaaaacattataaaataagaaagtcctaaatgaataaatgtatgcataaatatgaacctgtgtctcttgggatagaattatcttctaaactattttgtgcaataatatgtaacatttgggtattcatggtaaatatttggtttatgttatatagtacttatttcagtaatccaaattgtaaatgaaggccaaagcatttttacatttctgagcaaaggaaagttttatggtagataccgaaatatgaccagaaaaactaaaggttcgttaagaattccaatggatattggtatttatttattaatactagaataaaaataggtttatataatattttgtaaaataatttaggtctaatttatgattagagggtctgtctttattaacaggttacaagcataatcaacattagcatgctttgcctttaatgaattctgtatctcttgtgaatacatacatatgtttttggagagaaaggcatcttaatgtatcataaaggacagaaaatagtcatccctatcttgtctttgaatcaacacaccttgaatgaggtccaagctatactggctttatatcaaattctggtttgtgctatagaaagcagtacttagagtatcactatggttcatagcgatcacatcttaaaggaaaaagcataattttatttgcctgcttatttttaattcttcactttgtttcgtttttttctaaacatatttcaatttttgacaccttggactgaaagtcactcagtaaagagataggcaaacttgaaagcatgtgaaactcaaatacttttgagaaggaggttttatttttttcttcatccttgttccctttgctcttattagtaacaattccttccttactaacataaatgcttttctctcagtgggtggttaggaccacagtcatgacatgttacttccaattctcctatgttttcaaaaacctatcatttattggcaatttctcaatatttctctccaaccccatatgaaaattctaacaattgtgtttcaagcatgatacaataattccctcttttgtctctggttttactttctgcggttccagttaccagtggttaaagtaagatattttgaaagagagagagagagaggagaccacattcacaggaattttattacagtatattgtaacaattcttcttttattttattagctattgttaatctcttactgtgcctaacttataaattaaactttaccataggtatgtatgtgtcataaaaaaaaaatattatagatagggtttggtagtatctaggttttcagggatctactgagggtcttaaaacatattcccgtcccataaaggaggagtactgtagtgtgtttgagaccttacatatagcgttttctaaaaatagatgttgcatttccgcaaaaaggaaccattttaaatttgcttcactggaaagagttcaggaatctgactctttattgaaaagtaaaggtcaaaattgaggttacctgtaggtataatttatcttcattaaaaagtggctctcaagagatattaaaggaagcaataaacaccactttgttatgacttccttcagttcactgtctgtaagacaaagacatgaaggaactccgtctttgtatgttaatttttgcagaactgacactgacatcagtgaatgttttttatgttagtattgatgtccacagggaatacaaatccttattctcattcatatactatatttcagatatataattggtgatgatacagaaaatttctctcaagtttttcttccaaaaatcatgatggtaagaagagatattttcgcatgatggcacctaaatgacttttgcattttgacacaagaaagttgatgactcatgagtgcaatcactgtctttgttaagcatcattcaggtttcctaacagcacagtgttggacagtatgctctggaagccacaataatctaacagaaacacgtgtcatatttgcctcatgtgcaagtcttgcatatgttaacttaatgcttagaaactgaggctaaatttgaaaactgcagcccttgaatttccaagtctgtcttaaatgtgggagggtcagtgtttgcttttggattaatttggggaggcttcatggggaagtaaaatttcaggcagatcaaatgctaagggagacatgtactatctcacagtaactcatataatgttgttggagggagtcttaatgattaactttattcacacctctcattttacaaatgaagaaactgagacatagagggttgatcaaagcaaatacagtgattagcagcagagccgagcaaaactcagcttcctccagttatttaaccctcaggtaaacttcatttcaatatgttctatatacatttaacatactccttctactcagtacatatccttacatctcataataggtagtttaattccaaagtccaaattctaaaaggataaaaggacagaaatgactcatccatagatggatacatgtattgctgtccttattcactccttatcctcattttttaccaaatcaaagatagacactaggagaaaactatatccaattaaaatttcttgaaaaagacaatttacaaggtgagaaggaaactctctagggaaatttatttcacttgaagcatgaaagttaaataaaactaggatatctgtgatctacagactaaggagatttataactagaaaccgccatggctatttcaagcccagcaggtctttgctttcacgtgctaaaaaactatcagtgtgatcagttttaacctgacctgccagtcttgaaaatctattctttctaattcctcctctggttttattaccctgtcttcttagctatatcttttatactttttttttctattcttctttatgctaaaaccttctttcccactagacaggcatgtctttctcatctccttttttttttatttatttagatttgtgcaataacttgagtatttgactaccaaagctattatagtgctgcacatactatctgattatcctccttggactcagacttgcattctcgctctaggtcttctcagaaatatacctatgaacgagtctcacccaaactcactccacacccccaccaacttatcctatagaatacagaacaacttcagaaatgaattgtaatgagagttcttttcaacattacaaaaacatatttacacagttactgagaaaaaaaaagtgtatctatttgtctgtaaaccagctattctacaatactctcagggttttgttcatttttgtattttattgatgcattaaatttctggaaagtctgagtcattgttcaagaaatatagtcccattggtttattcccaagaaagatcactgttcaaaatattagccttctttctctctctctgtttacctcccttcacatgccctgaaccaagacacacacatacgtgcaaattctcttactgaaatctagataataacctttagataggaacaaataaagtggaacattgccttatacagtggttctcaatcctggctgctcatcagaatcgcccatagagctttttaaagctgggagtcctgaaaatcaaccatgaaattcactgaattagaattttggagggtgagttcagggaaccagagtagtaaaaattgtcacaagtgatgctcatatgcagctagaattgagtcacagagcttgtaatagaccttacaaggtgaacagggatgatttgactcagatgaaatagctatttttaaatgtaaatgtctttacatagcaccatcccacccctagcccccgtccacaagaaaactctttattagtctgactaaaactgatcccacatttaaacaaccttgcaggtcctgttcttatcccccatgttccatatggggaagctgcccaactttatatgattttcttaaagcacccaaatctctcaatttgattagaatttaacttaattgtgaaagcctctaaattgaatttgatttagatggaaagttaccaaattacgtgttccaaaaataaagaaataattttggtccaactttgtaaaaaatccaaaatacttcttctctattgtaatatcttaaagtcctgaggtcattggctaattttagaaatagaattgctcctggccactttgtttctatctttctatttcccccaaatgctgtctctacatgtgtcctgaagcatattttcaattagcttaacccagatctgtgatggactgaggtaagcaaaatgccctccctcagtaataacttgctcatctgtagaagacaaatgactctttcaaggaaaatgtagtttgtttacctcagtctctgcttcatcccatgctcattctttacatgcttactaactgaaaaaaaattacagaaaagattcaaatcactcgaattctttcagaaagtgtattaagataaaggagaacttacaagagctttcttacagtgttgtgggattttatttgtttgttttttgaaagggcaatgttttatgtcaataagttttattattttggttttattctgcttgataattctttaaaaggagtaaagaagaaaaatatggttcacagccagtaacatgaaatatttacttaataattaaaggtaataattagatatttgtatatgtatcgtcaaaggatgatgtagggtgttaattatctcttattgacagtaatggacaaagaacaaaatctgcatgttttagcatggtttctttagttcaaaggaacctatgttagtatttcaatgtttatgtgcactttgccagagttagggaaaatagcctcaagtctcttgaagcttcagttagatatggatagaaaataccccttgagacctaatacaaattactatttctagagagttagcacaaaaagctaatctctgtccacaaaagatttattatgacagataataagagccatttgtactatttatttagggtattaatctgttcaccagtttcaatgttatagtttagtaatataccctataatcttttcctattagactattttaaaagccacttcacatatctgtatgtgtgcatacacagatatatacacacatacatacacacaaatatattgattatatataaattgtctaccaaaacaacaaacagagagagactatgtaaaagaaaatgatgtttatttggagatagagcattgcaatgggaatctgcatgccatagtaaactacatgcatattcagaaaggtaaaggaagacaaagatttttaaaaagaaaaatgaggataattatataattgttttgaaatgattatccttggctacaaagatcaataacaagggtgataccagtctaaggttgtacagataattgctccgcagtgtccttgcagaagtattttttgtataaggtcgtgatgccctttgtgcaagattatgattttcagagtcttctgtaatagtttttattaggcatacaagcgtaagaaccctctcttaatagctttccccaactctatttgtctatttgtcagggcgaggctttttttaaatttttttgtttttaacatttgcaactctacattgattctgacaattttcacatttcccccttttgatcaagatctttctcataaagcatcactggtcaatcttgctgttgttagtttctgatgttccacagtgctaagatggacctgtccaaattgttggtcttgtcccacattatggggagtgattgacagctaggagtcagtgtcaaaaccctttaagccacatttgaattacaagacagatttgaagggagtggttctcaggctacccggagtccattattaatttcagtattgtgtgttccatagtcttctcccatcatcaaaagtactgagctagcattagtctgataaaatctgtgcttctgcaaaaatctaacaagtaaaagatgcagagtttaaaaagggaaaatacaaagtaatattagcaggcaatcccagtttgtctaacagttttgagctatgaacctaggctgaaagacaaccaattgaacaaatcaaatgaccatagggaattagatgaaatctgttataaccatgtggcctattttcttattcaccaatggatatcaaagtacctcttggtcaggttgtttcaagttaccagcagaagctactaattacaaaattttaattacattaccctgccaagtgaagaaggcaggtattcagaggagtaagagacttatgatattgagttttttcccgacatcttgggaaaagctgtctacagagcaaaagcatcagatttccctcccggtttccagtttcctgtttcaatggctctgatcatgacacctagcaattcagtgaactttttgtgtggcccacatgtcaggcacgatttgttccttaaaattcttctagtttctgcttatagggctttaagagcagaggcattcccatatttattaattttgtggaaaaaagctggattgaagaaacctagaaaaattcagcatgtattctcgtctatagaaagataatacaatcttgaaaacaatgcacagggaattgaatagtacagtgataatatttggataaataattacagaaatttgtcatataatttttccaatgtgtttttataatgtgcaagtataatattttatgttttcgtaattcacaattataattttgaaatccaagttaataatagaattatttgaaagctaagaaatgactatgtgttattttcttgggcattattgctgagctaagtcccctcaaagaacctgcttcttttgggatgagtaggaagtcagatccaatgtattacattaaacagttttgacattatatccagttgaatttattgctgttcctattagacttctctctaagcaatcaccgctttgacaagatgacctctctaacattttaaggcagccagagggatgatttgctttcaggctcctagggcatttaaggcatctacacaaaagtattgacatactctggcctgggggcctgagccctttacttctcaggccataagaccccttgttctcagcatggaagcagttctttgggtagaaacttcacattgattttctgagaaatcaatcaattcatttaactttgctcttctgtcattcatgattactctctgttcattagagaaaagcctcttttcaccttgactttatcactactttccctgtgttgcccactccaaaatgggctggccgggtctaggggcaggactggttaatggctggagtgctttctttgggccttgatgttttcccccataaaatgaggtgagcagatgatcaaggaggttctttttggttcaaatgtttcacaagtgcactttggactactgctactgctacttctactctttataataatcatcataaatattattcttttatttattatttattgagcatttactttgtgcaagacactatactaagcattttatataaatcatcacatttacacctcaaaacaatgtaatacagttggttctttcatcctcccctttagaaacgcagaagctgaaacctacaaatgttaaatatcttgcccaaggtcatataactagtacaagtcagaatcaagtattgaacttaggtttgtccaattccagaaacaacattcttagttaaaacaaaatacagaggtgtttgttcagaatgaaacctgaataaagacttcattgaaaacaggtgttttttgatacttcattttcagagaaaaaaacattaaaaatttcaaacatttacaaatgtgtccaatgtaaaaaaaaattatcttaaaatgataatatctcctataatttgagctaagcttgtatgtttattttaataaagtggtttgtgcttgtagttgcatgttcaaaattagttatacttcaagtagttccctttaatcagaatttgaattgcataaatgcatatctatcaaataatttttttatttcttttgttaccagtaagccttgttatttctaagggagtcaatgctaacactaaattctttacatttcaaataaaataatatcgtgactgatgtgcccacagcaataattagtttataatatcatatgatttcataggtaacgactaaaacgtgaaccaagaagtgaaatttattattaccatatggtttatttagtttgcctgtcatactcttgatactttagttttatcaaataggatttcctgtatcataatttcctttagaaattgaaaaacaaattaaatattgtaaaagctaccttatactttactgtcatacaaaatccttcttccatcaaatattacaaacatttgtagtattaacacattagtaaaaatgtaaaattagatacttgaaagcaatttcattaattaagggaaatatttttataacataagtgtataaagtacaatgtttctcatctttataccttggctcatcagagttgcaggcatggctgtggcactttttggagtttgtgggatgggtttatttcagttaatgagcatggtttctccactatggctgacattttaatattagacttccagcagtgaattctcgtcaaaaatggtttttagatcaccaggctttccatgactagagcttttggtacagaatgtcaagtacatttatcatcagttaaatgaattaattataaatgaacatactgttggtaacacagcaacaagaagaaaggatgtcacagagagaaacactgggatttggtgtacttcctctgctcttttaaacatcagttcttatttggccagtgtctctcatgtgaattttagagagcttagtttcaagaggaaacttgtaagcatgattaaaatgaaattataaatattttaactataagacttaccagtctataaggctttaatattgagaaaagaaaataacactatatactattttgaaagaatctataaaaataatcaaattgttcttttaaggaaaatgaagctgattaaatacattttactgaagaggaaattaaagtctgtaaagactgagtaaaacctcaaatatattgagtcaatcaaacacatagtccccttaagtaacgatttgtaccttaagccataatcatataacagatcacagaggctgggatctctaattctactcactaccctgctgttcgattaagaatgacattttccccaggttcatttaatacaacacacaaattaaatcagtgatatgtataaatttaagttgattttccacatatttttgttcttgtttttatactattttatggtatatgtgaccagcaatattttaaagggaaaaacttatatagaataagcatttttttcaaacaacccattgaattggtagtatgacaatgtgcttttcattgattttagatcagtggacaatattctcctttaaatgctcagttaccataaaaatataataatttgcattaaactgggaaagttataaaatgtgtcattagtggaaaaactctccagaattgttctgttaaaaataagaaaagcagtctttagccataggatggaataactgtgagaatatgtaaatatgaaacaaagctgaacgataaggaaagcagggcacagttaacatggttttcaggatggtggttaccacaggttgagagagctgagaggactggttggcagaggacagatggatatatataagatattttcaaggctctattttttgtatcaggtggctgagttgtgggtaaatgaatgttacattattacattcaataaatgaatggctcagtgaattaaaaagagagtgatgcatagatcaatgataagatagtttcataaatgaagtattaagattaatccaatattgatacacctaaggtcaaaaaggagaaaattaaagtttttaaaatgcattcatctagattttttctgcttacagataatatttttggtaatgtgtttgtaaatcaaccagtaggcatccaagttcccttaattatgtagcatgttattctgaattgttttctatttaaagatatctcatttaaaacatattgtctaacttgttctaagtcagaaatgtaaacatacttagtatctctctctttgtctctttctccctctctgtatctcatttgcacttgaaagttcatgaaaacacacacacacacagacacacccctttccaattacaggatgaaatgttatagttaatatttgtttattcagattttttgttttagccttattgtttgttttttgctttcttaaatataaaagtttatttcttccttagtaagtacagcatattaaaaacatacgaatttttccttgcttataaaattgcagtgtagaaaggtaccatttcttattgttgtatacaccatccatctcaaattatctgaaaaataaaaagtagctcacaagaaaattccaaacacattagggcaaaaaatagttaaaaataacaaagaatttaacaaaaatgatgtaaaacaaaagagcaaacatgcagattcacacatgcacacgctgcacccacacatacctcctggacaattgataggcatataaacaattggtcctaatagttgtagaaatttccatctgcatttgggataggtcctgagatttatttttgtaactcctctttctttcatcccttgcccctcacaaggtgctaggggttcagaaacaaatcgttttcattccctgccctggaggagatgggcaggtcagcagataattagaatgcagtgtcgtggttattgtccagctcaagagagaaggaaggaaataattctgcacaacaaaagaatggaaaggaaaagttagagaaaatttcatggaggacatgaaattagaaaagtatttgacatataaataaaatttgcccaagtgaaaaagacataactgggtagacaataattagcattgcagtgcaattccaacacaaaatgtatagggaaagtaaaggaggaatctggaattggattgagatgggccttaaatgttatagtaaaaaaagaaaaatgttggatgagaactctactttagaaacacaaaattgactaaaatgtgaggaatgaattagaataaggagagattagggatagagaaacaaagtataagtctgttacaacagacacaagagatgatgacttctcaagtagggtagctgtaaagggattggtgcttttgggcagcagagaaaggcttgcctgttccctggcagctagtctgagccaggcctataataaataagttttgaataattccataagtctgagatgtctttatctatttgctttattaccatttttgttttgttttgtttgagatggagttttgctctttttgcccaggctgtagtgcaatggcgtgatctctgctcactgcaacctccatttcccaagttcaagcgattctcctgcctcagcctcccgagtagctgagaccacaagcccgtgccaccatgcccggctaatttttgtaattttagtagagacggggtttcaccatgttggccaagctggtcttgaactcctgacctgaggtgatccgcccgccttggcctcccaaagtgctgggattacaggtgtgagccactgcgcctggccctattaccagtctaaattctctcccataaaaattcacttctgtgagtgttagttctagtagggttctgctagcggaagtttactgtttgcaaatgggaaggcatctaaattccatatatcaaaatcacttctcctgtcttaaaaaatgtggccatgtagactagtgattttattggccacacacagcatggtaaaaaagacaaattcatgcaatctagtaaatggaaaatctggctccaagtagattatattatggatctggaaatcctttgtgttggctctttgtagttctcaataattttaaaactcatgtcaacagttaggactgggtgtgaaaggataaagtctggaattgagattaggaactataagaatcaaaagcactttcatcccttggtttccatcattttctttgtaggtccattttgggaatgtttacatgctaaacacttaatgatgtagcagctttcaagtttctttgtgtgcctccgtaaaaccagtaatgccgaggaaaaacaagacaaccttgaacagttgtggaaggtttacagggacttcagatgcaatgtggttctactgctgctagtgggagaggggatctgtggtctactgagctttcctctatgtttccgccatatggactactattctagaaaacaatctgtcactgggggtaaattctcaccagtcagcagccacctgaggtgtagttagaaaaaaacaaaacaaaacaaaacactggaataaaaagaatagctctggaagctgatctgtctatatgagaattggtgtgggagtgtggtggtagtggatgtcttcaggaggtaggggaaaaatgtgaatagagacatccaagatcaacaaatctctatttaaacctaaaagaagctgaaataggcattttgagcaaaacaagctaaagaagatgaaaagattacctatacattgaagtgttctcagttccaagttacactttaaaatttctgagaaggaaaaacaaaaatcaatgtttgctatgccgatacacaaacctttcacctctgggaaaagtctttgggttctaagccaaaccaattttgtgagttttacccttcaatcctcaggtcacaaacagctaaacatcttacctttcagtgttcatgccaagaaataaagaatgttagagttcattaccgaagcagcggacagcacgtggcagataatttgtactgagaaaaaggttgtctctcacattggtggttgcatttccttccttccttccttccttccttccttcctccctccctccctccctccctttcttctttcccttcttccttccttctttctaccttccttctttccttccttccctcttccttccttgtgtccttcctttattcgtttcctcccttttccctccctccctccctccctccctcccttccttccttctttccttccttctcttcccttcttccctttcttcctttcttttttctttttattccagtgaaaacagaaagttaagtctagtgggaaaaatgaggctgcactgaaagactggctctgaaagaagcaatcaggcaacaataaggtgcttaaaggccttcttacctctttctttccatctgcttcttgctgaaggagggtctgtgcagaacggcaataaaacatcaatggaaacttggccaaagaatgaaactgagtcttagaaatgtactgatgtactatttgtgcttccccaaccctcctcatccctgtttaggatttttcatttggtggattctattattaaatattacccatcctcttggtttagaggagaattgtttggccccctaccacagcccacccaaggaaagatagaacagaaatttttaaagggagcattttgatatagcatggctttgctgagggttaatatcccgtgcctctagtatattttccaagtctatgatgtagggctgagatgctgagagcattgtgatctgactaatattaccccttcccagaatctcacagatggactacaatgaataggttcaattacttatttaaaattcaaaggtacttcacagtttgaattttcatgactttatagtttcttctttcatctttattccaactaaaattctttagaagaaaaatatttgcaagtctaagattatttgcattaaaaaaactaaaaagaaaaataggaaaggagggaggaagaaatgttacagtattagcaactgtgattcctcattggcctagagattttaactacagtttttatgcaaggcgttttttaacttcactgttttggaggaggcagtagctgagattaattatgtataattatattattattcctcttttcatcaagacataaaaatacatattatataatcataatatatgatccagacaccagtataatacacatgcaaaaaagtctcctataaaataaattcaatgatctgttattgcatcattttttaaatatatttttgttatagaggacataatataaaaaaaaaacattatatatcaaataatgcccagtactaggtataattctaaaaattttattagactagtagatattttcacagtacatgggagtatgtgaaaatacttacttatgatagcctcttgagtgttttgagactaatggaatttctcttgaatttcaagggccagttctttctggaggaaaggagaatccatcagatatttgtttttttaaaaaagccatgtccaaacatacatgctataaggtggctctaggcctagccattctcctcttttcctttaattgctgcatctccatgcaactaaacatttactaagttctttggatgttattaaataataaacttttcacttcattcaaacttggcataaactttgggctttctcataaggtaaaaaattcagcaagactatagaaagaataataatgaattactttggattgcaaagaggattctcctggaattctacaacatctggaatttagcgtatttctgtgaaatgtctccatttatgcttaggaagagagagtggataccatcaggaagtaggaaatttgaaccatgttaatcacatccacaaatgacatttagtatccagatatcagcaaaaggccaaatagagaagaaattaaaataagcaatcttatgaattcagtctgtggtcaggagacattccaagaagtttttaacaggaagcaaataaacaacctctcaaatataagtcattccatatctgaatcaatctaaaattaaaaatgctacagggcaggtggggaggaaggaaatccctgcaagaaagaaatgatcaaataaattcccatcaaggttttccactttttgtttctttttttaaatacacatttacaatatgtgaagtgcttctcattttgacctttttttcccccgggctcaggaaagggctttccaaggtcttcatcagccaccagtggatgatctcagggcttttctgagaatgaataaacgaacagggtgcagatagtgtgaagttagcccacctctcctttcctcctttcgtcacttgccattctgagtaccttttggccttatggagcatgctcctttatagtacagatgtaagaggaaactttttgaggtgacggatatggatatgtttatggtgtagattgtggtgatggtttcacagtgtatgcttatctccaaactcatcaaattgtatacattaaatatgtacagctttttatttgtcaaccatacctccataaaatggtttttaaaaaagaacacaaaaccattactatagtctttctttttttttttcctttttttttttttagatggagtctcgctctgtcaccatgctggagtgcagtggcgtgatctcagctcactgcaacctctgcctcccgggttcaagcgattctcctgcctcagcctccaagtagctgggattacaggcacgagccaccatgcccagctaatatttgtatttttagtacagacggagtttcaacatgttggtcaggctggtcttgaactcctgaccttgtgatttgcccacctcagcctcccaaagtgctgggattacaggtgtgagccatggcgcctggcccactctagtctttcttaagcctctactccatctcttcacttaaaaattgactttttgcaatgtggctctacactagtcaacaccatttctctcatgggtagcatgacctgctgctctgcatttcatatgtatccagcagaaacacaatgtggtacactggtaaatacaggacaccagattgcataaagtcaccagggagttggcacaccctaaggagatcccatcgatttgtagagtcagcactcccaaaggacttcagaaggtgtgcagctgtcatctcagttgccacaatgtcagctttcaggtggcatcattggctgcattttagagttatgatctgctgctatggatttctatagagctaatgcttctcccacctccaattattatttgtattatcattattgttgttattattaagaaaaaagagaaatggcgattaagaacacaagcccagtagtatagttccctgactccaccacttgcccacagactttgggaaaattacttggtcactcttgctttagtttcagaatctgtaaaatgataatagtacccaccttatagtcttgttgtaagtattaaatgatatactacaagtgaaatgctttgaaaagtatctggcacatggtaagaacttaaaagatattaactattattattgttactgctatttcattactgcactctataccgtgaatagtgttctgagcttggaaacacttgcacttgtttatactaatattctcctttgcacataaggtgcttttcttcttattgattctttctgaacatgcctttgagggaaaatatttcttcaaataatagggctttgagatgcaaaattcatacttataggattccagtgtctatgcacacagagatacacttagtgatctttagcattttcaatacaacaaggcatcttggaaaaaaagttttaatcttttcacacaataaaagtattcatacattctgatcgttgttttcatgagaaagcaagaaacactttgccataacttcatcctcccttcatcaagacattaaaaaatgttaattataagataacttaattcagtgagccctgataactccttatgatgcgtaacagcagtatattaggggtgaattaattcaatatgacaattgagatattagtattcctctgttatcttgtacattattcccccccattgtttatgatattttcatctcttcatattgcccaatgtgtatttttatgaatagcattgatagctaacctaagcataatttcaacaaattctatattaacccttttgaacctgtgactcttttggacttaagacattacaagcatgttcaggcaaaaatcagtgaacatttattcattgtttgctgtaagaaccagagcagtgtcctggtgaagaccatgggttccaggttcaacttcctgactctatgcttttctatcctttctgatttggtctcagttttgtttttgtttttgttttctgtaaattgggagtaataatattgtcttagaaggttattctgagaattaaagataatacaaaatatacataaccaatacctggcatagaggaacatgatcactatatttaaactatcattaatatcatatttagatattaaaaccatgtaagaaaattcatggaatacttgaaaatgaaagctttaaaaaaagttttgatctttgcattcctataacaagaattctgtttcaagaattcacttctcacttcctcaacacctcatatggcatattaaatacatatgtatatatatatatatatatatatatatatatatatatatatatatatatgctcctcaacttatgatggggtgatgtcccaataaacacattgtaagctgaaaagatcctaagtcaaaaatgcatttaatacacttaacctactgaacatcatagcttaacctagcctaccttaaacgtgctaagaacacttacattagtctacacttgagtaagatcatctggcaacacagtgcactacggagtatcagttgtgatcatgtggctgactggaagctgcagctcactcttgttgcccagaatggtgggagcattccattttctacccaacatgtattgttttcacaccatcgtaaaggcgaaaatttgttagtcaagaatgctgtgtgtgtgtgtgtgtgtgtgtatttacctagctatttcttaagtaatgatgctttcttgcctacatttaaaattttacttcagttgattctgcactatcagactgtaattatacatatatatatttgtactctctagaataactatttttgaaatttttgagaaatatgcttcatcctgacattaccattgtcaagattaatacctgttggcctaaccaatccacataaaatgtagacctcttttggcctgatatgcctgatttctaagcctatagaatccagcccgttaatgagagatgctaggtttgtcctcagcctagaaattaaggagggagatactgggaggaccgaggaaaaacctgttcacttgtatgaaactgaaactaccctcacatttcatctttttatactaggtagccagtactccttcttggtatcttgtctgtctaacaaaaacctccaacaagaaaaaaaaatgtattagagaaaagcctcctactgctttcagctgctgtagtcagtcataggcctcccacggttgtgaggcgtctgcgctcctgttttctggctgggctccctagtcatcggcaggagctacattcctcaaaagagagctgacagccagagcaaggaggaagggaaagaaactgagacttgcaaaaatatatgtttctggttttcaaagtttgctctctattctgctgtatgcaggagaatattcctcattataatggaagcccaaggccagatggcctgtggaagtcagtggacaaagccacaaggcactcgggacttgtggctatcaagttttaaatcatcccctcatctcacgaggtagaactgacctgcgtcccatttgtcacccccaacctattgtggaacctgtctcactgccctacatatatttgatttcagtctgtgtcttcctgagaggcagtattatattgtggttgaaagcaaagacaccagcctaagactgccgagttttgaattctggctccatcatttcttatctgtgtgacctcgggcaagtgttttaacttctctgtgccccattagacttatacatataaagggaataatagtaataaatagataataataaatctacttcacggcaatattgtgaagattaaatgagttaatgtatgtgaagcacttagaagaaagcctgatacaaacatagcaagtgccatccaaatattttcttttatttcttaggagtagggaacaggttttaatcaatttttctaattccaaaacctcagcacaatgcctggcacacaatatgtaacccagttctcaaagacaaagctatcctgtagctctaaacagtaaacacctcaggcaggctttaatggcaaagcaaaattacatgcttctgtaactacaaaaaaatatatatatatatgtaaggaacataatacaaaagaaaaaagaaaatacctaattcgctgtaacaggaaacagaatctcattaggatctgctttctatcaaactaaaatgtcctagtaaccagtctttcagaatcccctcctgaaatacagcagcaggccaattaattagtatgaaagcttagtcaaaaggacaatactacctggagaactaagcaattcaggcagcctcacagcatttaattgagccacagaccatagaacaactttgtttggtaatttagagcatacatttccactggagcatgttttctgattcaggtcttctttgtggttgcttttctgctggtcaaatgtgtcctgaaagagtggtgaaaacatcctctgcccacacagtgggtacaacagggatagactatcaggctcttgcccacatttattagaaaatttgagcctatcttcagacacaaatactgattcatagaacattagtgtttctactcattttccaggaaacattcaatagactaagtaggaagctggaggagggaaacctttggtgttctgagagacccttaaacaatttgacacccaatctgaatgtaatgctgctcatagaaacccaacatagcagagatgagccatattacagagcagttgcccctctttctgcaaattctagaggcctggctctggtggatcaggagggtctaagcttttagcccatctgcacctgctgcacctcagcctacattgctctaagttctctcaaatatgaatcccacatggtactggcaaaactgctctggattagagcacagtccatcctgccaagattctggagggattagttaagtgaggccatggagaaggattcctttggggagaatccactctttcagaaaaacacaaaagcattactctgtgttgggtgccaattgaaattacataatagatagctatgacaaggaattaagtaaaattcattaaactcagcacagtatatcataacactggagggaaaagtaaatccctgatgtccaggctaaactagcttttttcagaatttattgtcatcctgatttgggcatgtcagtgggaaagggaaagactaaagcatcactggggtatctctcaaggtaattgactaccttgcaggctcataaagataaaagtctggctcgcattgtgctctcaccaaagggctgccatgcgtaccaggagctcagaatgaaaaggtgttcccctcccagtctctcagggggttttgcttccacatcccactctgttttctcaagagcaatgtctccaaatgagaatcatttggcaaataaaatgaatatcaggatttgaacgtctgattttaaaagctgcttacatagaaatccacccaccgttttgaaaaggcataagatgcttgaggcttattcccagaactaaatgatgagatgggctttgtgagactaaaaggataacagacaccaaataaaaaaagcagtacaaaaatgccccaacctatgtatagccaccagttcataaaaatatttttttaaaagagagacaaatttaatgaaggcacgggagagtctaaattacttttgtcaaaagtgaattgaaatatacttaggtcactccatctaagtaatatgattcttcagaatttgatttttaaaaattctcagtttcataaagtacttataggacttatgtcaaagttataaggagtttgttgtttcgtttgtttttttattaaggacaggtggtgatgttggaaaatatgtaaaatgattaataatgaaactactgaggcttaagctaaccaatatttattgggtgactataagcttcttagaacaaaacgtgaatctatggggtgggaacatgcataacaagtatattacacattaaatcaatactcgtaaatcactaggtaccatgtaagaattataacaaatgagcatagaataatttctgcctttaagtagcttaaaatatagaaagacagtcatgttatcatacaaagcttgataagatacctgaaagtcaggaggttctgttaaaattctatgagagtagaagtaggagtgtgagaatagatcaaggacatttgagctagcatagacaggatggatagaaaataaaagagatgggccatgaggaagtgaactaatgagaaggcaaaggtgcaaaggaaaaaacccaaagaatttacagaatgattgtgagcagtccagtggctgctccaagctcaggatgtcagaagtggaataaaagaagataagcctggaaaaataattggaattttattctctaggaaattgccaaggggactgggagatatattaaaagatatttgtttttgcttctgttttgtaacagggtagtgacacaattagaaaatgctttggggaagagattagattgtaatgaaaatgaagtaagactgatatgcccatgataccccagagagcagcccagacctggggcctgcagacaatttcatgcttcaccctttttctcaaggattggagagggagctcctgcctcccagctgatcttttaacagttgccatatttttgggtagaggcctttccactcttggataggggaagactgggcttcttcactccaccaggcaagacttcccagaggagttagacattgctttggctccttgtgctgggatctgtattcaaattgtgacagcgtgaactttggcaagttacctgatctctccatacctcagttttttcctctcatgaaaaaagcttagcacattggttggcttatggaaaaaaaaaagccataactagcagctatgattacaaagagtcataaaaaattggttcactttggttctgtgaatattcttttcagtaaaccaatgtgtagtccacttcatttgatatgcaatcaaatagatttgcagataatctaagaaaaatctcagtacaagcaagtgcggcattagcattttgaactgtgatgctaacagaacaacaaagcatgtttaggcagcggtgtcaattgaatggctgagctttgtacttgtacatattcccccattaaaatacagcagcatgagaagttactatactctgtaagctcttccctgaaaagaggaaaaacaaccgtgactcatgggctgctagcttattccacaaaaggggccctggaacgatgcctctttcttttacccaaaattacgtttgctactgttctataaggtgataaagaagctctaattctcattgttcttgagatttatacttggagtcatgtcagaaacagagtagaatggatcatctatcacccttcaccttgcctggcagtgctggcctgaagcagaatcctcagatttttctttgttgcccctcatccccttttacctttcatctcgtccctctggcacaccaccttgatgcgtacactttgcacatagtcatcgtattttttccactacatttgtagtccaggcttcctcttgaatccatcagacaatgaaaataattgatccctgttgtgttcttggtaaaggtcagagatacaatcatatcagccgacttgatctgcttgactaccggcattgtgatttctaccgaggcaatttaaaagcgttgtaaactgtcagacttaagactgtaagcttggccaagcactcaacaaagatcccaaaggcatcacataaaattgggcaaggagccctggttactacttttcaacatctggccctttctctgaatctttctaaaaggactggaaatgcaaattgaagcaggactttgtttcccttgacattatgtatttaacctaaaaaaaaccttgattttaagttgatttattatgaattttgccacttaacctgacaattgactgaaggtgcttctcaaaatgtctagttactaatatgtaattaatttgttttgttctccagtttaatcctctttattaaaaactttgagggaacaaaaaaaaaagattattgtaatgggctttctggtaggtgcagaaaaacagcagggaagattgagaagtacaagaaaaacacatcagaaataaaataaagtttggatttaacacataaaattggcaagatattccagagaaaaaagcattaggaatacagctattcatcaagaatgaaaaaatgattaaagttgacaatcaaaaaaacacataacacctttgtggagttataagatgctcaaagaatgctttagaatatatcggttcctacttcaggtttgtttgtctaagaggcataaatgtttaaataatccatagggattgacagtagtaatagttccaatgatcaagaagtctaaagagaaattctgcaaaaggaaatagatactatacactgagtacttaagaaagagaacagaaactagcctatgatgctgcctcttgataagttcatttgtagtctagtctcccttacctctgtctccacaaacctggctcactgcaacagcctcagagcttcctctacttctagtcgtcctccacctgatttccatagtaatcttttaaaaatagtactgtcagccaggtgcagtgggattacatctgtaatcccagcactttgggaggctgagatgggaggatcaggagttcgagaccagcctggtcaacatggtgaaaccctgtctctactaaaaatacaaaaattacctgggcatggtggtaggtgcctgtaatcccagctacttgggaggctgaggcaggagaattgcttgaacccgggaggcagaagttgcagtgagccaagaccacaccactgcactccagcctgggcaacagagcgagactccatcttaaaaataaataaataaataaataaaatagtactatcattgtggcagtctcctgttcaagaactacttgcaaccctctaactatatttgatattctgcatgctctcctactctgtacccctgtccagccttagctcaaactcttcccagcacagaccttctgcttgactctggcctctcttcttactcataacctgtagacagatgccagtctagtgcttctaccaacataagtctacctggctttaggtaaaacaaaaggtttactgtaattaaatgtttctctgattaaaggaggcaaaggtttcatgcctgtgctttccaatacagcccccactcatactgggtttgtcacttttgaaacttgggccttctagttaccttagaccattcttgttccacttctgcttctacaaaatagtctgctgaataaggaagagtagataaagaagacaattttctaaggaaagtctggcattggctactttttcctgacagttctcattcttaattatttttttttcctggttccaggcacctttcagaagtatatccctaatttctaaactttgtgttttctcatttctcttgaatatttgcttaatctctctctccctcatctgatctgcactcccttcccttctcttttcctttgctttaatattctcctttccaacttttccatcctactttctccccccttaatcctgggccctcttgctttctactttcaactgttcatgtctgacagcagtgtgagaaccccaacttagaaagaagatgctatttacttgtgccttttaaattgtcatatcaacaaaggttctgtgtgccagacattgcaggtgcagcgagaccaggctggcaggtgatgctagaatgagcagtacatccacaggtccagaggaaggcctgccaaaaaatgactccggatccaagtagagaatgcagctgttgccatccaaaatattagatcagggagaaactgtcttggagtcttttcaaaactagaaacttgaattaaaaaataatatggtgttttaaaagtcaccatgtttaaatccacctgggaatccacctaactcttaggaaacaggctattgtaagaaaagaaaatgaacattccaactgctaaaaaaaataaagttgtaaattcttcacatgctattgagaattaaattactatataattccactgctgttaaatatgtaatgttagtgttcaactattgacctctctgatgagtttaatgttagtgtaactaacacattgctgattttctctaatctaatatttatcaagtgcctgtaaagcatgaagctttgtccactgaaccatttcatatgaacagctatttcaaactttgcagctctaggtatcctatattcacatcatataatgttttgtattgcacaaacatcttaagttggtgtaaagaaaaaatgaagacagtttgaaggtcagtttcttgagtctgtgcatgcatgtggtgtatgtgttttttatgtgcatgttttacctctgcccttcaagtttatgccacttgtgttcaatttctgagtccactctgtacctgttttttaatacttacccacagagcaaataataactactaagtgaaaagtgatagcaaaatctcttcagtctccagaggaattgagatttcctcaagattgagaggacagtaggaaaactctttacatgtgaattttatttaaaaaataacttacaccaatgttcaacaccatttctcatggaaggaatgattgcaatgagaaaaagaaaaaaaactgaatctacatgtaacagaaaggaaaaaaaacaaactgaatctacatgtaacaggcatcaaactaggtatcttcacaaatattgatttattaaaacttcacaagaacccagaaccactgcaatgtccccattttttcacacttgaggaaactgagaaccacgaaggttaagctcatggagagaaatgaaaaatgatagagccaagatttaaacccaggtgcctgggacaccacatctcatactctttcattatacacatcttttgaatatgaatttgcctcaattcctcctctagtaatgtcatatcgaattggtcttgtggaagaaaagtgacttacgtaaattacctgaattttaatttgaatcttttccataactgagaaattctggtgaatatataatatctccaggaatctcaatagcagtccttcttgttttctttgttcagatacagttactttaaactatgtaggaacttttagaaatctactttaaaaaatatggatatttgaattctcattttgttttgttatgtgggtgactagaacatgcagtagcaataaaacttgtttcattttttttttgacactaattttttttattatactttaagttctgggatacatgtgcagaacgtgcaggtttgttacataggtatacatgtgccatggtggtttgctttacccatcaacctgtcatctacattaagtatttctcctaatgctatccctcccttagccctccacccgctaacaggccccggggtgtgatgttcccctccctgtgtccatgtgttctcattgttcaactcccacttatgagtgagaacatgcggtgtttggttttctgttcctgtgttagcttgctgagaatgatggtttccagctttatccatgtccctgcaaaggacatgaattcatccttttttatggctgcatagtattccatggtgtatatgtaccacattttctttttattgcagcaccgttcacgatagcaaagacttggaaccaacccaaaacttggtttctgacagtgccttttgtactgaaattgaaacatttttctgtccttcaagtttattgcttaccattctccagaaactgaaatgaaattttactcaactctttttatattgttacagcttgatagaattttaaaagtttcaacaatccaatcacaattcttgcagatgtgtctccccaagggagttattagcttcaacactggtgtacttcctgggcaggtgtgtggctttggctttcacagtgtaggtgtttatttttaattaaaggcttttccctcaggtcttctagaaaatttctgttgataacagtggaatctctctgtgtggaatggttgaaaaaatgatttatatcaacttggttttcttatatgtcaaggtggtgttattggtacaagcagagccaacttgcaaaggaacacgcttctcttttgtactccatacttcctttcccatgacattccatttgtgtgtacacccccaaccctcccccaacccaataaacctggtgtttattccctttgtgttctatttgcgttataaaaagatagctaatgaaataattggagagaagggtccctatcctgaggctttttaatacaaggacttttcaggggtgatctcctgagagcgtccagttttctacccaaaagaatagaagtaatggtagaaattttaaagcaattgtaaaagaagatggcagcacatcacagaataaagagataagtttgaagtgttagagtcttgagctgcctcacacatcacatctctaagacagtcacctaaataataccttcacatacaggaggccctaacacaactttcttccactggaagagaagatgtgtatctcaataaaggtaaaacaaccaaaaatgtgattgtttggttgtcaaaacaaccaaaaatctcactttagcacttttcatagaactctgatccaagagtggaaggaggagtcattgcctccacaccttcacaattcaacaaggacagatttaatttcaggtgttacggttttgccccagactttcctttgcaatcacacctatttcacctccagcccactagttacatggccctattttatgcctcatccacacctgcatgcccatggcaccaaagaaagctttagctaggtgtcatgagtatgacaaacctggaccaaggcatttgatctttggcaaatgaatgcgtgcttttctgttcccataaacatccttggccctacagtttcacctccactacagacaggtgcctaaataggctgagccagggaagcagtctctctggctttccgctggttttccaattgtgttcatcaccgactaaggtgctgcactctgccacatctcgtttgccgccatatcacagaattggcacactgcggtgatgtgagtcagtgtgtggcacagccattagagaatcacctcttctcagaagtgtgcacagcctctcagttgtgaggaaaggaggattggatacccacaaacattggattttcttagtggaagcttgtgttttcactggttactgatgcacacacacctcaggaccagaattgtggcacatctggctgcaagtaagccatttcagttcaagttgctaagctcagaggattaattgtgaggcatactaaaggagagtggtggggagggtttgagtcatcctcatcattaatataactgagtgattatagacccttccctggagaaaatcagacagtaaccggccattgaaatataaaatagaattctgaagaagcctggcacaagatctgtgctttgtagctaagaatagcaaggttaattacagaagggagtgacagaaacaggaaagcagccatcgcacaaaggagaagttgctgcagtggtagatctaaaataattggtagcaggagctggtctcagagttggcaaaacattaacccttgagggatggagtttggagcggggagaaattgagactgagagagagagagagagagaaatagagagagaaacatacaagcacaggtcacttgtggtttcaaataaaggatagctgcttatcaacccaaatcagtttctaagtctttaattatatttgtcagtatatgactaagcctccttgaattcagaatgtgtgattttacatactcatataattctatcacatagtttttctctggcaaaccccaaatacaataataaaagcagagtgtttatgtcaaacaaataagtaaatacattttaccctagctaataagttttctagccatatgtctatcatatatagcagtatcacagacagaatgaaactacttaagaaaataataatttttaaagatatgttagtgtttcagttaacatgaaaatctctgaaacaagtacataaggtcaacctttactcaaaataagttttctaggcatctagtattttttccttataattctaggccaaagataattacctttatcagaataatacctgctgttctatttatattcagctttcgcttttagtcatatctgattatatagacagaaaatttgagttcaaccattaagatcagcagtgaggaataaaatatttaaaactggaaatgggtttctaaaggaagctttgtcatccttttcctaatgcttcttggattaattttttgagatttttttcatttgctttgctgaggaataaaagtgagggataatttagccctgtatgtgcccaccttcatataattctcggaattccaataatgctcactttattattattactgtgattattatcatcattattattaagcattacttgagcatgtactatatgacagccatgtattagagtatataaacgcatgaattataacttgtagctaagtatgttgatactattattcctatttcaaagaggagagcactaaggtgaaaggaggtttggtaattcactgaaaatgtataacaaccattaataagcagcagaactaggattcaaaggtagaatctgtagttttcccaaaacaccttgctgtttcttatttaagcttttcataattattacaaattctaacgcccttagtatcattagcagtaagtaactgcatttatttttaatattcagaattgggttactcataaaaacattttctatattccttaacctgaagcccagtttagggaaactgtctgattttatatatattggggtttcttcaataaggagagcctgtggcagaccctaacctcatggcaaatgaaggggttcaggatacactacccccaaaatatggtacattggcatattaactattttacactaaaggaatttgataaagagcacatgcaggaaggacttgctaaccttctccccactcttcttccctgaagcagatcataaaacctaagaaggattttctgaccttgccctgaaacaagtcataagaccctcatgtgagaggtgccctccctataccgagaggaaaggaatatccttatccctgaagatgaagggtcacagagaaaaatctgaaaaaacaagccttgccaagttttctctagtttattaccattagattatactgtttcctgccctgtcaatttctccctgtctacttgtcatcaaacctcgcataaaaatctataggtttaactatttctttacatcttaatttccttatgaagactcccatgtcttgtaaaacttatattaaatacatctgtatgcttttctctttttaaattttgttttagatgcctcaaccatgaacttcctcaggacagatagaaagatatttttttttcttctgcacaaacatttcctagagataatgggatgaataattactattaagaagtatagtgaggggctgcaaattaccccccaggtcatcccaattctccttcccttatttggaaaataattgatatataggacaaagaaaagcatcctgtatattctcctttctcagagttcctgaactagataaagtagcactcagcagaatgcattagtttgtatatgaatgcatttgttgatatatttgttttatatggcattccttgtctgtccattcttacttccttccactccccacccctttttctgctctgctccaggtcataggaaactacatttgtcagactctgctgcctgttggcttctgggcaggttccaccaatgagatccactgtagggagatatgagggaggaagcaatgagaagtcagagtacttctctcaacctctttcttttttttttttattattaccatactttaagttttagggtacatgtgcacaatgtgcaggttagttacatatgtatacatgtgccatgctggtgcgctgcacccactaacccgtcatctagcatgaggtacatctcccaatgccatccctcccccgtccccccaccccacaacagtccgcagagtttgatgttccccttcctgtgtccatgtgttctcaacctctttctatgcttagagcagctgcatctcctctgtgattctggttcctgttggactgcccctccctccactgtcacattcctacctggcagctccccaccatgggtctatctcctactgcatggctccagctgctggactttggccaacttgttccaacatttgcaggccccagggggcaaggggacaaaagaaagcccatacatctatgtctcatgtttaaaagttataaatcaaatacaaattgttaaaagtattttcgatttttttttctattttgataaacatttttataatgacatttaaaaaaataccttgcttgggaatccatgagacaaacacccactttctcttacttattaaggagtggaggggagggtagaggttcttatttcctagacccgaggcttggctactcattaccttagtcctctctaaacacctctgtctgggaactaaaaggattttctgaatggggacactagttcaaactaagaattccctgtccacaagtgcttccaatttcacaacgtggcgggtgttgaccctttacgtttctcaaagagagctaaggctgcaagtccaggttcaaatttagaattttcagactcaggtttcaggcttgtggcccatacctattcactttctcttggctccatttcgttctctaaagagtcttgactgcattcacatggacactacagatcttacattccaagccctagctactccctccccatttgtaaacagctacagcctcttggctaccttgtggctctggggttctgtgctgataaagtgacgatagactcagggaaagtggatgaagtctgtcatccacttgggtagagaaggccggggacctacccacctggagcacagtctggaagggggtggggggatgggatctgggtgtttatgtcttcttgacccaggagtttcttctgtcggaaagaacatagacaggaaggaacagagtaggattttttaaaacgtggagcccagatcagagttcctccttttccaggggggagggtagcacaaattttgagggtctgccaaaaatgttggtggtggcatcttcctcctattgctaatctcttggatgtatcactgttccctcttcgtctcctcagccttctcttacttgcttaacaaattccttataataaaattccatgcctcaaaacacctggagaggtttctgttttcttgactgtattctgattgatatagcttgtttaattttttttttaagtgttagaatgcagtgatgttttctgtacattgtacgttggatttatctgaactaaagagaataagctctattacaaagatagattcagaggtataaaatgttttctgacaatctgaatctttttctaacacatgcacatttcataagtcatatttcaaaaactattatatatttagctgtacctaaatttgcatgtggagttacaaggtaaataggacagatggagaaaaatagaagtggaatatttcaacatgccaagcagaggggcaagaaagtgaaagtgattcaactaaatgctgtctcttacctaatatagagcctttgatggcaagctgcagcctttgggttctctacaattcgctccgacacttcccacattgaatctttttcacgtgtcattctactaggacagtgcactgttagctcttaaaataagacttacacatatggtacttatataatgaagataaaatccgtgcagtggggctggaaatgttcacatttggtttcttgataacgcttgatgagagatactgcctgggttatataacaattcaattcctagttgttttttttgttgttgttgtttgtttgtttcctggaaggtgaaacagtttgacatatatctgaataccaatctttgtccctttttgctaataaataagattgtgtgttttgaaaatcctgatttcagtgataaaacttatattccatattttcatattctatatcaccttgttcaattcatcatggataacatcattactgagaaaaatcaggaatctatttggtgacgttctgtcatttctgtttctgtgcctttgcttataactctctctcactgcagcaagcctgctctgactgacctggtagacactgccaacatttggcaacagagggaaagggaaggtaatcaactttactgcctgatgttactaaaaaccacagccaagtttcaattatccgtgtcagtagattcggtgatctttgaatccatatctaatatataaataacgaggtaacaagagaaacaaacaatggagcttcatttgatcaaaagttgctgtattttttagtcatgatttctaaagtcatcatcatactgccttcaattgaaaaaccgattcaagccttaggctaggactatggctggtggaactgaatcaaggaacttggccttcatttttaggtaaatgggcatcctgcttcccctaccatttccatattaaattttctaactgcccccaccccacaattcaggaagagcagctgaaggacctgagacttcacaccatgaggccaggctgcccaggatattgatggaaagcacagagagcctcctccaagggctgagaagaaggtcatactatctgggaacaataatgtttttataccataaacccacccaatagaggaaggagagagtgagaggtaactgcacatgtcactaccacctctacgctggtgatgcctcatgcaaacaccaagggaggagatgcagttcccacaactcttgcacctgtgctgttaaagatgtgcagtagtctacctttacttttgacagtcactgaaccattcttaatggagtcagagaaggaaagtcaataacctgcaaaccatacaatcaacctcactgccatgaattgaagaggtgctggttcatatttgtctccaattgtttgttgtcttccaaatgttgacattgccttcttattcacatagcagaaccagactagaatatgtctatgaatcaggaaatcttgttgacttgggagagaacctgagaatatatattctacttggtggactagtaacactatatttgcatatgaagagtggtttataatgacttctagcttgtctgtggagttatgttatcctattgcttctgttggcatttaaactaaacaataaattgtgttttaccagtgactctcatcaaacatggaaccttttatcataatagccatattaactaagttgatgaatatccaaagtgagataggcttattattgttaatagctgcaataagtacaattgacagaattgcagtatgaatttcaaggagttaaatagacccatgaaggttaatcacagtgaaaaactagcttgcatggtgatttcctagctatgttgcattacaaacgagaggctcagccatgttttcatctcattatttttactcattttatctttgctttcttatcccacttctccctatctcccaaatgcatatttcgggacatggcaatatttttctagtgttaatatgaattgatgtcttccttagaaataattagagccctacatgtcagaaaattatgagacagagtgtctttcagctcaagtaatgttccaacacaggaggcaaagaaaacgcattatctgaaaattactccgtataaagtgaatagtcatgttctcacttgagttctttggaaacagatggccattctcttagtaataaaaataattctccttacttaccaagcttttatttcaaaatatattcctttgaattatgtcatgttatcctcataccatgtctatgagggagatagagaccaagacatgatagttcatagagctctcagcagaaaagtataaacccagtctccaaacttgtcatcacctcccagggatctcatgacatatctcattccatactaggattgagactgatccatttatgtatattgcttttctgcttttctaggaggaaacttgctactgccttttaaaccaatgtaaaagtgtatgtcaacagagtaaaatcagagtttggttatgttataggcttatatttcagttttgccactttgaagcattagttggccaagttctcatctttctcagacttttactccaggataaatgcagcctaactgatgcacaactgcatcgataatggaaactgcataagagtttggtcagcaacctttggtgctatgagtttcatcattgcagtgataatggaagtcatggttgtttccagtgaaggttgtttgttaatatgtgacatcaatagagccaatatatatcagcccaataaatgctaagggattccactatgtaaatgactttctactttctattagttccataccacagaccacttagaaaaaattaaggacacttctactgatatctctctctctctctctctctctctctttctctctctctctctctctctctatctctctctctctctctctatatatatatatatatgctttgaggaagccttttgatgttaagctactaaaagtatcacatttctatcattgagctatgagggaagcaaaggtgatagctccaagcttttcttcctcagcaataaagttgctacagctggggatttcggtgggggaggaggaatattggttgtcaaaggtcttaaatgagaggagaacaaaagatttccaaaagatggttcataaatcatacaatgtgaaatgaacgcagaaagaagggtgaatatgttggtaatttgcaaggtttttttaaatggagaagtagccaagcaaatgaatactaaaaaagcacctatagttgcactcaaaatagaaaatccaattttgattatgatacatgttttatataagaaaaatacatttaaaattgatctctctccaattacatttttacatagctcatttctgccattcattttctcccttacatagagagagaaaaaacttggccttacaaagacagagctgatggtttgaaatcctactctactatgtactaagtttgtttatttttgttacttggcctcttggagttttcgttctcacattattcttgagttattattagagtaacataaaaacgcacatgcaggcactcagtggtactaaattacttttccttataaaagaaaaattgcatggaacacttgttaaagatggcaaggaagacttttcatctaaataggggagaaggactattgcaacaggggagagagattgaacgcaactctgcagaaacaaaaagtgaatgctgaggtgagccaatggaacattgctggtcatagagggaggttggtcagtgtgataggccatctgtgtcttgctaactgatagactcaggccctcccacagagactagaaataggggaactatcttctttattctttttttaagttttaatttttacgtatatataataattgtatatattttctggggtacatgtgaattctactcttctggtttttgaaatatacaataaattattgttaactataatcactctgttgtgctactgaacactaaatcttcttccttctaactatatttttgggccattaagcatctcctctttattaccctctccgtattagcctgcccagcatctcgtaaccatcattctaatgtgtgtcttcatgagatcaatatttttagctctcacatttgagtgagaacatgtgatatttgttcttttgtgtctggcttatttcatttaccataatgtgctctagttccatctatgttgttgcaaatgataggacttcattcttttttgtggctggatcatattccattttgtattaatatgactttttaaactattcatccattgatggatacttaggttgattccatattttggctatagtgaatagtgctgcaataaatgtaagagctcagatatctcttccatatactgttttcctttcttttgaatatacacccagcagttggattgctggatcatatggtagttctatttttagttttttaaggggcccccatactgttctccacagtggctgcacgaatttacactcccaataacactttaagaagattccctttctccacatcctcaccagcattcattattgcctgtcttttggataaaagacattttaactggggtgagatgatatcttattgtagttttgatatgtgtttctctgatcattagtaatgttgggcagattttcatacgcctgttggccattttttatggtttcttttgagaaatgtctattcacatcttttttttcactttaattggattatcttgtcttttgggttttttgttttgtttagtttttgtttttgtttttgctattgagttgtttgagttccttatacattctggtatgggtagttggcaaatatttcctcccattcttttgggagctgtctcttcactttgttaattgtttcctttactttagagaagctttttagcttgatgttatcccatttgtctatttgcccttacttacagggtgttaagaaatctttacaggtcaagaaatctttacccagagcaatgtccagtagttctatagtttcgggtattacatttaagtatttgatccattttaatttgatttttgtttatggcaagagataggggtctagtttcattcttctgcatatgggtatccagttttcccagcaccattaattgaagaaactgtcccttccccattgtatgttcttggcaactccatcaaaaatgagtttactctaaatatatggatttatatctagcttctctattctgtttcattaatctatgtgtctgtatttatgtcagtactatgatattttggttactatagctttgtagtgtcatttaaagtcaggtagcatgatacctccagctttcttctttttgttcagattttttttgactattctgagtcttttgtgattccatttaaatttaaggatttctttttctatttatatgaagactatcattggtattttaatagggattgcattgaatctgtagatttatttgagttgtgtggacatattaacaatataccaaaagtagagaaagactacaaaaaaaggaaactacagaccaatgtctctgatgactatagatgcaaaagttctcaaaaatactagtgaactgaattcaacaacacattaaaaaatgattcatcacaatcaagtgagattcattccagggatacaaagatggtttaacatacacaaattaataaatgtcatacatcacacaacaggatgaataacaaaaactatatgatcatctcaatagatgcagagaaaacatttaatgaaattaaacattccgtaatgataaactctcaataagctggatataaaaggaacatagtccaacacaataaaggccatgtatgaaaaattcacagccagtatcatactaaacaagggaaaactagaagcatttcctctaagatcatgaaacaaacaagtatgcccacttttacaacttttattcaagataggactggaagtcctagcaagagcaatcaaaaaagggaaataaataaaggacttccaaattggaaattaagaagtcaaattatccttatttgcaacagattatatcatcttatatttagaaatatctgaagactccaagaaactattagaactgataaacaaatttagtacagttgcagaatacaaaagcaacattaaaaaccagcagcatttacatatgctactggcaaacaatctgaaaaagaagctgagaatgtaatacaatttacaatagctacaaatattaacaaaatgtctaggaatacacttaaacaaagaagtgaaaaatctctaccatgaaaactataaaacattgatgaaagatatggaagaggacacaaacattgaggagatattacatgttcatgaattgtcactatcatgatgattacatttcaaagtgataagatccttgagaaggacattcttggtttatagaagatttacatttcaatggtgcagagatgtaggaagagtttatttataattgtaagttttctaaaatacaattgattcttgaacaacatgagttggaactgcacaggtccacttataagtagatttttttcaataaacatatcggaaaaatttattagagagttgcaacaatttgagcaaacttgaagatgagccacctaatctacagatattgaaagtattaagaaaaagttagttttgtcatgaattcacaaaatatatgtagatattagtctatgttatcacctcctgccataaaatgtacacaaatctattatacaatttttaaatttatcaaaacttatgcatacaaacacagattatattcactgtcgagagaaatataagtattcagtattaaattctaactgcaaaaagttaactgtattacctactgtgctactgtaataattgcatagccacctcctgttgctgttgcagtgagctcaagtggtactagtatctactgaaaacagaatgtgactctgatcatctcagaaaactagttttatctctcaagtaaattgcatattgcataaaaaagtgatttcttatggttcttgcatatttttcatcatgtttagtgcaatattgtaaatcttgaataacaccatgggacccatacaaagcaccactagtgatgctaggagaataagagaaaagttatgacattacaagaaaaattgaatttcttgatatgtaccatagattgaggtctgtaactgtggttgcccactattttaagataaataaacccagtaatgaccattgtagaaaaagaaaataactcatgaaactgctactgtgacaataggcaccaaaaaaatcagtttttcacaaaatattttttaatctcatagtgaaaattcagcttttatgtagatgcaggatttctataaggaaagcacatctatggactctaatataattcaagaaaatgcaaagtcattgtatgacaactaaaagcaaaaagaaggtgaaggatctgaagttgaataatttaatgtaagcaaagaatggtttgatgcttttagaaagagatttagctttaaaaaatgtccagataatagcagaagcagcttctgctgaccaagaggcagcaaacaagcttttggagaccatgaaaaaactccctgaaggaaagaatatctgcctgaacaggtttttaatgtagatgaaagtgtcctattctggaaaaacaaaatgccatgaaggatatatattagaaaggaaaggaagcaagcactttttaagtgctctaagtgataggctaattcaccagtattgcaaatgcagttaggtttatgatcaggactgccctttctataaagctgctaatttcctaactttgaagggaaattataaacaccagctgccggtcttttggttctgtaagaagaaggcctagagaatgagaacatttttttctggattggtttcattggtgttttgtccccgaagtcagaaagtaccttgccagtaagggattatcttttaaaattctcctgatattgaacaatgaacaatacccctggccatccacaactccatgagtttaacactgaaggcatcaaagtggtctgttcatccccaaacataacgtctgtaataagcctctagatgtaagagtcataaaaatatttaaagctattacacacagtactctatggaaaggatttcaacattacagaagagaaccctgtaggaaaggattgtcgactttatgaaagagaaccctgtagagagaacatcgtgaaagtgtggaaggattacgctattgaagatgccatcatttttatagaaaaatccttgaaaaccattaagctctaaacaataaactcctgctggagaaaactgtgtccatatattgcacatgtcttcacaagtcttcacaggatttatgacagagcgaatcaaggaaatcatgaaagagactggatgtggcaaaacaggtggagagtgaagaatttcaagatatggatcttggagaaatttcagagctgatagacaccactccagaggaattacataagacaacttgatggagatgagtgcttccaaaccagtgccagacaatgaggaagaggacgtagaagcagtgccagaaaacaaattgacattagacaataattgatattattttcacaattttgccagactgaatgtagcagttaatagtacaaaacttggcagaaagtttcgattattccacactgcttttggcttcttttacaacatggatccttatatgagatgaacactgaaactaaagcaaatggtggaagaaaaactggtgctgtataggaacatttttagagaaataaaaaagcgaaaaaaatcagacagaaattatgatgcatgtccctaaagttacaccgagtgtgcctgcctctcctgcctctccttccacctcgtctgcctcttccatcttggccaccccttacacagcaagactaacccctcttctttctcctcctcagcctactcaacaggaagacaacaaggatgaagacctttatgatgagacacttccacttcaaagtttttcaggctgaagggaaagtaaagccatcttggtcacccttcctcttgctggctatgtcctgcattcccgcacattcagcaatttttttcctgacagttttggcatctattaagttctttgcacatcatccagtccctttagagtccgcctaatctgaaacttaaaaaaaaaattttttgctcatttttactctatgtcttctctcctacacaatcacagatattatttaaaaattgtgcataaaactgacctatctctaaagaattctgttttcagtggaatgtctggggaaagtgacttttatttcttaagagttagggatttggtttagtaattaaataggatttcatgtgtagcataatagtaatcaccttctgtgaagtatgattcttctctgaaagatattttccttgaccacagagtgctttctagaactcgaagcctctttattcaaataatagctctcaaggatccaagtctattataagaccaccttatacttttaattgctttcatcatttctttctctttttcttcttccaataatcttattctaagcaaaaatttcaaccaaaatacaagggttttttttaaaaaaaagaggttatataattattttctaatttccaagttgaacaaaatttttatcactcttggtttataactgactagtaaagaaactcagactttttaaatatttgggttgctgatattgcaggttttcccctaaaaattatattgagtgaataattaaatcatcatggaaaactccgtttgtttcctacagccttagaattaagacaaaaatataacatccatatgacctgaatacattcaataagttcaagtccctgattctaggactttgaagacttgcagagaaacataaatttaaaagttctctcctttcctgtatatttctcaaagtctgcctactagtagtaagaatatagtaaaattagaatcctaattaaaatgtaactacatagcttagatgctgcaattttctgtcttctttatgttttaattttagttagctacattaagcataagtaagtcatccttttgcttctttgacagttatattttgtcagtctctgtatgtcaaagttatatgtccaattgtttcttctactgctctgtttttgccatattgtatgcagtagttaacagtatagaacttggtgatagattatattcttgactccttctctgacttgtgtcttcagagacataacctttcttttctcagtttatctgtctctagagtaatggtagttatttctattggcattctttgttttcaagggaggtactagtgtttctattttctaaatggtttgcaagcaaaggtttctggctaatagcattttctggtctccaaatctgtggtgcaccattaatgaatctgtaattttcaaacatttaggatgaagtttagagtcatataagaatatggactaaggagctcaacatgtctgagtgtgaatctcagcatggctcattacattttacgggaccatgaatatgttactctatttgagcctcactttcttcccctatatatagtaataataacacatggtagttcttcctagaaggactattgtgaaggctagaaataatacaggtaacactgttagcacagtgcctggcagatggcagccacttaaaacaaataggaattttattattgaaaatgtaattttcctgaattatactaatcctaaatatacttaagcagatttacttaacacaaagttaattcttctgattctgttaatcatatggtgttcaaattgttacagtgccacaaagctgttattactcacagtgattattattgtgtgacaaaatatacttttttggctaatagagattgttgatttatacagtgtggattatttctttgttggaatcatgagataatttttcattatattaagttgccacccatctgctatgaaggagataatcctgacttactttgaatattttttctaggattaagattagatttatacccttctgcatgtaagtcccttcacacttattctgggaccaattaagagtagtatatctgagttcttggtggggagtgggggagaaaaaacacagtgaaagcaaagagtcaacacagggaccagacctacagccatggtgacgtttgtggagctctagctcaataggctacctggactcaggctcatggaaataatccacactgggctctttttgtgaccacagagccttctcttactgtttaagccctcgaatattctattatcattgattctaagtgcaatcaatcttccatatacatatgttatgcattcatggattaacaaactgaagattaaaaatacccctgggaaaaatattctgcaatgttccaaaaaccaaaacttgaatttaccatgcatagaatactaggttgaatccaggtgaattaagtgatgtgtaggcattgtattatatattgtaagtaatctaaagatgatttaaagtacatggaaggatgtgcatagattatatgcaaatactatgccattttatataagggagttgagcatccctggatttgggtacccatgagggttcagtaaccaatccttcatgggtggggggaagcaactgtatatgtggtgttggggtgagatgggagttagtaagttactacaaattttctcttatactgtagaaatttagaacatgtcaacaaataacgcatcaccatcataaaattatcaacataagcccaatgttgtcacgatatattgccatataacatgtaacttcttaaaaatcaagaccactaacatttttctcttgttttgcctttaattcaaagtcttcaatctctgtcatacatagcataatgtgttgcctcttctcattaatagaaaaaataagaaaacttcctaaatcatggattcattaagttgataacctatgtactaggcacaataacacatagagaaataaactggaaatagatctttcttgggaagcttacataaagggagataagccaggtacatcaataactataaatactgcaatacaaagatagaaagtgcacatttagccagcagtttactcatttgcttagcaagtaagtgtttttatttctgactacaggtcatactcactacctaattctgagattacaatgaacagtgaccacaataatggcaaatggaaagtctgcctttagtatttaattcctaatttgtatgtggtggggagtgaggagtgtggacaaacaatttaaaaaactgtgataatacagtgtgaaatgtactaatggtatttatgggagaggacagggcccattggaacatgaaaaggtgtatcacagatttaagagagcaagcaagatttctcagtgtatttcatcatatttgttcctatttaccttgagatcatagcctcttattatagcccctaacacattgcattgcaattcctgcaatgcctggtttacatgcctgctacacccttactctcccctctctgtgttttgtgcccaatacgttatagtagcttcatttataaaaatagcttttttttttgcttccaacaactttcttgctttctcaattatgcttatattctagtttcaaactagagtaagaagtacagttgcattgcattctcagtaactgctccttttcgttgactgttttatttgactctaaaaatctacctgatgtcattgtcttctataaagttatagtattaaagaaccaaccacattgcaaccgacttaaagaatgtgttgtagttaaatttcttatgtatttcagaatcacatttatgccacatgctgtattttaagcaaagataattatttctatgtttacgtgttccacattaaatataaatcaggttagaatatgaaatttcacagtctctggcttttgactaatttcaatattggtacattttgagttcttgcaatatcttatttgaaataacaaacaaggaaaagtttcattataagcatagctcctatatttcttttcttcacctttctgtgacacttttggaaattctgggcttgaccaggtcttgtcttgatttacctgtttctctgtattcctttcaaatatctcttcttctttttattttttcagttttaaaaatttgtactacaaaaggtaggactttttttttctcctgagccctcccatgtcttgggttcaagatctttaatgaagacaccagaagaatcacatgtctagttatctagtttactgcagtagcctaggctgactgggcatctctgtggaagaattaggcaaatggctaaagggtgtgactggcacaaatgtgactccatcttttccacagagtccccattctcatataaatggatgaggtggttcgattcaagttatgtattaaatgtaaaactcaagagtaaattctggtgacaatgttatacctagacaacatgaagcctaggaatctagacatgaatatgccagaaaggcagcaaagaaaaaggtgagaattttgttagtaagaagttttagatgtctaagatctgctccagcttaagaatttgagaagatatagacttttttcaatttaagcagatccactaagaccatttggtataaaacaaaggaaatgagacctggaataaatcaaactgcgtgagtttgagtcctggctctgcctctacagagtgactttgggaaggttatctagtctcactggacatgttttattcatagtgaaatctaaataatagtaattacacttacctttcctgtttagcacaaggatcaaatgaggtactaggtattaaatactatgtaaaatccaccacagtttacaaatatcgtttattgctaagttaagggagatatggaggaattgaggaagatatggttcagagttcattaaatgaagtataaatatttggattaatttcagagcagggaaatcaatataatttattccagttggttcgtactttgcatttcctaagcacagcatatgatagtttatcaactaaaagcataataatatgtgtctgtcttctgtgtattaataccaaaggtaatatttaggtttaattttgactgttagttgtaggaaaatgcgaaagaagagtaacatagaaaagataaaagagtggtaaagaaaaaataaaggtttatttcattctcacataaatgtgggtagctcctgatcattaggaactaatttccttctaactgatttttttttctgccatactaaattttcaatgtctacctcaagattcaagatggctgctcctgctccagccatcgtgtaaacattccagctgacaacaaggaggaaaatagaaaaagaatattatccaaagttttacacactattcttgcttacctttcattggcaggaacttaatcatatgacctcagctaaaaccaaagttgggaaatccattctttattctggtgccccatgtgccaacatcatatttgttacagttctgttatgagaacaaggaaagaacaaatattgagggaagccagtcatctccacaacaacagtgattggtgaactcccctcacttaattaccagtaagcaagagcatgtatattgaaacaaaattcccattgatattatttataacagagttattttcttttcacacaacaaatatttattggataaaacctacatgtcagatattccactggacctaaaagaaggaaacaattttcttcttagaagctatattctgcgagataagaataaaaatgagaattttcaacagataatgtgatgatacaagacaaagtgattttgaattcatgggagaaaaaagtaagtgttgtattattatgagatgcaatccttatttgccgtagtcatgcattaaattgcatcctagaaccctggaagaatgcatcttcctctcaaagtgcttcatttattacaagggaatatttcatgcattgagaggctgtaattgagaactgaatgtgaatcataatctgatttctctttgaaatatacacttagtatattcaagctgaattgaataagatagataagtagggcttagacaaagacagatattatttatataatattaacttgattttaaagtattcagttatttatatggtatttggttcatttgaatcaagtagattatgtatcaagggttctcttccctgtggaattctggcattaatgcatgtggtcatagagggaggacaatttgttagacgtaattgaattctctttcttctctctttcttgctccaatactaactttgactactgccacgcttcacctctgaaggcaaaaatgtgtggaaaagaagataagtaggcaaggctggaggtggggtgagaagaataattttcatccactttaaatgaagggaataaaattatagctctccagagaagacccaaaaacacatttcccttccttctccacccttccccaccctgtcttcctcaaccttggcccagatctctccttcttcctctacacaacttttatgtttgtgggtaaaaatgaagggagtttctcagctcatccacattactttaaactgtataatttaaactcacgacataagaataaaacactatacttaaaatatttggtaagatctatttttgacttaatagtctttcggattttgcttctcttttcttgttggcacttttttcctcttctggtttcaaatgaaaatttaaatatgataagacgaaatggtataatgcatgacatttcatactgaagccaaaggagcttaataataaatccttggctcaacccagaaagacagattcagctgtcaccatttctaaacaaagttagaggttattgtgtaatatactgctaatttttcatgctgtgaaaattaagtaaaatggtgtttgacttacttcctgttttcaatcaactttatggtagtcccttttaggactcagatttagaaatgaggtatagtaataaaatttagctacattctgggctgacaaaaggaattggtaattttagaatgttttaaacatataaaacataacagcaatgtaaattcaaaattggaagtgttcttattatcttcttggccttgcttattccagtaatccattctaaacacaggtgtatgccataatttccggtagatgtttttatacttacataactttaaaaatgttcctgtgaaatgtttataacttgcctgatgtaggattttcttacattggatactcagtattttgaccctgaatttctcaatgacaaaagctgtaaggaaaccatggtaaagaaaaagacctcctagagtttttctggactgagctatttttttccaatagataaatatcttccaaaaatgtatttatagtcattacttataaaagtaatattactagaaatagttggttttgccatctgtaatttcggcccaatatagactaaagtaccctgaccatagttatttttcccacatgctgagaaactgagaaactaacctggtagggttccaaactttcaaaggtaattgtctattaaaacaataacaggtagcttgagacgtatcttcaatcttgcttcagaataagggatttgctacaatgtgatttcagtatttcttaaccagtggactgaaatttttatttgcttctcgcaatagcatgaattgcttccatagagctactttgtctattcttatgttacaaggagtgtgtcacaagaagtcaaacagggaaggagatgaaaccataaaatgggatggtgcattcaaagaagaaccaagagaaaaccccaaacagaaaaacagcaaaaccagtatttctgtatcgttgcagaggactggaatatgtggtttcagagttggaagggagtctgtggtataggtcatctgtttttccgatggtaatgagctggtaaaaatacacggtcacttagctaacagaggcttcaatgcttcttagcaattccacattatctagctctttaattcttggcaaagagaatttccagtctgctcacaggtactcaaacctctgatctccctaggacatctttaacttttgcatctgacccaactgttattccaaaaagaatgtagtagccataacagactgagattatctcaccttcctaccataaaatatgctaatttatttacatcaacacccagtttttcttcctttctacctgtttcaaatcaagaggggacccttctttttattaaatttcagtccttctcatgtgctttagatttcatttccatacgacatctccaaaacttgatgcaatcaattgtctctcactcctgattcatcaatttctccatgtgattcttcttttagtatttagacatgttttaatatttcccattgtaaaaaactcatacctacatcctcttttgcagctttaattttaagatactgataactactgctcataattattgagaacttagtatatgccagacatattctatgacctttcttttatcaacttctttagagaaaggtgaggggagctcactaggagcatgcctacctgtggagcttccatttcacttctgccaatggaagtggagccagcagagggctgactccccacaggaatctcactctttccctgataatctgggaaagagtgagcgatggcaccaactaggatcatgaaaatggagaagtgagtggagtttctatatcattattagatgcaatcaaataggaattggtgattgactggatgtgagggaaatacaaggatgatgtccaagttcctggtgggaatgataatgttctttcactgatagcaaacacagaaggaagaacttccttaaggagaaaggcagagttcatttttggagatagtaggcttgaaatatctgaggttggatagctcagagataggcaaatagggatttgaaatataagcacagatggaatcaaccaatctcagggttgattggtacttttttatagaagtcctttgaaatctccatgaattgtcacacctagaattccgtaacaggtccagtggtgtcatttagtgtaattcagttgtagtggttgtttaaaaaaggaggcatttttctcttaggtatgtagagaggtctgaggacaggattaaatgatagcctgccttcttcctgcaccccaccatggcagcattactttgtttttgcttaaaaaaatacattttattgttcaaaagttcatcctaaatattaattatctgatatcattttcatagcaggttctataaagaagtatattagttctaatatcattatagattacacacatgaatgcatagcagaatgttccatgtgtgttattcttttgagaactttaggaactgcctaagtctagataaattactgtaacgggttgagaatatgtatgaattgttattgttgttaatacttttgagatttgccaagaactaaacactttacacttattataagcaatttttatagtaatcctacattgtaggtatttttcattcccatcttacaaatgaaagattgagggtgtgaaaagtttgataatttgcacaaggtcacacatttggtagctttagttaccagcagtcagtccatgactgtctgaattgcttattctaaatcctggatgcacattagaatcacctgaggcaccttagcaattctatgcttgggcttcgccctagacagattacatcagaatctcagggaatagcactaatagatccatagttgttagagcaccccaggtgataccaatgtgcagccaacgttgggaaatactagcttgactcaaaaacctatgatctttttataccaggatgcccctaaatcaaaaattgttttcattccacattgaaatagttctgttataccaacaagaccattgatcaaacatgataaacagaataaataaatgtcttcttgataggaaagcattatcctcttctgccttcaaagttatacaagaaatattttcaaggcctaggaatctcagcatcagggctgcaagattttgtttgctttgcttgttgcaagttgaaagcaattttatatttgcattattattatccttggttttgagtgcctatatatggtgcttgcaagctgggaaaggatatctaaacacacctgagggcacaaacctactgaaaaaggatttcctctacagataaagaacatagtgtaaatcagtttctatcttacagtttacaacatggtttttaccctttgcttatttatttaaattgacagataaaattgtatgtatttatcatgtacaacatgatgttttgaaatacatatacattgtagaatggttacatctagccaattaacataggcattacctcacatagttatcatttctgtggtgagaacatttaacactttactctggtctctccagacatctaagagaaaatgcttcctttttatgaacaaccactgtcttagcattttgaagtttctaaattattagtaaagctttcgttgaattcttggccttatttaacaagtgacttaattatatttcattttgaataaaattgttatttttttaagcctggagataacagtatataatgaagcatctgctgtgtatgatgtacaagtgtttgaattcccacagctcacatttcaaaaaatcagattttcctgttatgtgtgacaaactttccaagatcttcaaattatgaacatgttttccactagatgacatctgtggaacagatttttttctctgctgacatatatctaacactttctttctttttaatagtgatgctttatatgaatatgaaattataaaaatttagcaaatgatagttattgtttgagatactcacatttagaaattgcttttattgctccctcattcatcagtcattttgtatctcacataactttatattgacagtttcttctgttcagagttagtcttgtaacagatattttaattatgtagaaaataacctgcttcaaaattttcacaaattgaaggttgtgtaaagggttgaagagatgatgtttcctcatcataaccttgtgccataccttgtaagcaagtactgtaacttgtatttaatgatgaaccaagagttttcaagaaagaactaaaatccatcatatcttttctactgatattttccataacatccaagggaaagaaagcatgggccaagtacttgggtctatgagagaggtttttcagctgtttacaaatgacactgctgtcaatgtagcatgtcatagcagctgtggaaaaagggaggttaggtgaagtgataataacaaaaggcttctgattctatttttattgccaccaaatttttcatttaattttatgaaatgaaccttgtcttcacaatgcctattggttttagtgactcatttcattagttgaggtgctttatccaggtaacctcaatttgcacgtgttgatggagtttatataaccaaaaatatatttggaaatggttttggaaatggtgcatttctctgttttagttggtggtgatttgaacaataaaggctcatgatttaatataatttttgtttatttattataacatctatttatttgtcacacacatactttttatttgaaaaagaataacagtactgttaaagaatatggatagtcattagaaaattaatattagaaaatgagaaccctttaaagcacaaggcaacatgttatagtggaaagagcacatgtgcttctttatttgctgagtgtataacttcagacaagttatttaaactctctgagcttcattttctcctttgtaaaatatttcctctacagcattgcttcaaaattaacgtttaagcagagtaggtgcttataagttagttttctcatcatgttttaagatgcagtcaaacatcttcaaatgtgcttattttgccaaataaaaactatcatttatcaagcacttactatgtgtaaagttatgtattacctttgtgcaaatccctgttttagccattatcttatttcatcttcataataatttatttttagtctgcaagaactgtggtcttctgaataatgtaaatatgcagttattagtgcagcttttaaagaactgcctttgaaatcactgtggtcgtcaccaaaatttctttccatagcataattaatgagtaagcagttaccggtgtgtccagaattatattgtaaatgccttgtacatattttattccatgtgaatagcaagatatatgtattcttaatttatttattataggcaaatcaggatgtgaattgatgaaattatctaaacaaataataattgctttatatgtaggaattagtttagtttgtcttatattgttgaaatgttactataattgcaaataattattgatttcttcataaatactgtaattacagtgtgcaaatattgatactctttaagggtttctaaatagtatactgaagtgcttcgcttcagtattctgtttttcattttttctagcaatagcacaattctctatattttatatcccattaatttttttatataatctttctgtcataacaaacatgttctcttttgctttttgaaaaacttacaagatgtgtatctaatactgcttatttttaagatgctaacacctttagctcatttatttgagtgttggaaataaagtaaatatagtattatgtatatttttctgaaattattgaaaccttgccaagcaaaaagcagtaaatagttatatttcatactctaagaaactcatcactgtaataataaaataatattttttcaaagtgaaattaaagagtaatgtttgaaaaatttaataagacagactgatggaaaataggaaacatagacaagtaacattagaaaaggaaaaatgtatttcttaaaaggtatgagagaacattacacacaatcatatattgacacattgagatatataagtgaagtggataatttcctaagaaaacacaaattttcaaaattaatttaaaaagtgaatagcctgatgagggctttaattagagaattcttgttattgtagaattttagatctaggaaagcctttcacaactgtataataaaactcccataatttgtaagtgaaaatattgaggtccaaagtttttgtggcctgctgaaaacatcctattaattagctttggaaattaggaggtcatgggtgatccctgtgggataaaagcttaggggagatgctagacggcaagaagaaaagaggagagcaggtaatatagaagttgaagtgtggcttaatctttcaagaagtttgaccacaattggagaaaagagagagaataaaccaatgagaaccagtgaaaacaaaccagaatactggacggttggttggttggttggttgaacatagaaacttaaacagattcgtaggctaagagagtgaatacataagataactaaaggaagagaatgtagagatactaaatatggaatcaagcgtagttactattttttgatattagatgtgagaatagtggttatctttgggaagctttgggactggcaggatggagatgttctaaatttttatcttgattacagttacataggtgtatgtatttatacaaatgaatcaagttttattataatatttattgtggattaaaaagcatatttatttgtaaaaatttatcactctctctgcatgggtgagtgggcttttgaaaggtagccttcacagtacgtacatcaaagatgaaccagtatatgagagttttttccctttgggggagaatattaatctctgacattctgaaagtagaggtgaaggagaaaggagaggaggagggtcttatggtttaatacatacacttgttcctgcttgtacacctatccactagtgagattggtatctgacttcagaaaccaacccatttgatttctccagaaactaatcttccctgtgacaatgctgagctgtgttggctagagaaggaaacacaaagtttcagctattctgtacgtcgatttttcaaccaaccattctttttcagccccatataaaactgcgtaagccttctgtttctggtccccacattcagaaagtccacagagtgaataagctttattacaaacaacatttctattacccacgccctgccctgccaccctataagcaggtaggctataactttctctaccactctttgtcagttaaaccttctttcctcagaatcttctgaatttgtcaacaccttgagttcatggtgtctactgcctattattttttctttgtgacttaataatttggtcattttagtgtggtttgggaggtagaagacaaatcggtaatgtttaattaaaaattttggactacattttccaaatgacattgttgctaatatagaaaacttagattagtttattgatctcagtgtataggaaataaaattttatatgttgatcttgcatccaactagcccgttgattctttttactatttctaatagtttaaaaattgattatttttggattttctaataaggagatatattatctgcaatgacaacaatgtgtatctttatttttgtcttttcttgtattgttttcgtgagaaactcttgtacaacttagaataatagaagtgatggtagacatcttcctttttttcatgactgatggacattaatctagtattttactattacagatgattttcagtacaagatttcaaaagatgatctttattaaccaagaatgttcacttcaatatataatttccaaataacattttttaaaattattatttgggttctgaattatatcaaatgctttcacgtttattaatgtgaccatatgatttctcttctttaatctgttgatgtaataaattatggggaggtcatttttgatgttgagtcaccctgcattactggacccactctgatttgatactgatttattatccttttactgtatttctagacataatcttttattttgtaatttcacatttatgtttgtaagtggaagtggcttacagctttcttgctcatttcgatatcaatgtcatgctagcctctttaaaaaatgagttggatacttctaatctttctctttgacccggaaatggtaatgtgaatttggatgttgcttacatttgttagaatttgcctgttggtgtatggaaaatgatactgaaatgatactgaaaatgatactgaatttctactttttttgaaggactacttcttccattatgactccattttatctgttattagttttatctctcataatttatgttttactagaaaaacgtccattttatgtagcttgtcaagggtgtgtgtatatatatataatatgtataactgtatatatatatatatgtatgtataactattttcattcctaaacttatttattttgctttttctctcacctttaaatatcatcacaatggccaaggtttcgctgctttattggtctttcagagtcagctttgtctttatagatgaattttactgttcttcaaattttctggtttgttaatttccgattttatctttttaaaatctattcctcttgatttctttaagtagcccactaattttcatctttctcttgttttctatctatttaagtctaaaaatattctattatcatagcaaaatttcacaagttttcatatatatgctgccataattgttattcagttctaaatagtttataatttagagttttagtttctctttaattgattatttaaaagctttttcctccaaaaggtgcagaattttaattttgatttctaattttattaaattgtggtctgtgaaaatgtcctgtgtattataaacttcttgaatttattttatttcactttctatcctaagaggttccatttgtatattaaaaatctagacatgctctgtttttttatgtacaatattacaaagaaagaatgttaaccacttttatttattgcattataatcatcaatattattatttcctccatttttggttactttctgagagctgtatgttaggttcatcattataattttagtttgacagttcatccttgcagttttctcagtttttgcttcatatactttgaaaaattattattgtttttataaagatgtgttccttctgtatcttctttgtgccttgctccttttattagtatgaaaagtccctcttcatcttttttatttttctcccaatactaacattgtgacatctggtttttacatgttagtatttgcataagctagctcttttcatctctgttctctattttcctgtgtcagtctttgggtttgaagtatgtcacataattacattactggaattagacttttttcatccaatatgaaagtttctagcttttaacaagtaaatacaaagtattaccatttattgtgatttttgatgtttggaattagtttatttccttactttattttctatttctcatgttttctagtttgttgtcctcttgcttacctttaattgaacagatagatttttcttagttcaattttttctgctattttacaaatgtattgttattattttttgtggttactgaaccattaacataaatgttcaagcgtatttttctataatctagaattaatcagtatctcatccctgagaacatcttaaaaaagaggtttagaatacttttatgttcctctactcccttgcaactctaatctctcccatctttgaacccttcctgatattattttcaattttatatcttcatggctatatttttaaaattatataaatttatgtaaaataaacatttatttagacttattattttcttttttaaactatttatgtatttatttatttttaactattattttaagttccgggggtacatgtgcagctttgttagacatggagacttaccactttctttgctatccatcagttcttttatcttattccctcctcttggacttcttattgttagtggtttatattgtctagcaattctttcaaagaggatcttgaggtaattaacttcaaaatttcttccaatttaaaaaatatctttctttatgcctctctcttgaacagtggcttggctgggtgtagaattctatcttcaaagttactttctcttagaatgttgagaatctctttctactgccttcttgtaccctgggttgcttgcaaagaacctgatgtcaatctgattctgatttcttcgtcaatatctttctttttactctgatagcttttaagatttttctctttattctctgttttcaaagatttcatcaaagtatatgtgcttgtgcatgtgtgtatgtgtgtgtgtgtgtgtgtgtgtgtgtgtatctttagtctctcctacgccgggagaatttttacagtgttttgagaaaattttctgtaatatatctttaaatgctacctttcccccaaatttcctgatttctgccttctggaaatacttttaaatagacttcagaacttctgtgtcatccatgcattatgacctttctacttcccatgtcttcattcctgctcccaatacctaattttgggctatggtacatattgtcaatttgttctttatatacttttgttttcaaggaatttctcacagtctctagtccatcacagttaacacttcttattttttcctgttattttaagcaatctcttctattgtgtctaggaatttggtgtgaaggatgtacatgagagtgttaggtaaaaacagtgctcagtttgacaacttaaatccattttcaagttttgaaatgtttgccaataacattcatcagctgtgacactgatgagaccagttaggggtttggcaaggcaggaaaatcagaagaattgaatgatgaacttgaaatgctagtgagtctcacatttggaaaggtgaactgtgaggcttagccatagtggaagtcgacacatggagacatttgaataaagaaaaactgtaggaccaaagttcaaaatagtgagtccagtgatagtgataattgaacagttgccaagatatgaacctcgtcatggaaaaggagattcaggatttgaggcttgtaagtgaaaaaaccctagtactgaggggatctaagggatgattgatcactgggggcttactgatgtggatttgggttatgtaagaaaagagatcaaacaatcctgagacctgaacactagaaaggccagttttatggaagctgatgtgtcatttgtggaaaataataaagttcatttgaaaattgctattcataaaagttatattgtaaagacttttgcaacttagccaatatgacatataagtagaaaaatcagtgtgtgtttccttgtatggagtgtttgattttcttttaacttttaagttcaggggtacatgtggatgtttgttacgtaggtaaatgggtgttatggagtctggttgtacagattatttatcacttaggtattaagcctagtaccaattagttatttttcctgatctcctttctccctccctccacccttcgataggccccagtgtctgttgttctcctctgtgtgtccatgtgttctcatcatttagctcccacttataagtgaaaacatgcaatatttggttttctgttccttagtttgctaagaataatggcctccacctccatccatgttcctgcaaaggatatgatctcattcttttttatggctgcatagtattccatgttgcatatgtaccatattttctttattcagtctatcattgttgggcatttgggttgattccgtttcttttctattatgaatactgctgccatgaacatacacctgaatgtgtctttataatagaaaaatttatattctgttcggtatatacccagtaatgggattgctgggtcaagtgatatttctgtctttaggtctctgaggaatcgccacactgtcttcaacaatggctgaaccatttacaattccaccaacagtatataaaccttcctttttctgcacaacctcagcagcatttgtcactttttggctttttactaatagccattctgactgatatgagatggtatctcactcactattgttttgatctgcatttctcttaatggtcagtgatgttgagcatttttcatacacttgttggccgagtgtttgattttatactaattcttcacatgctgaagcaaagtgtagctcctttttttctatttttcaagatcatagtttttgcgatgctctttatatatggttagttttgcgacttaaacctctttagtccacatgtacacattccttaagttgagatagcttacctccatacttggagcaatttaaggataaatagtttatccagctattgtagaatactattgtctgaagacataggccttatttctttagctacaacacatttccccatagtctgtgaccatattattgtacgaagaggcatgattattgaaataaatgtcagtggctcaaaattacatgtgcttcaatttgtattagaattaaagtgaataccagggagatgtgaagtaatgaacacaatatacagaaagtaaatgttaaaatctctgtactcagacattgaacatgtcattatttcttataaaatttcagtacaccaacacttagggtctaacatttcaacatatttacagtttggtataactctttattgacagtttaaaaatagagatggactagctttgctagtgcatacaatttagttgaaacaaacgtggaggaaaatgaaagggtaactaatgacttagaaaggttatctagtctttggatagcaagtggaagagttgtctttggaattcaaatggattggtgactatagatcaaaaataagcaaactagtcagcctgcagatatttaaaccgtaaattggaaaaaataaaagtcttaatgtgtcaagaataggaggaattacaattggttaaagctactgcattatacctgagactagagtataggtatgaggaagttttcaagtattccatgattttatcatttttataagcagaaacaagtactaaataggtttaagtactacatgaaacaaagattcacatgctgaaaaattgttttgttttactactgcttataataatgatgataatagttatatttggttgggcacttgctgtatacctagcacagtgctactcagcttcttaacattatctgtcatcatttacacaacctggtggataaacatgctgaagttcattttataggattagaagaactggcgaactaagtcaacatctggtgaaatttaataaaattaacaaatcctatgaataatttgggccaaaaaattctagtaagatattctgcattagcagtggatggtggtagagatgagaagatatgggttatagttttatttctttgtattggttttttttacaatttttaaaattctactgtctttgttttgccattttccgtttttaaaaatggtaagactgagaatgactgacaaaagaacaaattagtcctgttgttggttctggtttataaagacttgcatttcaacaagatttataaagcaattataccaacagtgaaaaaagtagcaacctttaccaaaatgaagctgctgatcttttgctgatgagtcacaactaatgataagcacattcaaggtgattaagttacgtgaagaaaaatatctataaaatcttagccctgtactgctggtgacatgattagcttttcaaaattacttgatgaggacacacattgcaaagtaatagtatagaagcattgtattaagtactttaaaatacatattttatttttgtactatgttattagccaaacctcattttgtactttgctgttacaccttgaatatcatgcatgtataagagcaaactaatctttttcttttgaaaggctgttactcttacagatataattttaacatcaacacagataaaacaacaaagaacgattatctgttaaaagggaagaataaagaatgtagccaaactaattatgcaagatgtctgtaacaaattaaatcaaagaaaagagaattttcataattatgttttaaaaattcaagtaaaacaataattttaatctcccttgagttcaaatttacattcagggttcttctcataaaaaattaagtgcaaaaatgaaattagactttttttttccattgtaaatactgtatagagcataaagactatagggtttataatttctgtaaataattactcttgtcactgaggagaagtagatatttgaaataaaagcaatgaatcagagattaacaatcccctgaagaacatatcattttccctctcccaggttcagtgtgagtctttttgtttgtttgtttccacagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtaagcatattgatataccgtttcatgctcttctcaaaatgacgttgaacacacattagaaagcagtcatgagtgattagacacaggctactttgtgtctaatttaatctatggaagtgaaaatacatgagctggtcagttttgaacattcattggtcatttggaactttaaaaggaagtaagtattgaatgctcatttagctagtcagttaacattcaacagtgtctagatagtatgaaatgagaccccgagatgcctacacacagaaaaacagtgctctctgttaatattttctgaaagtgcaaaataccttaaaattttcaaggcctaatgtgtgatggttcactaggcatgtactcccaccaagaaaacttagaagatttcatttcaagaaatctcaaagcaattaaagaataaaagcgattcatttcatagggagaacaccatctagagaattaatgaaacctcacagcttgttgacctggtcctcaaaagcagaaacagaattgctgacagactgagaactaattctttacttgtgtttattaagaagtttctctcaaattgcctcatgacatggacatctcaaagatctatattatagggccaattctaatgatagcctagttaatttaagaagctacttttagaaaaagcccaaatatacaataatatctactgtattagaagactggcatatgggatgctaggaggaacctgggaaattacaaataagtgtgcttataacaattccagaattatttaggctggaaaaatatgatcaagaacacgtaaatattattcattaggtttcagcaaggtctattatgtctagctaataaattaggactttatccacagacaaatggaaaagcaattaataagaagttgaagagtaggccagacatggtggctcacgcctgtaatcctagcactttgggaaaccaaggcgggtggactacctgagcgtgggtggactacctgagcgcgggtggactacctgagcacgggagttcgagattagcctgagcaatatggcaaaaccccatctctaccaaaaatgcaaaaaattagccgggagtgatggcacatacctgtagtcccagctactcgggaggctaaggtgggaggattgcatgagcctgggaagtggaggttgcagtgagccaagatcacaccacgacactccaacttgtgtcacagagtaagaccctatctcacaccaacacaaaagttgaagactttgttctacttagaatttcatcaaatttttgtctaaatttcctgacaaaggccttctaaagttgagatagtatttaaatcaagggacacttttgccatgaattagtaccattctaagaaatacagaatacaggtaaaagaacacattttttgatgaagaacaaaacatggtgattttcaagattagtgactaccttgtttaaaattattactaaagattttgaggagagggttcacagacagtctccgtatttacagctaatattaaactactctaggtagcaaaaacctgaactgatggtgctaaagtatcagaaagtttatgggttggcagaatagtggtgtgtgtgtttcattatgaacaagtacaataaaatgaatctagaaaaaatttaatctaaattgtatgaaataaatactattaattcttcagttataacccatgaggaatttttttttcctaatgaacttggtccagtcaatcaaaaaaaatcaacaaatgacatgtgtggaggaagaggagaaggagggacaagaagaggagaaacagaaggaggaaagggaagaggaggaaagggaggataaggatgaggaggggactatatatttataattttatatacatatatgtatagtcaccagtgtttgtttaacactatggtgtgtccttctgagatgttttccatagttcttgtcattaaatctcatgaaggaatgtgatgccactagagaaggctcacagaagagaatagcaggaggtatgtgaaatgatagtaagaaagaagacagacagaggacatacaataaaatgattagatgacggatttttcaaccggaaaaggcaaacatgatcttcctgaaaagaaggcataaccaaaactaaaaaaaaaatctttaaacagcatagactagagactctaccaaaatacaggggggttctattgaacttgaatgaggtaagtgtaattcccataaacgtaaactaaaagaagatgctagctcagaattggagcaggtatgtaggtaattgaactccctgtttctacattcttgttattataagcaaattataaagaaagtgttaactcataagatgtatgtttttttctgtcttattataagtacagcttgatgtggatcaatatgtggccaatggaatgttccacttctccgatattacatcataccagaacatccagtttttgcctttctgattttataactataaatttcctttataacagtgtaaacccctagggaaaaaaataacttaaaagatgtactaaatctctgttattacttccatttaaacccgtgtcaaatgtggtggtaacctagcaacaccagagaagtgcagtaagttaaaagctcaggtacctctctcatatttttcaacttgaaagaaatcctgtaatagaaacataccttgtgaagtgactcatccaaagatagtttatctaatttgagcacctggagtttgttctggcttttcttagaccagtatgcatagtggttatagctaaatatgaatgcgtgacattgcttttcttgcaggtttaccagcattagtagtggccacatcagtaggcttcaccagaacaaaaggatatggcactgatcactagtaagtccatccacagagataaatcatgtttataatttaacaaatcatcaaagagtcttggttggcactgctgatggcttgcagtttatcatggaatcattaacaatggtagaaattgcattagtaaggaacaaaacaaggtagcttaaatctacaaaggttaagaaataaatgttgtggcactattcagaatctttgttttagtttcccatttcttaataagaccagcatatttggcttttaaaatatttcaatatttattttgcatgcccaatctcaaataaattgagaactggataagtcttgacatacttactttttagaacgtggtgctgctatgagcttctaattccattgatgataatgtgtattgttattaaccaagttttgtcatgttagttcaagttttcttgctatgttagggtaatgcatactaaaaattatagatcaagggaaccaatggattttacattagaaaatacttggaccgtggaagaaattaaaagggagaaaaggtatatgatatcagcttattttatagtggtagagctgataaattctgtgagagaatttgtgtttgaatttaacattttaaatctaaacagtgcactttcatgttttattttatctgcatccaagttgaggaggcagttaagaagtggggaaagaaatgtgcatcttattaaaagcatatgttttaaagcatgatgttctgtttaattattttgggtttgaggtaggaatcactgccaattagaccctctgataggttcgtacaaattgtaaacatactgagagatattatttcacctgtttatcctaaagaaacttctgaaaagtttaagacgctcctgtcatcagagcatttttgtgccatctatagtatttttaaaaattctgatagcatagatggcacagtactggttactacagcactagcaccttaatttattactttttacaatagcataattattggtatacatctatttttggaaagtcactgtattgagaatatgggaataagtaaggttatatatgtgatggttcctactttcaaagagttcataattaaagtccaatacaatacaataagtaatgcatttattttatagccataagtttttataacagtgtaaacccctagggaaaaaataaaagatatactgaatctctattagtatatcttgaaagatatactgaatctctattagtatatcttgaaagatatactaaacctcagtttgaagattagtttacataaaattacagtgggaatttagtggcagagattagtttacacaaaaatacagtgggaatttagtggcagtcttagagacacaatctaaagtgttctgtcagactaaggtttttttctccaggtattttatttaaaaatagatattaaagtggaaaagtacggttttatctttctgctgttatgtcaaggagcaataactaaatgcaggctttgaatatacatacacatatttgggtatatctatgctgatatagtatctctttgtgtacatatataattaccttacatactaggtaaatatgtttaagatataatttacatagagtagcattcaccctattaagtgtatagttctgtgagttttgcgaaatacataactcgtgtaaccaccatcacaattaacatagagcagtttattgttagaacagatatagagcagctactgttcattgttactgcttttgaaggcagcatgctgatgctgtaagctgagaagaaatagttaaagggtcaaatgtcaaaaaactggtgcatgaaatggtggccatgactttttgcaccagcagcccctcacacttccctcattttcactttcctggattctgcatgagcagatgtgccaccctgcaaagcatccagtgtcagccccattccctctgcatttccctctgctgtgagagactgtttctccccaaatggattatcttgtctctatcaatgcaaacctacatctcttggtgaatttaggcattgaaacaaacacagctgcacttatttttattcaaaagcttatctttagagaattttcttagtagtttggtgaaaaagtaaaattagaagaaaaatagcatgcaaatgtagcttatccattccctgcaatgatggcttttaaaccaatttctcccaatatttcaatgacctcgaggaagagcaggtaaatggcacgtctaaaactctaaaaaaaaatacactggtcttgctttaaagtacatttgaaaaaatccataatggatataaagcagcattttataaaatgtaaataatactcaactttgtaatgacagtaaatatagaaacctcattgcaatagtaatttgtctaaaatgtttcaactgcctgaaagtaaaaccttgtaataaaactttcttttgagttagatatatatagtatttcttacttatgaaatgatataattctagtttttttctacatcttctatgtattttttattacaaatgtttaacatgtgccaaaattccaaggcaaaatgtataatctaagttgtttgtatcacacgttagtggtctaatacttgtcactaatttttgttagttcttatctaatgtcattttcagctgctggctctctcttgaaggaggactactctatgcttttgtgggacctgcagccgctgttgtcctggtaaacatcaaaatcaacctattttgttttcttaggaaaaaaaaaaaagactactttctttcaattagagtggcaattttgataatgtagttcttgtgtagaaattttaaagttcaatggactattattctaattgaatataaattattattcagccctttattattctaaaatattcttattttgaatactgaagaatattaaactgggagtgtggtatttctcttacagtaatttcagatttgtgaaaaagtttgagtaagttttaatgaattcttcctctttaatgtatagaatctcatcatttaccataatttcacctttacactattctgtacaatacatatggttattacgtatggttattaatagggaaatctctttaatgctgcccctatcaaatatctaaaggaaatatattctcgacctcagtgatactgatattttggatcatatgtttgtttgttgcagaggccgtcttatgtgttttaccaggttccgcagcatccttcttctctacctactacataccagtagtaccccctagtcataacactcaaaaacatcttcagacattttccaatggtcccggggggtcaaaatcatctctgtttaagaatcattcccatatgttatagataaggattttaaatttctcttttgaaaccacaaaataattgtttaaaattttaaactacggtaatgtgaaatatttccttccaatttgcctttctctttctccttttggatttattgattacaagtttttcttgcccaataaatctttaaagaaaataagggaggaaagaaactgtctaaattaaatataaatattcatattgctatacaattatatttctaattggaaagttactctttggtttcttgaatgactcattcaaaaaattggaaggtagtgacatcctactaattctgatatgtctgtttttttctccctttaagcttgttctccctcaactaagctgtaacagggagcagaaactgtctataatttgcaagaaaaataaaatcaaggcaagaatcttagtgcaaagggaaatcaaaactattagacaccttttttgtctgctgctttgaatttttatttaatcaactgaactatttccctaagcttctaggttaatgccaatataacactaaaatgaagaaacacagtgtgtatataattgaaacaccaaagtatggtctttggaggggtgacaaattcccttatgattaagttgtagattactagaatccatagaatacactttttctcttagtttaaatgagaggtacatagatgaataagtattctcttgattaagtggtatcttgtcaggaaactatgaagagtgactcttcctaagtccatacttaataggtatgttttgcatcttccttacgttagcaactggacacattttagctttatattcaccatcttcattggcagcagggcagggttacaccaagattggaaagaggccagaaaggcaaaaagaagaacatatttttcatttactcattggactggattccttgatcagaaagtgttggtagattagagaactgtcggggctcatcataagctggtacaaatagacatctatgcagtttttacagttttacttgaaaaaggaaaaatatgtgtgatttcatttcatgtatcatgcaaaagaccttttaagtgagaataagaaagtcttagaaagaaaatgatagaactgtacactagagcatattttaaaaattggcactagtgtccattgtgaaaaagattctggtgaattgaataggctttcctttctgcttagaaaagcatggtacatcaaaatgctccccttccacagaaaagaataaccacacagcatgaggaatttaagcattctgtcctctgtgttgggaataatgacaaatcatcagcaccttttgctgccagggctcaccctaacctcatactctaagattcagaatctcctggctcatgggcatagggtaaaactgctttagccaaatgattttactcagggttgactcagacagaagaatgccagattggcatagtatggtaccatttaaaattcaggcaattgaaggttaatttccccagtgttaactgcaaagcatggaaattaaatgaacttaatgtactttacaactttaaagtagcacaccactgttaaattgttccgtatgcctctgctcacttataaaatgtttgagagtgcttcataccactactagtgatacggtggttatgaattgataaaaataggattttcaggagaaacagggacctgattcccttcaatatcattgaaaggtcaactttgtttctgtttgacaggtcaacatggtgattggcattttggtatttaataaacttgtttccagagatggaatcctagataaaaagctcaaacacagagccgggtaagctgcaattggtggattttgaaggttatttatcagtgaatcccatactccaatttcagaccatcactgactgcgtttgactctgccttgaattttgttattgatgtactagtgtgtccagtagattctgctatataaaagtttccaatgtgctatttttaagcaatacgaccaaaaatctaaaactactataacagaccatgaagaaattcggagtgtacttgtgcatattgcctgcttgtcagataagaacgttaaacattaaggctttacttgcaatagttgtcgttaggtaagggttttcaaagccttcctggttttggtcacaaagaacaggaggtagattgaacacagtgttggtatgtgacagaacagaatcagaacaagcaaacctaaacagggcaaaatactatattttctttgactaattgtatatatcaggaaaaaaatcttcacttggaataattacttatcaagcactatttaggtcttatattttcattctttatgacatttttaatctaactggctaaaaagagttattcataattttcacactttaacctcataaaatttagaaaagcatctcctttaattttactgttattataatatataaatatctgatgacatattatatattataatatatatctggccgggcacggtggctgacacctgtaatcccagcactttgggaggctgaggtgggcagatcacgagatcgagaccacagtgaaaccccgtctctactaaaaatgcaaaaaaattagccgggcgaggtggtgggcgcctgtagtcccagctactcgggaggctgaggcaggagaatggcgtgaacctgggaggcggagcttgcagagagccaagatcgcgccactgcactccagcctgggcgacagagcgagactctgtctcaaaaaacaaaataaaataaaataaaataaaataaaataaaataaaataaaataaaataaaataaaataaaataaaataaaataaaataaaaaatatgtatatataatgacagtaacgtctcatatatagattgttagtagctttttaaggtgacatcatcctttatcatataaatttgttgacacttgaagtattaatgcctttgttttttctttgtgtccttccctatagaaagtttacagctttctcctttccattgaactgtaacctcattcaaaacttacccatgtaatattcttttcttccataatttgtggtattatttaatagtcctactaattgatcagttacttatgaaattttaagtcctttgtgttcttataacctatgtaatgatttatacaataagataatctgggtatttattttccctagcaaaagactaaatttaatggttttcaatataaaaatttgatatcatttatgtaaaacattagaaatgcaatagcgtaataaaaacatgactgaaagtttcttcctgagcggggatcacttctctcatttagaggcttttttcactgcagacaagtttctgtaacaaccttaaatatgtagacttgaacgtagtacaagcacagctttctagatcatttgaacacaaaattttcacacaattactcttgttattacgccacatgtggtggaaattgaagtaagcttcttcagttatttctgtccagattaatcatgtaagaatatactgatcagactgagtactgggatagaaactcagttctgctgctagtagtataaacttacataatttaaacaacatcgacaataaaatgggactctttagtggttaagatgaagctctgcaatttactagctgtgtctatgtgcctttgggtgtgttactttttgcaactcagtctcctcatctgttaaatggggaaaataacccctgcctcatagagtatatgaaaatataatgtgtataaagcacactttagagtatctaacatatagcaagcattcactcaacagtggctgctcttctgagaagccagcctgaacagattaggttgtttttgaaggtctctaactgtcaatcaagaatccatgattccaccatccaagacatgaaggtcataaaaagagatgagatcattgaaatgaatatgatattgaggatttaattaaaaaaaaatttaataaaaaatttaaaaaacaagtgaatacccttattttttcttatttaattattttatgtgtaaagcccagtttaattcatatagctctttataagagatcgtataggtttagaagaaatgacaatagtgtcttattatgaatttagaaattatccattccaatctacatattaacaaataagttattctaaacatattcttagaagttacttatgtttcactggcaaaactgagtgggtgtttttctggttcaaaggccactcctagagaaacagaaatgttaacttatgttataaaagcagaatgttggctactgtccaaagcagaaaagaactattaacaaattaattactttgggttttcaaattatatttctaatataaagtactgttttagcttaagcaaatatagattgaaatttgtactccattccaaagtgtgattgaaggaaatttttggaagctatagaggtttgaataattttagttcacagaaaagtagtgaggacagtgaagaacagtccccagtgaagaagaaataatcaaaattaactaaagaaacattaagcaggaaactaattggtcgacttgacaaccaatcctcctaattgtaaaaatcatttcagcttatttgaatatacacatatatcaagcatttgttttacaactaggttgttattaaaaaccaaatattgtaccaagatgttccttctcccattttttctgtttctttgttccctttcttcttttttataatcagttattagaaacagccaaccatatagtttgtgctcaataaatatttataaggaattaataagtgaatgtttaataaataatacaatagtttaacaagttttataatacacaaactatattaatattttttctactgaaattcttttttcttttttctttttaacttttaagttcaggagtagaagtacaggctttttacacagataaacttgtgtctcagggatttgttgtacagattattttatactcaggtattaagcctagtacccattagtttaccaagaaggaatttattgtaaatacaacacatcttaaataaaatgatagagtgaataaaatcaggattaaaaatggcatgtatatttttagaacatcttaagcagaaaatttaagtttctctatttttctgcagtggaattttcttatctactgccttaaacgtctttgtcttatgtacctgaaactaaggaaactatgacttactagtaccctttacaaatttcatgtgattttttttttttaaagagaggctggcgcatttcctttccagggaatattttatgttattaacaataaatcagtcagactttttttctttaaagaaaaaggaaaaataacatggagaagggaaactagaacttgtagattttaagacccacagtaataactggagcagacagaactacctgaagagtaatgtgtgtaaagtttttctatttaatgtgactttgcttctataatgtgatcctaccctggtgccctggtgggtatattggttaaatttagatgtatggacaactcaaggttttttttactgtttgaacttttaattttataaatgaataatttcttctataataaagaaacaagatctcatttttcaatgcagcaactcaatttagcatctagactatgagtttttcatattatattaatttctatagtggtcacataaactaggaaaaaacattacatgtctctaggtaacttatctttattctacttcatgcacatccagtaatagaatgccaaaggtgtcctaccagttaacatcaagcatagtttttaacagttagccctgactaagggaagtaggcataggtcttctagttagactcaaataaatatcaaataaagacaaataagcattttaagtaatggcttaaaatttattttcagacaggcccatacttagattaaatcacagttttcaggtctaaaatacttacactatgtacttaaaattattttttagtaatatttggctttcgatcttgtttcagagcctagaggcaacatattcttagattaagaaagacaactgcatcagtgtttgaagtgtgaacaccatacagcctatcttctgtgataaaggaaacaatatataactaatccatgcctttttcatattaatctgatcagatttaacaagattaaagaaatgcaaatgtttagttagagaagtggtacttgttcctgtttgttcatcagcataatctatggagctttaaaaaaagcagatgcctaagtcctattaaattagagtctttgtggttggggccagatagacagctgatgtgcagccactgtggagaatactaggctatgtactcctttgggatgtacacatcggcgtgtccaataaggcattcctaaactaaactggatagactaatgtttacatattattttgaaacatttggacacatttggcaactacatgtgccctggagtggatcagtaaagcgagggatttagtgtcatattccccacccccacactcatgtctgaaagctttgatttttctcacaggatctgctgatcaatctacttaattaatcactttcagatttattatctcatatcagcactattcacaagtgagtacccttatttaaaataaaccagagttctaaattatgagcatcttacaactttctctcttctgccactttttttatacacatagtaatgcaactccgctataagattctttaagaaaacctacagagtaatcattttagacatagataccacataggaatggactatgcacacctcagagcattattccaagttgtttggaatttttaattcaagtaatttctttttggtttttcctaaaaggtttattttctaataaatctgtaattttcaaggtacagttttctaaagcaaaatgtgtgtaaagtttttccatataatgtaactttgcttctataatgtagtagatggagtatgaattgtttgaatctgaatttatgtgcaaaatcctctagacaagaatagaccatttaaatactaggaggttggagtctatgacaaatgttcagaaataatattttgaacttaatgactatgttaaatgtgttttattaaagcagaaaactatcactcttttattatcaactaatatttcatcaaatttcatcagcccctatattcagatcatcctaaaatgtggacgatacatattataagaaatttcaaaatatgaatctgttgagaaaaaaattacatcttcaacaaataattgaagactcctaaaatccatttcttcctatgttggacttctgagataattatttacatttcagaaggttttcacagatatatatgccttctgcaattaacaatgaacatcctcagggctaggagtcctcacatgtttgattattggggtctgaataaagggttttcactgtatgtctacagaagcacatgcttatgtttaactcagtgtattgagcaactttgatcaatagacacaagggccacttatggtgtaatgatggaaatatgttttgcatgcaacaaaggcccatattaaaaggtaaatgttacaaagataatttgtagtataaatgcatctttacaacaacctagagcatacatttttgataaatatacttttctgcatgaaatcgtatttaaaagctaacttgaagcagcaatttttttttggtgacaattcaatattttgttctttttgtgggtgttctgtttgtttgcagtcagatgagtgagcctcatagcggtttgacgctcaaatgtgccaagtgtggagtagtttcaacaacagctttgtcagccaccaccgccagtaacgccatgttagtcccaatcatttacatcttcttgttacaaatcttttacagtgcatgtgagaaaatgctatgatgaaaaaaaattgtgttttctaatacaagaccagagagtatatttaaatatttataattggcaactgtctttatagctattgtgggatagtatataaaaaaaaaaataagactctcaaatgtcatctgctttgtggtttccaagttaatggtcttggaaccacatacaaaaatgctttgttgaatgggggtttggctatggcctggggtgtgatgtatagctacgtaatgttactttcttggtctcaacagggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggtgagaagcattcttgtgatagagaacagtgatggttggaatggtatttccttgctaaaaagaatgatcttttaatatcttgatgttcagattaaagctggtctcctccattgacaatcacttgggaatcaaagctgaaggaatgctttaagacacagcttgggagagcccccagcactctgaaagtgacagattagaacagatgggactatgccaggaaaaacacaaccagaggtgtcaaaagccaggaagaatagatttaaaagaagctacatggagtgatttgtataaataagtcttgttagaaaaactagtgaataagagggcatagaggcataagttttaaagacacagttcatgagcataatgcagtgatagttcttaagcttattccctaactcatgtttcttcacacagcacaccctcattgcatatattaactaatactattttaagcagaaagcattgaagatgaatgcttagatcttttgtctctatactaagttttggttatgattgctatggattattgcttttgatatggatgtttactcttagaaaaatactaaaaatgtatacagtgagacatgataggcagtgattatctccaagaactgtagaggtattatcatatcagcatttctctggatcatgattgaggtttattgtcagtagtaggggaagaaataagtcatatttcatgaatgcagacactaactagcaccagatccatccaggacagtgagagatttcagacttgagttgtttagaaataaaatgttgttttccaacctgtgtgaaaattattttgaatgcttgcaagcactgagagtatttataaggtttatgagtcattttagcatttactctagggatgactggtgacaaaaacacacatgacatagtgccatgctagtcactttgagaaaacagtctactctgtcattttgcattatctagcttgtttgagaactttattgcaatgtgcacattgcaaaaaaacacatgtacgtatgagtataaaccctatagttttgcagtgatgtgcagagataactagaggcttttacctgatttatcagatgggaagaacaatatttctgagctattttattttattttttattattctttaagttctgagatacatgtgcagaacgtgcaggtttgttacataggtatacatgtgccatggtggtttgctgcacccatcaacctgtcatctacattaggtatttctcctaatgccatccctcctctagccccccacccttgacaggacctggtgtgtgttgttaccctccctgtgtccgtgtgttctcattgttcaactcccactaatgaataaggacatgcagtgtttggttttctgttcctgtgttagtttgctgagaatgatggtttccaacttcatccatgtccctgcaaatgacatgaactcatcctttttcaatagctgcagagcattccatggtgtatatgtgccacattttctttatccagtctatcactgatgggcatttggattggttccaagtttttgctattgtgaacagtgccgcaataaacatatgtgtgcatgtgtctttataggagaatgatgtataatcctttgggtatatacccagtaatgggaatgctgggtcaaatggtatttctagttctagatccttgaggaatcatcacactgtcttccacaatggttgagctaatttacactcccaccaacagtgtaaaagcctttttatttctccacatcctctccagcatctattctttcctgactttttaatgatcgcctttctaactggcatgagatggtatttcattgtggttttgatttgcatttctctaatgaccagtgatgatgatctatttttcatatatttgttggctgcataaatgtcttaataagatacagatgtccataataaacccacatgtattctaagaacattctatgtagaaattcaatgaaaaccaattaacagtaacttcacattgcaaggggaggagagtattttagcatttaaaaagtctgatgtcgtttactgttgccaagccttactattcccttagcaagtttctacctagaatatcagcattaaaaatcttccaagtattgaattatttatagaccaaaggagtagaaattaagaggaaattgaataataatttagcttatgttctccaactataactatcttatgggtcttctatattaatattattgctaataattaagtaacaagattgttctaaatgagtagacacataatatgtttttgattgatgattaaggatgaagtatttcaggctttaagtaagatacatgatgatatacctacatgcagtttttagaagatactaataccttaggtgtttaggagtagaacagtgctgcgtcactatataagcttctctttttcttcagaataagcttgatagatagttttaagctatcatcaaaatatgcaggttttaaagtggcagatattatgatggctaattatcaaatgtttgctgtttacatgaagaaaaatacttggcacaaaaattctacatttccctcagaactttttcgtacttgctaattggactattaactgtcaaaaacaatgatttacaagtaattaaatcaatcatataataaatgcttctgctaaagtaggtgtctctaaatacatgttttctgtactaatggaaaataaaaatatggatacatctctgttgttgcattttcaattattagttcaagttgaataattttatagcaaataaattaacagcagagtgtcataacactctttagctccatcactgaaatggcaaatcacatatttcttttttttaattgaaccttaaaaataccctataacattactgtaaatacacagagcagatttcaggtatagggcaagtctgcttcagaattcctagaggaagatttcatttaaacaccttatttagaaggattttacagatcccaaggaagatatcataggaggcctcatttggaacaccaaaattctttttgaccttctaaaggtatattgcctgacactagcaatgggtatatctcagattacttgtgatcacattgccctgacattaccatggtccaagagaagagaagtatcttcccatatcctctgtgtctccactgaacaataatttcataaagacataccaaagaaaatggaatagatagctatatgtaaaacattaggtagtgattcatatctattaatctacttgataatttataattggatcctagaaatacagttttatctctactgctcttcactttaaaatatttgcttcactaaaattcctgtggacttttctttcttaaaatatataagcaatgtaaaatatatattttttaatttagagactggatatatatatatttctatttctatgtatttttgacagacactaacataatttggtctctaatgactgtcccaatatgaattcagaaggctttacccatatttattatttctgtggaggaggtggatctacacaggggaagaatatagccttgaagtttaagaaggagaaaataagtgaaatactataactgtgatatttttaatgtgttgtgtatggagcctaatttattttattttttttatttttttttatttttttttcctgcctttgtaattctttttttttttattatactttaagttttagggtacatgtgcacattgtgcaggttagttacatatgtatacatgtgccatgctggtgcgctgcacccactaactcgtcatctagcattaggtatatctcccagtgctatcccttccccctccccccaccccaccacagtccccagagtgtgatattccccttcctgtgtccatgtgatctcattgttcaattcccacctatgagtgagaatacgcggtgtttggttttttgttcttgcgatagtttactcttttagtgggtccaattttacactcatttcaaatcagaagaaaagggagaaatgatttactctgtcctgccaaatcaattatattacactaaaaaaatttggaatgtttgcataactatttgttctgaccttcagacctaaaatcttaatatttaaactttataaaatttatattcttgaaaatacagtttcttcttctggaataacttttcttttgaattactttactaaatctctctggagaaaaaaacaaaagacaaaaagaggaaataagaacaaaaaaaaagaagccatctgattcatcacaatacatagttttagcaacagaacctaaatcttagaagctaatatgtttaacagctaataagacagaattgaatacaatgagtatggaggtgtttcttcatttatccatcattggttgattggaatttatttgaattaaacagataacaaaatatactatttactattccccgcattgctatggaaatggaaggacacaagagttatgaaacctttgaaatagttactgttgctaggaaaccactttcttggtgcctgcacattcttctcatctttctgtctctggctgtgcctggctctaagacagtcttacagctctatgtcagagggggaaaatcacaagatcgtgatacaaaacaagctacaataaaactctttcactaaatggaaggataaaaggaaagtgcttaaatggataattttgttatatcagtgtgtgagaatcctgtggctgttctgtagcatcactaacagggccaagctcctcttttctctttcccaagcactggcaggaggtctaggctgcaccagatgaggtcccaaaatctgtatccaaacctgtgaagtcattttgtagtgaaatgcttaaaataaaaaacttttctttcttccctctcccactcgcacccttttttagcctatttcctatttagtcttattatttccacaaggcgtacagataaacaaaatgatttacatgcacatggcagtgaatatgtaaaaaagacaagcatccttacctgtctaatctaaaaccagtaatattccaaagtaaatcattataaaaatgaagccagtagtgatgaaataactagacaacaatatgtaaagggtccatattgcatataatatagttcagatggagagttacatgaacatccaggtttgactacttacagggaaattgagtatgactcattagcatggaagggtatatctgtgccttcctttactgcaggatgggtcagctgttttagttggtctttgaagaggaaggaggagatgataaaagacttcaaaactcatgggttcctaagggaacaatgaggttggaagattagggaagtgaaggtttctggtagaggaagatggagaaaggttactgggcatatggtttccatggagtggggcctgtggtgaatagcagagagtttgattcttctctgggaccatatgaagcacatggaggcataaagcaaattatgtgatcctggaccctagtgattttttttttttttagaaagctatgactgaagcagcaaaagaaaaacaatactgatgacatttgaggacaaagcattgactaagtgatgttttgtgctttctggtcagaatgttcaatgaccatgataagtggccattatgagtggtctcgtaaagaaagataaatagatttcaaagttcataagtagctcagggcagggagggtcagggtactgattctaacattttgagcttgcttagaaggtggttgtactgattctaacattttgaggttgtactgattctagcattttgagcttgctcagaagaaaacttcaggccaatttccctgatgaatatcaatgtaaacatcctcaataaactactggcaaactgaatccaacagcacatcaaaaaacttacccactttgatcaaattggcttcatccctgggatgcaagtctggttcaaaatacacaaatcaataaatgtaatccatcacataaaaaacagaaccaatgacaaaaaccacatgattatctcaatagatgcagaaaaggccttcgataaaattcaaaaccccttcatgctaacaattctcaataaactaggtactgatggaacgtagctcaaaataataagagctatttatgacaaacccacagccaatatcatactgaatgggcaaaagctggaagcattccctttgaaaactggcactagataaagatgccctctctcaccactcctattcaacatagtattgaaacttctggccagggcaattgggcaagagaaagaaataaagggtattcaaacaggaagagaggaagtcaaattgtctctctttgcagatgacatgattgcatatttagaaaaccctgcagtctcagccccaaaccttcttcagctgataagcaacttcagcaaagtctctagatacaaaattaatgtgcaaaaatcacaagcattcctatacaccaataatagacaaacagagagccaaattatgagtgaactcccatttacaattgctacaaagagaataaaatacaacttacaagggttgtaaaggacctcttcaaggagaactacaaaccactgctcaaggaaataagagaggacacaaacaaatggaaaaacattccatgctcatggataggaagaatcaatatcatgaaaactacccgaagtaatttatagattcaatgctatccctatcaagctaccattgactttcttcacagaattagaaaaaactactttaaatttcacatggaaccaaaaaagagcctgtatagccaagacaatcctaagcaaaaagaacaaagctggaggcatcatgctacctgacttcaaactatactacaagcctacagtaaccaaaacagcatggtactggtaccaaaacagatatatagactaatggaacagaactgaggccgacctatggaatgggagaaaatttttgcaatctatccaactgacagagggctaatatccagaatctacaaggaacttaaacaaatttacaagaaataaacaactctatcaaaaagtgaggaaaggatatgaacagacacttttcaaaagaagacatttatgcagccaacaaacatatgaaaaatagctcatcatcactagtcattagagaaatgcaaatcaaaacctcagtgagataccgtctcatgccagttagaatggtgatcattaaaaagtcaggaaacaacagatgctggagaggatgtggagaaataggaaggcttttacactgttggtgggagtgtaaattagctcaaccattgtggaagacagtgtgatgactcctcaaggatgtagaaccagaaataccatttgacccagcaatcccattactggggtacataccgaaaggattatacatcactcagcttgctataaagacacatgtacacctgtgtttattgcagcactgttcacaatagcaaagacttggaactaacccaaatgcccatcaatgatagaatggataaagaaaatgtggcacatacacaccatggaatactacgcagccataaaaaggatggtttcatttcctttgcagggacatggatgaagctggaaaccatcattctcagcgaactaacacagggactgaaaaccaaacactgcacgttctcattcataagtgggagttgaacaatgagaacacatggacacagggaggggagcatcacacaccagggcctgtcgggaggtgggggcctaggggagggatagcattaggagaaatacctaatgtagatgatgggttgatgggtgcagcaaaccaccatggcacatgtatacctatgtaacaaacctgcacgttctgcacagttatcccaaaacttaaattataataataataaataaaagaattaagcaaggtgggagttggttgctaaaagctttatccttgtcagcctgattgaaagttcaaaaagaaacacatttcagatttttttgttgtttcatttgtaataaaataggatgtggggccaggcacagtggctcatgcctgtaatcctagcactttttttgggagccaagatgggaggattgcttgaggcctggacttttagaccagcctgggcaacacagtgagacccacatctctacaaaaaaaaatttaaaaaacatttagccaggtgtggtggtgtgcacctgtattaccagctattcaggaggagaaggtagtagggttgtttgagctcaggaggtcaagactgcagtgagccatgattgagccactgcactctagcctgggtgacagagtgaggcctcatctctaaaaagaaaaaaaaaatagaatgcagtaccttgaaatgggataatgtctgcaggtataaaaataaacctggattttaccaaaacagagaatgaggcgcacaaaactgcttttaaataagagcatgggcatcacacaggcaaggacaatatgctcatattcttatatacctttccaagaattcaccaacctcatttgacccaaaagtcatcccacttcttaggcagggaaatgtaaattctaattctccttccagattaacctttcctgacttagcaaaattgctattatattatgaatatttacatcagtcttgattttcacacatggttctcctagtccatgcagagatttaaggggttaacaagagtatgaaataagatgggtgagatgacatcagtaaaaaagctcagacagagagtttgtaacagaaattgacaaactctgtcatgcctgccgttaacatcaaaccattgcttgctgttacccacagctcttctgcaggatcctcacactgccgtcccagctgttccctactctgggtagcagcatggtgcttctgtctctagtcaagaagagtaggctgggcacagtggctcacgcctgcaatcccagcactttgggaggctgaggcgggtggatcacctgagatcaggagttcaagaccagcctggccaacatggtgaaaccctgtctttactaaaaaatgcaaaaaaaaaaaaaaaaaaaattagccgggcatggtggcaggcgcctgtagtcccagctactcatgaggctgtggcagagaatcacttgaacccaggaggtggaggttgcagtgagctgagattgtgccactgcactccagcctgcatgacagagcaagactctgccaaaaaaaaaaaagaagaagagtaggtggacacagacatgtggatatgtggatggacaaatttcacctttctctccttgccactcctagattgtccttgcaatattgttaaactaataactggaggttcaatatgtcttaaataaaggttcaaactgaaaacttattaactcatgtcttattttttatctaaatcataaaaggttggaaattatggtacagccactcaatttctgaccagttggagataattgttttggtttattccttcacttaaactatcttatgctttgttcagtaagacaatagagtggtacattggaatgaagactagctttcaagtcaagtgacctgattccattcccagctctgctacttgttatttttatgatcttgagcaagttacttaagctctctaagcttcaaggtcctcttctgtgacactgaaataatgtctgccacaaaggggatggcatgaggctgaaatgaaatatcacctgagaaggcatgggatcctggtgtatgacacataatgtccctttccttcctttctattctcatgctgaagaaatgctgctacatatttttcagatcatggacatgacatataatttagagaagcttatatgacctcctcaaactgatataaaaagtaatttgaaggtaaagaggtataacaattttagagattaagtgatagatcctttagatattaagggattctaatagaaagtcattgggactgaaatttgcatctggaatgcatctttttctttcattgtatagtaaatggcagattttcactttttgtttattgactttgctatcagcaaagtcatttaatatattaataatgtgaagtcactcataattcattcatgtcaattgtcatatcaactatcataatacatatgaaattgaaaagtctttcatttcataattagattgtatagaatttaatgattatgaaaagctgagctgtttgttaaaatatgaaacaatggtagaaatgagattcaaaaaataaaaggccacataagaaactcttctcccccgaaggaaaaattacaaataattacaagaatgtaactttacttattttcctggcttagaatgatcctcttgaataggaaatcaagaagaattactgtaggtaaaactgtcttcttaaaagtgaagattcagggtctgatttgctcagtagctaaatacagagcccgtttcaaactgtggagctctttcctgtgaggtttgtctgaattgcaacactgccaaacatcgctcggtgctcttccctagcagtctctaactctggcaccagcttccacaatgacgcgctaccagctgccttcagagcgaagaccagtccagaagctctcagcctgctgctgttgatataaagtgaatccctctcctggttcagaagacaagagcgagacacacccctgcaaacctctttgaactcatgtctcatccaaaaatccatcagcatttatagctttttcaggagtttttagagcaacccccagcaggagccagtcaaaataactttggaagtgcatggttagattcttttcaggagacaaccttgatagcttattgttttttcttcaccttattgtgtgatgtttctcgccattctttttttttttcattttacaacatgccattagattgccttaaagtctcctaaatatcccaatattagttacatatctgttccttgctactcctgcagatatttgaccctctgcctatcaattcaggtgaaagatctattacagattattataaaaagaaaaaatttgaagtctagattttaactgtgccataatttatcttaaatattaaattgtttcctataggtttagtaaaaaaattgcatttactggtatcaagtaatttttttaatgttaatttcacaagaactcaaagatgcaatgattttaatatctaataaatcttaaatttagttgttacctaaaataagtgattttccaaatggtaagtcaaagaataatattattgccaggcattagaaatatgactgttggcacagaatattttaatattctggttgagaaagcaagatctagaatctgtcttattttattttattttttttattttttgcgttttctgcttgtttgaaacatagacttgctttttacaaaaactcaattattcttcatcagcacaattcacatcaattcaccaaaatcaagtctctcttagtttaccagatacaaaattcaattaattatccaaacacgttcaaatagctgtgaatgcgttttccagataccatcttgcctgaagtattctattctgtgataagaaatgtgcactatgaaatctaatctaatcattctttcctgacagtgttggacaaatatttaagactaatatagactaattcatccagattccctagatactttttttttttttttgagacatagtcttgctcttgtcacccaggctggagtacaatggcacaatctcggctcactgcaaccttcgcctcccgagttcaagcaattctcctccctcagcccccaggtagctgggattacaggcacctgccaccacgccctgctaatttttgtatttttttagtagagatggggttttgccatgttcgccaggctggtctcgaactcctgacctcatgttccgcccgccttgcctcccaaagtgctggaattgcaggcatgagccaccacgccctgcccccagatacgtttttaagattaaaaaaataaataaaatggagcatttagaataaagtagaatttcttatgcaaatctttctaaattagaggtatcagaggcactaaaagtgtcagagaatctagcacttaaattgtgacatatgaccattaaaatgaccttgaatttactggagaatatttattcttttttgatttatatttcttctgaatagcatttaatgattcatgaagctgacatcatcattcagtgtagaaatgcccttaatctattgtcccatttgggagtttggtagtgaaaggtattgattttatatgtgtgtgtgttctgaaaagacgtggatttcttttacatctccttcaagcaactaagagttgattttgaaaagaaacctacaaaaattgtatttccatatttcatagtcagccaaaaatattggtaactatgctttgaaggtctgaaaattgggagtggttagcaaggaccattcaaattaatctttggtattgccaaaatatttctcattttatatatgctgacctagaaatatgtctgatagaaatcttcatgagacaagctcccagaaggcaccattgctaacacagtttatcttcctttgtaaaatgtctttctttaatagttgccttgaggtgcaaacagaaagttaatatgtacctatttttctgacattggtttctaggattttttttctaaaaacagatatactttcttaatggtttccccaaatcaagtgtctgcataatagaaaaagtaatgatctgacaaagactcattaccaattttcgattactaatgtctctctttagaacatacaacaacttcttaatctaaaaaggaggagcttgaaagccttcacatctgaaaaatctaattttatcccagttgtgtctcctttaccaggaaaagctagattatttagttataaatatttattcagttcttcaggaaaagatgatcagactagatttcactacgtctgtacttaactgatgtgtttgaaaaaggaaataagaaattaccttgcttggtatcaggtaatgcattctttttcaaagaaattctaaatttagaaatattagagtaatagaatggaagacaggtcagagaacactgagtctatccccattcctttacttcacagacattatggccacatcagtaggattaggaccggaggtggagaaatagaagtggacagaggtctcattattgggccagttggccagtctttggttgtgattagacttagtgtcagtttccaaatcctgcaatgtggcaatttaggagagaggctactaatgactatgaaatgagtgagaggacaaggaggaagctaaaaacaatgtaataggctcagttttgttttgttttgttttgtttcctggccaacaggtatattatgaatatctcacatcaaaatggtgacaagagatcttatatcactgcttctcaaaagtgaaaatctctatatgttaaccttattagtccctataatgatgcatcagtaaaatagggaaaacatcatctatgatttgttttttaatccaataaaacagagtgtaataaacaagaaagggaaagtcaataatatgaagttagaaaaacaaagtagtgaaatgacattgacattgacttggaataagtagctacttggaaagatgtccatcaacagctcgtggggagcttgatgaacctctggaagtggaaagaacaggctgatgctgagacactgtaagaacagaataactatcaattgctttttgtgtttgttactcagctattcatgttccttgacttgttttttaacaaaagaattaatgtaatgttcttagaactttcgtgagatgtgtttgttctttcttcagaatttgattataaatggatatttggatattaaggaagtttggctttgcaaagtgactttattggcaagtcagtccaccagaagtagtgctgttttgtttcccttttgtttcattatgttttgttttaaatcagggcacatagtacttgaagggagacaagagatagtctactcaaagatttcttacatgagacataaaaagaaacatcccaaatcaatttcagtcaaaagatcattgaataatctcatttttcgtaatatttaaagctgttatgaagataatgccatagcaaatagtaaatctcccttaaaagacacacatattacgtacaacagtggaataaatctgccttctggcaagaattattagtgttgagccagatatagctattttgatagctaaggagttcccagcacttccctctataggttatggcaagcaataaatttccttggcatacagcaaaagtccaggtacaccagcatttgtattaaaaagtaaacaaggcagggcacggtggctcatgcctgtaatcccagcactttgaggggccgaggtgggcagatcacctgaggtcagaagttcgagaccagcctgaccaacatggagaaaccccatctctactaaaaatacaatattagtcgggcgtggtggtgcatgcctgtaatcccagctacttgagaggctgaggcaggaaaatcacttgaacctgggaagcggaggttgcagtgaggcaggatcgcaccattgcactccagcctgggcaacaagagtgaaattccatctcaaaaaataatagtagtaataataataagtttttttaaaaagaagtaaacaaaatcagtataagatagtaaaatcagtgataaccactgcctcagagctgattgccaagatagacagtatcttgtcattattaagagagaagaaaattaatgtgttccccctccccacaggttcaggatgcatttagatgccgattgagaaactgtcaggatcccatcaatgcagattcttcgagttcgtttcctaatgggcatgctcaaatcatggtgagtttttatttttccccgattgttaattaactcatgatttctcaagggaataaaagaaatccttatgagtaaaatagtgtaaaattttcattttgattgactttggcttcagttcattaatagactgtgaactctggtaccacagaagtattatttccagatggcttcagagtccaggacatgttgttggctccctggggtgttgagtgtgggagtcctatgcaacactgtgaagtatgttcctccttgcgtagaattagggctaatgatttatgcataggatcatgtggatgtcttttacagatcagaacactatgaacctgcacttctagtcttaaagcagtggttcttggccttagtgaaacattggaatcatcaggggagctacaccacagaccaattaaaatcaaaatattgggagtaggacctaggtattggtgattccagtatgcagcctaagatgagaaccactgttctaaagtgtaaggagtagccactcttttagtgaaagaccagttattgtacatgagctctggttattattggaatcaaagtgtactttaggtataaccactttgatgtattttagaaataagatgagatttaaactctgtcatttaaagcaggaattaaataggacagttttacttttacagtatattcaatttattattaacttttttgaactaggcaacaataataaactagatgatacattagtaactaagactttacaaagaataatcaactccttactaaaaacaaatagatagccaaaatctctgatttaaaatattaatagggaaaggcatttgattggaagaccctgatcaagataatgaaattttatcatttcaaaacattaattgatttgcttaaaataaaagttttaggaaaatatgaggtcacaactaaaccccagaaggttctcgaccagatgagtatggtttaatcttcagttttaagtcctaaacctgaaagctttttgccacatttgagtgaaaatgaatcattagaagagcctagtttgagcctagtttaacctagtttgacaaagctggattctaagatgttacattacaagcaatatattcaaattgaatgtttaaaaatgccaataacaaacataattatttaagaatattcataataattcacattctgatgtctttattatggttagagaattgccttaaaattctatccttctaatatatagtaatcagtttccagactgaagatgacactgggtattgtattatcttattaaaattgtgtgctatgtttcctttgattttatttaacatttgggctctagaaaacactgttgaaaacaatctaattatacatagagaaatttcctatgaacaaaacaataaacttgtactgccaagttagatatctgtaaacttcagataatctgattagtaaaagacacttgaggtcttcattaaatgatggttctatgtcttattatttattgttacagacagactttgaaaaggatgtagacattgcctgtcgatcaggtaagaatatttagattttgaaatctaatcagtagggatgttcaatcatttctatagattttaattttaaagaaaatgctgtggtttacacattacatattgttctgtgaaagggctgtatatgtaaagcagcccccaaatgccaaaggagctgagaaaccaaagaacgaggcagaaaaatccagttgttggtaaaaggtaggatattagggaacttacagacaggagtgtagtcttgggcagcagcaagacagatagatccccacacagttactcttcagacacagggtttatataccatagggaaaggggaaacatgctgtatagacaattaaaggcaaccctccagaatgggcaagagtgctatgtgcctcatagcctatgatttgtacaataacatcaaggttgctttgatctacaggcagaatttgtaatgagtacatgttcttacattaagcacactaaataaagtaagaatcaggaggcattcataggactggggttattgagaaatcaaaatggtggattagcattcaagatggagtcactgtctccatatttatgtgtatgacaaaatagaattcttaaaatggaaggactgtaataatggaagtgtgtttgtggaggaagaaggagagagagagagaaaaagagagagagaacaagagaaatgagagaaaaactaagaatggttcattggaaacaccatgacagcagaaaaactttcacatggagacataagatttccattccaccaagtaatggttgttgggtgtaaggccagtcaatttaacctttctgtgcctctattttatcaagtacggaatatgggttattgtaaagatggaattgcattgtctgtatgtgtattaaggttgttgtggttttaattttacaaagggtgaagagaagctctgcagcacgtcctgtttagagggttgtatgccataatctcccagcctgtggctaaattctcaccagagtagatggctcaatagttttaaaggaaactatatgttcaattttgggggatagttccaattgttggaatatggtcctttgtaggaacagaatatgcctcattttaccttttatttgttgatcttggtgctgcctttcaaaacaacagtgaatatctacttcatctaaatatccaactatcttaaagcaattatcatttagcccaatccaagtatttttttcttcagattaaacaagccttgtttcatccttcatttcttgtagcattctctgaggcacgatgcccaaggtagcctccgatttatcaataattttaaattatcgtgctcaaatatatacatgttcacccagcatttatcacagtgggctctttacttgtattaatgatttgcatatgatttctatttcagtactagtgtcaacttacctgaaattcctaaaactttttgtagaagttgtcagggcatccccagtcttatttgtaaaggttttgtttttggtatgttttccttgaaaaagaaatttgtcctttgcagttatgtctatttgctattattttaccaatttcaggttagcatactatccatttccattgtttggtgactaaaagttttataagactaccttctaagtctttattcaaactgtagttaaaagagttgaatggcatgaaacctagtagagaaacctgctatattcagtaaggcacccccttactgccagcagacctcctctacatggagctttcagattcaactcaaaaccattaaacatctgtacagaatctcaggtcctgtcatgatcacaagaatatgagaaactaatctcatattctcattcctggatttaatctaaatactctatgtagagtatggtcatagcaaaacagtaaggtaactatcatgatttggcaacctgtagtggacctgcactgggcattagaaatcactatctcctgttgaaaacctaacaaaatgttgtcaggatgcagtctcactagtgcttggtttccagaattgatcgttttccttttttggataattgatataatattgtcactgtgctccatccacctgccataatttctcaaaaatcactagccatggtgccaatttccacatctatgttccaagatggaatgtgatttgtccgggtttagaagcttgaatttatttacaatgaataagtattcatttaattcctaatcttccaccttcagtgttgtttttttcagcctcatttggtgtactcattacagttctccttgacagagaagcaatataagagcagacaggtttgtctttcctctaacagctgtaacattaaaccagtggttgtcaaagagtggtccctagaccatcagtgttatcatcacctgagaacttattagaaatgcatattttgaggccctaacccaggcctttggggtctgaaactggaggttggggtataggaactagttataagccatccagataattttgatgcatgctaaaatttgagtaccactgtattagaccatcctcctcaagctgtgatctcatctctgcagtatttatcttgttctccttcattaaattacagatttttcccgggcctcattgtatgctgggatttagcatccctaatacaggccagtgccattattttattagaaaataatttttctaatgttttcatttgttattggtgcccttttcagttgagcccattaggatctttcttctgagtttatctagagttgtctgtctatgttgaagcgtattcatgaactctgaataatctttctttatactgaggtgaaattcacttccctaaatggcagcatttccatctgatcatgccaaatattcagttgctttatattttgtttgaagtttgtgtttcactacttgattagtttctctcgaaagtcccatcactttaacatcatgttttcgtgtgtaggtggtatgatttgtttatgctgtatattcaaaacttggatatacattttaagtaagtctaagaggcaggcatttctctcgtatagagcagccactactgcaaaagaagaattatctttctttacacacacacgtatatatatatatattttttttcagcaaacacaactatatcacttgattgaaatgtgttggctataattataaatcatattacatttgtgcaaaacttaatgtatcttgtacgaatttaaattatagagtcaatacacagtaccaatacttcctttatagttttttaataaaagattaaacttatctatatattttaatgaaacaaaataggttcccatatattttactgctataaattttggaattatttttatatacaattaagggttaaaagtgttccttactgaatttggagattttttttaagtatttatttacaatatcattaaatcattacaatatcattaaatttagcatactttgccccttactatgtcatgtatcattactcctggaaattacaactcattattgatctattatattaagacttttggaaataactttttaaaactgaattattctactttttattatgtataacacttaattacataaaaaggcacagcaaaattgttaatcttaaaaaaaagatgtaaatttaacatgatttttactgcctaagataaagagacaataatacaataactagatataatatctttcaagataacagatattacatgaatgattcatgttttgaaataattttaaagtcttgtttctatgtaacagggaaagacataatctttttcaacttctgctttaatgaataataattatgattctacttgaaaattggataataatggaaaaaaatcagtatatctgaaactttttatgaggagacaataaaccagacttttacagtcatctatgcctaatgaaattttaaatgatgattgctctacttcgtaggtaggttagcaccagatgtgcatgttgaaccaacttcgcacagcgctattctgtgtgctttcaattccaaagttacaaaaataagtcttcagaattttattcatttgtatcctcaaaactgatgattgttcataactaagcatgctttgtgttattctgccctattatccccaaaacatggctttctttttatacagaggcaaaaagagaaaaaaaaactaaaatatattttaataaagaattatttactcttttgttgattgtttttgtttggtttggtttgcatttttgttttgttccctttcatactacaagttatcatagatttttttccctaaatcattattcttaggcttaaagtggaacaaagattttggaggttcataaagtgtttttttcttaaactcagctggcaattttaatattcccgcaagggcattccagcttatagattaattttttaaattttctttcttccatataaaactgaatatgataaatacttttgaatattgtatccaccttgaccatatggacttcagtgaaaaaatcctcattaattttcaatatgcataatttttggagggatttctgatccagtaggatgaagttcccattaattatcccttcaagaagcattttaatgagcgtaacttctagaacacattggagggaaagccattaagaaaaaaatcaaatttgtatgaatatgttcataattttacaaaaatcctttggagcacattgatggagaaaacttctctggtaatctcctatttccctgaaaagttatatggagttgtttaaggacagggtactaagatttttgaaagcccattaatcaactttcagatttgctttagctatgggctacctgagatctatgagagcataacagaatcaatgaaaagtgattgagtaatctctctggaccatgtacaaacaaattgatatgtattttttttaaataacatacctaccaaataatatatctttaatgtttagtagaaagcgagacaacataatataataatgaaaaataaacacacattaactctctttcttcaactttacattcctactcacagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccgcatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagaggtgagccacagaagattaaatttttccttgatagttgaaatatgaatagatataaatagagatattgattgattggttgattgattgatgtgacactggtgtgggaagagaagattcacattagcttttgcagttttgtatcatgaaaatttctggctattgagattcagtctcaatgtagggttttctcagtagtgtattatcatccccttattcaagataatatttgaaaaggaacccattatatttaaaaagatactaatcagtcataattctgtcatcatgggaactaaggcactcataaaaaataaaataaaataaataaataaataaataacaggattcttctgatgtttctcaggtaccacaggtccttttggtgcacagtgtctacgtggcattacaaacttaaactgagatctgcactttctgtgtaacagcaactgttaaaaattacaaaattggaatatttctctaaatgttttaccattatactgatgaaaaactaattattattacagtagatcaatattattcagagtaaatattttgctcttaacttacagaataatgaccattaaaattttgcatcttagactgtgaattgtcaggaagaatgtaatctgagcatactaacaggattctgaggtccaaccacatggcctttttgttttcataaggccaccaaaagcaaagagtaaactcgtcactgcttatacagtgaaaaatagctgtaaacctgtggttgacatatatattcatatacgatgcaatacatgcatacttttatatgattgccacttgttttagtataatagattattacataaaacactatctacagaaaggcactataattagttgcctgccctttccaacccagttatgctgataattgtatgttcaagtgtccaaaagttcccagaggcaattgtttcatgcttctccccaaagccattccttccactaggtcaaaatgaagaggcattctgagagtcttaaaaaatgcgatgaataaggtaattttcagggttttcccaattgattgagaaaattctagacaataaatggtaatgtgaatagaatctaagataagtccctaagttctggatcaccctcaaactgagtaaggcttctgaggataactaggtcagaatcattcttcagaaccaaaggcatagatagggcttcattagaagccaagttcaactccagggtgactgaagctcccttctgaacaaaagtatttcatcctcctgaattagcagaatagctgcagtttctttatttgtaacttgcatatcccagagacttccaggtttgtaataatgaccacataagaacaaactacaaaatatttatgcaaaaatcacagaagtttttaaaaggattttcagtaagtgtgcatataataacataacattataagtaatcataatgactatatggaagttttctgtatagtgtggctcttttaaatgtgttaaagggggttgaatggaactgcatgaaaatattttggttgttacaaaaatgttttacatctaaaagcctgaaaattttgctggattgatattgtacaggttatctgtgcttgaacaatagactgtatttccaagaacttctttcttcagtttgtaatttttccaaatttccgtatccttattattaagtgtattatatataactgtgattcagccaaaagacctgcatttaaatgacttagagatcacaagacttacatcttgaaaaggaaggaaatttggaattcagaatgaaaatttggttcttcattttcattctttaaatgaatttaatagtaattgcttagggtgactattttatgagatagcagaaagagaatatatagatgtgggaatgaataataaaaattagcatttatatagcatctttcattagcagatcctcaaatcactttaaaaacaggaattaatcttcacaacacctccatgcaagggataagttgttataatcctcaaactagagtcatttgttcaaggttatagagcaagtgcatagcaaatctaggaatagaatctttctgtcctgatcaattttatgccatctagaagagacagtaatgagcctgaatattagcatgaaggtaactttaaagttctttctaatccttgataggcatttggtcttatgattaataaagacatgaaatgggtaaagcccttgtcctttaagtgtgtacaactaacacattttggaaatggggctgtgttcatgaagataaagtttttggtctggctttcttctcgggcagcatgatgcattgtcaagtagaattatcagctctgctagattgcgtatgcagggtcaactggtgagggagatgctattctgacaataataaaggaaaagcagaaaaatgacctgagtatctacatagagagtgggattaacagtagtcaggaggtgttttgagtcttagaagataatgttaaggtgaaaatggtaaataatgtggatcacatgaggcctaagcaataggacaatttaagtcttttctccctgtaagtaagaaggaagattaaagccatagagaacatccagcctgggcagctggcacagcagaggatggccaagatcctcaggatactttcaaggatataatataaagacgctcacattttacctccagaggagtcagttttcacaaactgccagcatggaaagtgctgaaggaaaaaacagaagaaggtaaacactgccagttgtagaatagaatttgatagaaagtggaaaagaggaaaaacgagagttgagggaggaaaaaagaaagccaaaaagagtgcagagggtgagtgggtggaagtatttattcaaataagcaagaagcaacaaagaaagaaggaggctccccaaccccgaagtcagtgccagcacaacagcttccagccttcatgggagtttgttcagctaaccaccaattattggatataaaaagttcaataaattcatgaagtttcttggcataaaaacatatctagattttctctgagcctaatagtaccttgtttctttccttctggtgatatgttctctttctaactgtagtcattcccaaatgaacttgttaagcaattctgaaaactttagatacagagctgccactattatggaacaattgcaatactaatatactaagatttttcacaacaatggctccagccctaaatatcctgtaactgctttgcttaaggttaagaagaatgatattgttgtcagcactttagtcatttaccttcaattaatgaacaaaatgtgatgagtgcatggtgtatacatagagcaaaacaacagcaacaacaaaaaacatactaagattttgcttttgagcaagaggggacaaaagagatatcatggttctcaagcacttgaggactataaaatctaatttaaaccttggattgttctttatttatttcctgaaaaattatagttgtaacattgtagagagacaggtcagtgtttgttctgaatcattgaaactctggtatttactttagcaggttgtagaagttagatttaaatagtaagcattttttcactcaagagtctttccaacttatgtgcacatcttggacatgtttagcacatggtccattcttcactcttttccctgtatcattcaaggttaatttaggttcttgagtcactggcttttggctgggttctaccaacaggaagcactggtgagagagtagaggttgaggaaaagagggaaacctgggatctttctcccttactctttctgcttttggaagcaccttgtatgtctggtgtagttcccacagtgcttccagtatatgccaggtgctgcaacctctgggcttaaatcactctgccctctctttgtatctgtccagcctaggaggtacactgacctcttctgcgaatccctgggttactacatggtcccctatgtggcatctcagttcttctatcatttgaatttttgtggaccatcttgctgaaatgtaaacaccttaagtggtttctgttgttcttgccttaatttttcttatcaataaaaaacttaataactgataacagttagatagtacattacaaaatgcttacccaaaatagaagattttgttgttttagcttgtctatttgtgtataagcttacctatatgtctgaaaccaaataagtctctctcaatttgtaatggccagaaaggacaccattctaggctaaatttttatacaccagtttttctctggacatgaattatagagctctcagcataatggtttttaaaggtaaaatattttagcaataatatcacattacaggtgcctcccttacagctgttgtgaggatcaaattagataatgtacatgaaaaacctttgaaattgtaagaagcactttagatgtaagattatgttattattatgtcattactgtaatgccctgaatttctgcaaagaaatttgaatgctgagttaaatcgatattcacaatattagaaaaaatgttatggcctcactcaggaactggggcactctgtcactaacagaaaccattataaaattgaccatgtgcagaaacaactttttcttttttacatttttttctcttttacattttttttctcatgtaagtctgatgaaaggaaaacttgcccttttttactgttttgcttttactcctggattacagaattttgtctctcttgcaggcgtacaacaaaattagcttgaataaaagtcatttttaaaaattaattattctcaggtatcatttctgcagctatttttagtggatttgctaccagaactttctccttgcaagtaggtttattggtcactttgtaatagaaattttaatggcatattgccattcattagtcagtggaatttattacttgctgtgaatcttctagtatcttgtccagcttaatttgcagtgacgaaaataatgaagtattccctttgagaaattattcatcattctacaagacttagatgtggagaaatgcctctatgcatacattcactaagtattcctttgagtagcttcatactgttgtacattttctcacttttaaatcatcgtaaagaatttctcctttctattagtgataggccttccttcctgcaaattgtcttgattctcttagctgtcagttgacctgttcataatggttttcgttgtgtgtttagtctacctgcttaaacaaattctctcagagtatgcccaagcaaagcagcaacaacaaaacaaaaataaaaagtcacattcttttgaacacttttggctgttgtcgtgcagctcttttaatcatttaccaataattttgtgaatgtctcctattgtgccatgccctctgctagatgctgcggatctaaatgtaatcaagatagaaatggatcttgcccctgtggagaatacaccctatggcagagacagacaaccattaaaccaatgaatgaaatagtgtgcagtaatgggtaataactatggaatgaaagggagagatttctctagataaggtggtctgggaagcatctgaaagtgtcatttattgtaagaaataaaattgagaagtaatgtggcttgcaaggagctgagggaatttttcaggcaaaagaaactgtaagtgcagtgatcctgaggtagaaaagagttttggcatattctcataagatcacaatacctgtgtagctaatgttgaactccttaagatgaagttaaaatgcaaaggagagaccagactttgcagagtcttgtaaagcaatggaagcaaatgaggactgttaagcaaaagattgtcacaatgtgtctttatagcagcatgatttagagttctttgggtatatatccggtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatgtgattgtggttttgatttgcatttctctgatggccagtgatgatgagcattttttcatgtgttttttggctgcataaatgtcttcttttgagaagtgtctgttcatgacacatgcacacgtatgtttattgcggcattattcacaatagcaaagacttggaaccaacccaaatgtccaacaatgatagactggattaagaaaatgtggcacatatacaccatggaatactatgaggccataaaaaatgatgaattcatgtcctttgtagggacatggatgaaattggaaagcatcattctccgtaaactatcgcaagaacaaaaaaccaaacaccgcatattctcactcataggtaggaattgaacaatgagatcacatggacacaggaaggggaatatcacactctggggactgtggtggggtggggggaggggggagggacagcattgggagatatacctaatgctagatgacgagttaatgggtgcagcgcaccagcatggcacatgtatacatatgtaactaacctgcacaatgtgcacatgtaccctaaaacttaaagtataatattaaaaaaaaagattgtcacaatgatttttccatcgattcaactatccatccgtccattcatccataactttggttgttcagaaagcaaaggattagaagccagaggttttaggagaggagatagaacagaaagttggataacagtcagaaagctgctgaagtaatccagacaagagataacagttgctttgactgtgcaggtgaaagtggagatagaaaacagtgggcagaacaagacgtatttcagagatagaacagatggcacatgctggtggattgaatgtggaaaacgagggacagaaaggaaggaagggtgactcctgagtctctcgcttgaccaattagaaatccagcattttctatcatgggaaaggcaggaggaataaaagatgtttggaacttaaaagatggtattcaaaatcatgggaatgaattatggtatccagaagagaataagagaaagaagagagcccaggaactcaacatttagaaggcagggatatgagagagccaacaaaggggacttcagcataagctgcagcaagaaagagggggaaaaataagaagactgagagctgatgagtgttttcatgagaaaattattaactttcaaaagcttctgagtgtccaataagatggacagaaaattgaccttggaatttgaccagatggagctcatcagagactgtcagcaagaggaattttaatggagtattgagaatagaatacaagttgagatgagttctaagtgggaaattaagaagaggaaacagcatagaaattaggaagaggaaagagcatagaaggtttccattacctactttgagaaaaaggattatttacgttaggttatttgcaaaattggaatatatgtacagagggatttgtatcttcattaaatatttcaatatcacctatccctggcttatattaaatttacatgtagcatttttaaaagttatcagattatcagaaaaattgttatggcttgaccacttttctcagttggttcttaatttaaaacatacataacaatttccaatcactttcttctctggaattaatattttagagagctcagaaagacatttgaataaacatgcaagtcagttagggtttcaataaacttcaatactttgaaagactttccaatacactgtatgtataccaacggtggaaacagaccaaaactgaacagaattgaatgttcttattctttctttacaccatcaatttcccaatgccccatgcccctttaagataaactaaggctggggtggagcctcacgcctgtaatctcagcactttgagaggctgaagcaggtggatcgcttgagcccaggagttcaagatcattctaggcaacatgacaaaatcttatctctacaaaaaatgcaaaacttaaccaggtgttgtggcacatgtctatagccccagctactaggagggctgaggtggaaggatcacttgagccctgaatgttgaggctgcagtgagctgtgatcatgccactgaaccccggcctgggtgacagagcaagaccatttcaaaaaaaaaaaaaaaaaaagagagagcgagtcatgtctggaggtggagaagtctcctactgtttgttattgtatcattgcttataaatgattgcacattagaatgatttctaagttattttactcaacacagatattttctcaaatatgtaaatatcaaattgctaggttttttttctccttcaaaatgcaattgacaagtaaaagttaacctgcttgaccttgctttatgcttagaaagtcagacttggactgactggctcatctattgttatttttgctgagtctggtaacaattagcaaaacatcacaggcatttttactgtaacatatcactcctgtattactgagaagacagcaagagatagtaaatgaaatgctgcgcttgtagtcagaagtcctgagtttgaatcccaactcatttgcttaccacacaggtgaagtgggcaagtaattttaactccactgaccctcaatttttcttattcataaaataaggaaaataaataatattttatccgaccatcccactggtgggtagcatgtgcaaatgtgaaagtgctatataaacaataaaaggttgaaacacttggtcagtattgtggaaacctgaataactttacacacatttttaactcacttggactgtaaaaatctgtcattttttcccactctctaatttttaaggctttactgctttattttgcatccactccaaatcccaccaccatctttaggttcttttgattaaaatctgtttgtttgatttgttcattccttagtctaatccttcaagactgccagttctgctatgccttatgttagaatttaattttaataaaattaaataggaatgagatctacttgtatgagtgtatccattttccttccatatttcacattgacatacctgctctcagaaacagaatctatctctggtgatctaggttcctgtcttttgctcttgcttctaaatctttttcacaaaatgtcactatttaattttcaaataaaatgcaaagctcatgactaatgttttataattattgcttaaaactgtttccagccttgaattttgctgtattaagaaagaatcttgcttaatgtatactgacaaaaatgtcctgcttagtcacagtgccaagaaaggtatccaagagcagaatggaagccctgacatttagtctagcatattgcagcaaagtgtggtgcagtacactggagcctggtttttacacagcacagttagataacaatagtggcggggagatggcaaaagagggctgggctcaatgcctggatgtcaccacggcgaggctgaggtgctgttggagacaagaagaaagtgagatcaacctgctgagtttttatttaataaagcagtctcctttcagccctctccttgattgtacttgaagactgcattttcagtcttaagcagcttcactaaaataaaattatttcaggaatttttcacttaaaacatgaaacctttctttcggcatgtccccttctgtctactgaaacgtggtttggggattaggtatacagtgaggttctgattctgtaatgacaattttaactgtagctgcagaaatttaatcatagttttcaagaaactacattagtgcttcttttctgtctctcctaatgttcaagagttaaaatgcagactagagtctgctacctatcttgggtatgatttcctattaaattattgaagtttgtaggtgttgggatgggagcacgggaaaaataaaacaaaattttgcccaaaggtttgtatatttttccaactgcctgaatattacatgctttaattgtttgttaattctccctgtttcattccctctctcatcaaaaaattctaaatttaaaaaatctgtactaaaagtttgctaagaatactttatactaatatcatgaaaatcatatcacatgaaatatattaatttcattgtaatcctgttttctggttgtatcagtcctcattattttattaatgcattttatctgtaactagatttcagaaactgtttaacaaaggtggagccacagagaaacactgtgagacatttacacatacatctacattttactggggtgcggaatagtttgttttgctgaactagaacaaatacgttagttccttaggactagcaatgagaaggacttttctgtcatggaggactatcaaattacaagaaatatgtgggtgagacttatgaagaactttgggacttagaggactggttagaatttggtaggaaggaaaactagaagttggttgaagatgtcgaggtaactagacagtttttcctatacaacttttaatcctgtttgtctgtagctttgctgtagtaagcctaaagtctctttcaagattgaaatgtctgtttgagttttcataggaacattttctccttactaaaaattagggttaagaggtcaaaatgagaaatattctgtatttttatattctccaattttaaaagaagttcaaagtgaaaatagaaaattgtgaatggaatattttgaaatcataaaatttttcatgattcatgaaattttacatttttccttatgtgaaggaaatatgtataaaacaagcaggattatctttaatgaaaatgatgatttttcattttgtttgaatgactaaacataactttattggtttttctccttctttttaaaaatatatcttacagagaagaaaatcacgatattcagaccttgactttgaggtaagtttatatgaattattttagaattgtaattacttgaattcaaaatagatatatagttacttaaaaattattactctatgcagccatgtaagggtattatgtactaatttaattaaataagtcaaacatttttaattaaagtttatcctgtataggatgaaatttttaaattttgaattacttcaagtatttgctaaactgagattttctggacaagtgaggaatttgttttatacatactacgataagtgaacaatttatgttaggagttgaacctggttgattcagtttgtagggagggggaatgtcagcttcctgatttttatatttaaagcaattttcttggttttacttcagtgactgcctgaagagatcctgtgagtatgcttaggctggttagctaggctttctctgaaaattacttgtttcatgttctgattcctgctatttaggttctctgcggtacatttgatgctttttttttcagtagaaactattgattcaatgtgctcctgtgtttagtaaacgccttttcacagatacaaacaagatgaaaattttcattttccaatttacattgaatttatattgatgctgtaatatgtttactcgaaattactgaaatcataccatctgaggaggttatgctaaatacaaaattaatgacgtttaagcaccacataaaatgtacttatgtgtattgataattggatatgattcatagtctgctaacataattggatataatacattatatatttctccagtatatttgtacctttgtgatgcatacatagaactcaatactcttaattgatactcctaaaattacagaagcctcccagaacgtgctaactactcctaattcagtcgtttcatttatgtagatcaatgttctagctctacaatgtacatcatgtgtcaaaactaagacttgtttttatttactgcaatggtcaacaatggttttaccctgaatggagtccaaggataattggttcttttcagtaacatttcagactacaagatacaaagtaatgataaggaatcttttatctacgattaaatagcaaattttaatactgatgcagcctcattgtagtaacttagcattgaatatatatttaattgtatccaaagtttttagcataaaagtatcaagaatataaatctgaatagacaatattcagcaatctttgccttcagattttttagtgcctttgaagaacagatattttatagctttttaatattaattcttcaggtagccaaaaatagaggatcagactgtatatattcatgtctaaaagcaataaattgttatgttagtataaaggaaaggaggaaggaattaacccactaggcatcagcggcaaaatatagtaaaaacctagaactaaaattaagcctcaattaaaccaacctaagttatgtaatcacaaacactgaaaagaaatctaatcatactgtgtcacttggagcattagaaaaactgttcttttttcatctattctctatggcaactggtagcagattccttaagctgatacttacttctacgcttattattccacccataaaaccatgttgttagtaaaacttttgctgataaataagagaaattgcaacacaagaaccccggacatgtctttagctctttaattgctgtaatcactgcatgattactacaggtgtcaaaatttggtggggcaggtgggaactttgagacattacttttactctacaaattgtttagagctatttcccttagtctcatgtgctataacaggtatgtggcagatatttcgtggattgagtttagaaaacttattgccaagtataaatgcgaatgaattgtgatacaatctatttatattttgtgggtggttcttgagggaaagtccaagttgtccccctcttaattcaggctagcttaattaaatttgtatcaagctccctgacactcctgctccgcctgcaagctttatcatataatggccagcttaaatattttgccactgacagactgcttcttggacttcttaaaacatctttgcttcaggctttaaggctaacacactccccagagtccacacactatgataatattctgccaactcatatatccctaaaactcttgtggctagttaatgtcataccaggggaatagccctttcatgtagccagtctccagaacagcattgcatttctggattcttgctttctggaaactatacagaaaatactgtagtgatattcttgtgttctgtaaccaaatgccttattgaaattgtatgcccacctccagagatcctagtacctagtaagcattcagtaatttttttaaaagaatggtgaaaaattgaattatttttccatccagtttgtttaacaaaatgttattggacactgtacctgagttaaggcagagactagtataaaaaatgacaactatggaagagacgtttcaaagatagccacactgaatttcaaagatatccacattagatataactcaaggagatagaaaaatggcaggtagaaattccaggaataggaaaaggcatgtaggttggctaatctgtggcattcttaagaaacaacaggtaagtcaaaatttacctaaacaggtgtctatggaagaagagactaaagtgagtaatttagaaaccatgccttatagtccaggagggatttttatttaatttgctactaaaagctgctaagctttttctattgtattttgtttgcttgttgttgttgctgctgttgtttcagcacagaatgattttttatactctaggttttaaaaagatgagtatgtcaggttttaaaaagatgaggatagattgtagcagggtgaaaggtgaagtagaaataccaattaggattggctagtatagtaggtaatgaaagtccacttcctggaggtggtaggaagagaaagcaaagagaagactctgcagaggcagaatctatggaatttggtccttaactgaacatagggtgaaagggtgagggagcagaaaaaagaagactcttcagttctgagcctgagtttttgctagtaccagtaacagaaccagggaaatcaagaagatatctagtcagggtgagttccattttaatattttagaataaagattcctaatgtgatgttaaaacagacaattaggtaagttgttctaatcgtctgtcttgtgtcgagatttgggctctaagaattcccagaaacacaattacaggcattcattctgaaacgctaatagataacagtatccatgccatgttaaaaatatatggataaagaagtatccatgaaaccccatctctactgaaaatacaaaaattagctgggcatggcagtgcatacctgtaatcccggctacttgggaggctggggcgggagaattgattgaatccaggaggtggagattgcagtgaaccaagatcgtgccgctgccctccagtctggacaacaaagtgagactccatctcaaaacaaagtaaaaacaaacaaagaacaacaaaaagaactgtatccatatacttgtcatacggatatgtcttttttaatcttcacttccaaaaatgcagagataaaaattttcacagttttccatgaaaattatgtagccttttttttttttttttttttttttttttgacagaggctggctttgttactcacactggagtgcagtggtgcaatcttggctcattgcaacctctacctcctgggttcaaggaatcctctcatgtcagcctcctagtagctgggaccacaggcatgtgccaccatgcttggcttacttatattttgttttgttttttgtatagatggggtctcaccatgttgcccaggccagtctcgaactctggggctcatgtgatccccttgactcagcctcccaaaatgctgggattataggcatgagccaccgttcctggcctatgtagccttttaaaaacattttaggatatttctctgagtttttaatgagctccatacttccactattttcatatttctcaaactgggagacaatgatggtggacagaggacaaaagaagacacagacacagggtaatcacaaatccccattttcatgggggcttgagtttttacaaggagatttgggggataatagaagtaagagatcattttatattaactcaatatcactacaaacacagctaaattgtgacatagaaatcaaagtatatttcaatttctaagtataaggcataagatttcaaagaaatgtcttgttcataacagacttcttcctgcgccatccctgagccccagcagtaagtgcactccattaggcaatctgggtacttttagaggaaaagtttgagcaatttagtcctagacaatagccatctttttttatattactaaatttaaactgttgcaaaattatgcatttacagcaagtatactcatgattgacagtggcaaaataaaaaaatatgcaactaatttttgctgttttcagaccctgcatctagtttcttttaaactctggcatcatatttattcaaacagaaacatatttgaaacatagacactaaaaatgggtctacaagttccatgtgagggatgcattgggactccagccaaggaaatcatccccctttcacaacacactttaagaactaagctaaatccctgtagtgtgcattgcttccttaatatgagttttgacattcactttaggctaatattcaacaacctactctggagagaggaatacagggctcagaaaatggtagcccagagtatggtgctttggcatactgagtgctttgaactaagaacattgaaaggcctcagaagcaacctcagaatcaggatctctctgatcttctctttccctcctgtcagtggccccttattctcctccaaagtaagtcatagataccagaattcctcttcaccaaattggatcatagtaagtagaacttcttttccccaaagcaagccaaaaaacttaaaaatattactctaaccttcccttcccttttcatctagaagccagccataaaggactcatgcaaaccagtaaagaagaagaaccacaggttcatcttagccgatatgggcaacggcattgtaggtgtataaagttctaaggctggaaaacgtcattcacagaaactggtttctaattcccatcagcccatgatttccagacctcatactataatgtttatggttaggagattctccaactttctctaacaatttatttcagcttctaaaagtctgtatacagtgaatacctctctgatatataattcagacttaagcatcaactctgtgattcacacttatgaattaaagtgaaaatctgtaaacagttttttctaagcccacctacaggtcatttacaggtcatttacaagtcatttgtattaaaaagaaaggaacacaataaaatcagaatgaggaggcaaagctcctggttgggacaagtaaatgagccattcttccagcgggaagacctcttttatagaagaagaggacatttataatggccttccatgtggcagtcgccttccctggcctatatgtctatgctgtcttgttcatttaaggtattcagtatacatttattgagcacctgctgaatgccagatgctgtgtgctaggtgccagtgatatacagacgaataagcaattgtccaggaactgttcagagacaaaatatgaagaccagccattaaaaatataattgcagtactatgaaatagctgcagggtgatcaatatccatggagcttatgggctcactacagagggcacctagcccatcctggattgttttgtctcattttccattttaaaaagacataattacaaacctgaatagtctaaagaagagtgctccctgaatctatgagacacatctaagatagcaacaagcaaagagaattgatgtggaattcagaaagaattccagcttgctcactacttgtgtgagcttgggaaacttacttagcctccttgagcttcagttttctaatcagtaaagtggagataatggctttacctcccagggttattgtgaggattaagaaagataataatggctgccatttcttaagtggctcttatctgtgtggcccaatgataagtgttttatatccttttttaaatcttcaaaattaccctgcaacgtaagtctgattactgaaactggggctaaaaggagattagattttacacttcagaccacacaacttaaaagtgatacaactgaggtctaaatatacatttctctagatccaacttggagaaatatgctatcagacttggcatattccaagtattttaaatggtctaggagagttcttgggatatagcaggtactccagacatacaggtggctttccatcctcatttttctcaaatatctgaaatatgatgaatgtgcttcattttatagaatcactttttctctaatatcaataattaaaggattgcaatgactaattctcttgcatttaaaatgtataaaaagaaaggggtcttttgaaataagctactcaggaaagcatatttcttgtgcagttagattggtggtcctctcaggatggggattcatatacagcttcaagaaatgttgcgtgatagtaatatgaatgcaaggaaacattatcatgctcttatctttattgcaaaagatgcatataatatttgacagccacctgaattctatagatgtgtagatattgtcaatcagaatatatctttatttaaatagaaaatccacagattagaattttctcattattacacattttgaaaactcaattctaagttcagtttttgacagcagttaatttctttaaaaaacgggtgcttaaattagaaaagaaagaaaaaggcaatcagataaaccctaatgtcactaaacataaaaaacagctaaatgaaatagaccaatagatttataagcatgaaaacttctaagcaagtggcaactcattagaagcatcagtgctacaaataaatactcacacaagtaaataaataagaggaaacctttagtacatgtgaaaactaaaacgacacctaagttgttgccccagaatattgttgggttataaactttccaatgttcactgtgaagctggcattcttatcagtggactcttctttattttaaaggctggacgatctacttgagtctatgaacaagaagaaatcatgcttggacaatcaaactgagttcatgtcagagacatgagctgtcagtggcagctgttatgtgatacttctgccagaactccaggccatcattgctatggttatttctggcagtgccaaggtggcagtttcaaattagaatgaatatttggcatgaggaagtatttgcaattaatgtttctaggtaacaagggccccatatttcagcatacaaatttttcatttgtttccatattcatttcagcgtccttcagctttattattcagaatagctttaataaacccaggtagaaaataccaaaatgttttttagttacgtaatattggtgaccagcataactttatatttttcctgtatactttttagactttcatagcaatccaattctttgaaatatgatccacccagttctgaattaggtactacccattcaatcagaatataattataaaacctccaatcagctaatgtatattcttttccatggaatgtatttgatgcttggtttgcttcttaaaaatgctttatctggtgtaagtatttggctgcaacaaacattaggtgactttgactaatgaaataactgttggaaggggatggaataattcacctcttggccagagaatagtaggaatatcaatggacatttccagcaacatgggaaggatgggaaggtatagttccccaaggcaaagtcagaatcctcacaagatgaaggataattggagacttcacaaacaaaaattatcagatgctcatctcaaaataagggtgccgtgcctttggcatcaactctcttagaagagaatgagtttcttgtacttgaaaaggaaagatcccattgaagggaggggattccagcatagaattaaaaattgagctagaaattgtctgaatcctagaaaatggaaaagagaggatagacaaataagaccatgggaataactaatttgaggaatttcaaattaaatatgaatatatgaaaatgaggggattgcctcacttggatttatcttagcaaattatcctatcactttcatagcagtaccatatgttttctttatcacgcttacagttttacatttatttgaattattatggctgtgtcctccattagacttcaagctaccagagatcagaaactcaatcagattttgtgcaacatcattacctgagcatctagcacaatatgtgatgcttgtaagcatgtattaaatgatggaataaaatatctcagaaaaatgtcagtacatcaccccactgtgccatagaagaaaataactctatattataagattcattgctatgaaaaatgaaatttgtaagttagaagcacacccagtcttctaactacaatagtttttttttaagtgttccttatgacacaaatccatattttcatcagtatcttagaacctggtactgcatgaaagtgtttgtctcccaaaggaaagaatgtgctactttatgtttgccagtgacagggtcctcaaaatctccccattgagttgcttatgcaaatcctctctctcataaatctccacaagccatcactagtcaaattatgtttgcctggtgtttctctgttaatcctgcaaatccgttttgtatattcccccccaaactgatgggaagttaatcgctctataattgcttgctatgtttcatgtccctatcatgagtaatgttgccatgttcttgtcctcaaacacctgattctcacacagccaactcctagagccaaaaggagcaaagacagaaactgattgttgcaagacataaaatggcagaaatctctcacataaaagtaggctagtgaaaaggaaagaaatgagctaaacaatgtattgcctagatacatatttattaaatataggaaattaaagcttgcataggagagaacagacttttttaatgtgttaaagattcagttgtttttgtcttttgtccttttccttttcctcaaggagataaagtgcttctctgcagtgtcttttagaaggaattaggcattacagctctcccaaagatatatttctttttcaaaacaaatccttacttttgaaaatatttgctagttgaaacaatggaccaaatattcaaattctagcttaaacatagatataatatacctatgcaaaccacaggcacaaatggtaagttatgaggcatatgcttaaaatacagtaaaatcttacacaaatatgaaggcatagtcttggagaatcaccaaaatattgatttttaacttttaaaaatcaaaactgaggaagacattttctcctttaaaataacaattacaaatacagggcacttattatctaactcttcttcgttagtgctcttaaatgatctgtaattgaacaagattcagcccatgatacttaccccaaggccatttttatttgactccatttgttgagttatggtgaagttgagagaaaagggtgtaaccagggatgaggagtatgaatatatttgtatctgtgattttagaagcagatcagctacacaatttatgctctgaaccctaattgttaagaatctataccatctcctaaacaaatggatgaaatctatgggtcagattttccccctaagaagctcaatcattatgcacatggaaaatgcaaggttttacatcccacatatatttcagacactttaatgctttgattcagccttaatggcagggcttgggattttgttcccactttagtacagccagctaggattttagtgtttatagaaataaagcataaaaaagtaatatttcccatgacaaacatcagggactgggtgctttacaagtttaagtttttaaacattttaaaaatatgataacagtttttgtaaaacagttttaacttttgaataatgaaaatcttactcagaaatgactggtacatttttaatgtacccacaacaaaaccttttttttgtagtcttgtaagtgaaagaaaaagccaattcttaatgtgtaagaagtgctgaatatgagacaatgatttgctgcaacttatttgcatttgtgcatcttataggacctcctggttcctgccaaacttgattacccttattattaaagcaaaaatattaaatctctcttgtttgaaaaacatacatcaagttggggatgagagctatcttgttcttttttgcagaaggtcatgcatacaaggaagaggcatatggaactatttcaagaactaaatcagaaatttcaaactttggacagatttcgggatataccaaatacaagcagtatggtaagtatgctttgcttcaatgcctgagtagaagatgcatcatgtcagatattattcctgccttccaggacctcctaatggtgggaacataagatgagtctacatagaaaaaaaaagtataagcccccaaaacatactttggaaagtctaccaagacaaattaggaatgacagaatctttaggcattttattcatatttcaaatatcctcatttataagctttcattagagttagttttatatcaaaactatattggcttcatctgatcattttactgtcagagttaaaattaaaattaagtttcttttcaaatatccctttgggttaatatttccattttcatttgaatgtctgacataaatgtaattgttttatgtatatgaagttgtaacctgaaaccagagtgatagatttttgtctccaggagatttacttattttgtggtaagaattttcgtacacacatcaacactggggactctggttattaactgtgaccattctcttctcattcatttacattattataatcttagtacaggacttcatcaaataaaataactttgtacaattactatgtttatggcataatcatagcttcacagaagtttatgtaattataagagcactagaccaggactctagaaatcagtatactagtcgaaagctcaaaagctcaatcaagaactatctgatcttaagcaagtcacccaactcaggtttctaaactccaatttcaccctcctaaatggagcatagaaaatagtaattaatgtatatcttccgtcattacaacactttcaaaagcaagtaggttaagaagcaccttataggctaggaagctgaggctcagctataagacatagagctgggactgccatctgacaccagctcttctcctttgcccaaatatggggctctttctttgcctcatactctttgcggcccttggatggtccttcttcttttccagacatcaatatttatattgttctaaagtagatgacgtttggtcaccttcttaatctagtgattcttccatatatattttatgagccttagccctagcttcctgattagtaatgttagcttcggaagagctgaagagtatcttttatgtatctttatgtttttcttttattcctctcagtactagtacaattccagttgtgataagttatcatggcttctattgatttatagcatggctatgatcattcaatctgtgtttgttaaatgaaggctatgagaaatatacgctctaactcttaattggtctcttaatagtttcatgttcatcaatttttctccttaaagtaggaatcatgtattatttgttatcaccaatcaaatgctaggcatatagaaaacacttcattcataatgagtggatcttcctcttctactcctcctgatagaaggctatcaatttttagctagcatgcaagtgagaattacaccattgagattagacctaaacacattacctactcatttcgaaatattgaaagataacattgaaataattgaagaaacttcattacttaaaaaaggagagggttatatttacaaatctaaaagtcttatgcaacagatacagctggctaactgctataatatgattgtaatttccccttgttgtatggtctgggtattaaatcattaatggcacaactatctgtatctcagtttcctgacaacaaaaatagtctactaattacaccacatctctgcagcagcgtgccttttctagaagagatttataaatatttaccatttggaaggttaggagtggggaggatagagttgtcattgctgcttgactgtcatcctaaatatctgagaagagagagaaaaaaatgcgacttccttattcagtttttattaataatgagcatgagtgagttcattatctttaatttagtcacataatttgtagtggcacattattaatgaaaaattgcataattgggtggagacagacttttttaaaacctcaaataaaggggtttttcttttcttttctttttttttttttccgggctgctgactcacagcacctgcctggcactgcaaatgatggtaattatgtagaataatagaatttggggaatcaaagggaaaccaaaaaaccatttagtccatttccttgcttccaggcaggaaaacatttaaatcacactaaaaaagagaaggcactgatatccagagaagaaactattttactctgtgtgtgtttcacaaaccattcagttaagatctctttcccccaagtagcttttgcaaattcttactttttaaaaataagcatactcttttttgcttcgtacctaaatattggtaggttgaaagaaggagggaaagaaagaagagagagaggaatcaaaggagagaggaaggaagaaaaaaaggaaaggagaaaagagaaaaggatagatggatggagggagggagggacttatccacaagtggacagccagtgtgctctggatccacgaactatgggaaatgctcaggcagccctgccatatttttgggtggctctgaactctgtttacctaacattctatttctactgatgcagcttaagaccaaattagcattttgggaagcttcgtgcactttggcttatatggaatttatgatgttttagcctttaacaaatatgcatctgtttaactacagctccttattctgtactcaagtgcaaaacataaattaacaaacacaaaacagcagcataaattcggagacttacactaacttcgaagtttttatcataagattcacacctccattgaaacctttcctggcacctacagctctcatcaccaacttcagtgatccctttggacagctccacggttcatcatttacttggacaattgacaatattacacttttcagtatgagagtctataggctcctctcttatcacgcccaacacgcaggacgatgagtcgctcctgggtaccacacactgacaacaaagtctctccctactccctgcagatcttgttcccactctgacttctgagtgcagtagttttttaccactaaagaagcctctgacctaaagggcatccacacatttgtgaacaataatgagaacaccagttgagctgggagtggcttgggatgctaaagattagtagaaagccaaaattaatgaattatgaattaatgtattacccactaatagaacctctcaggaattcaataggtcatgtagtgacaataatagcatttgaaattagaatatagattttctgacaaagtttaaaattggccattttagttcacatatccataacagttgatctttgaaatcatatctgttccaaacataatggagcccctatatattccaagcaaatgaacaaatacttggaattacatactctgaattctttcaggattgaactaattggactttctttcaaactaaggattcccagaaatctcctttagacacaaccctcgtgtatgataaatgagtccactgtggatctgattcagtagaattcgaaccagtgagcctttcagttgatgtttgatgattcaggtctcaccatagtgcccctaaacgttcaacatctccctattgcctacaaaataaattccaaatttagtagccaggcattcagaatcccttatgatctggcttccacttcaccatctgcctgcttttctgctattctcttttatgccaactaaaatagataggtcctgttctcatggctttcccgtctccgtgttctttggatttttacttcccagtgtgtcattcagccaccagacctccaaccacacatatgtgttcgtggccaagcccatccctctattctggccctaatgttacttttctcagaaagttttatgtgtttcctgtataaagaagccatctctctatccttctctgaattcccatagtacttttcctggatgatagatataaatattaacatgttttaacctccatttaactatacattcttctgtaataagtatagctactatatattgagtgtttattaaattctccaggcatcattccaggttaccccacttttttatttttgcaaccccataaggtaggcattgatccacacgttctgccaactccttggcccacaatataaagcatatcgctgttttgcagatattcaggttgaggttcagaaaaatgaaatcaattgtttaaaatcacattcatctgaagtggaggaactggaatttggacctgcatgtatcaggctttaaatcttgagcttcctagtggaccatgctgattatgacttcatcctccctggtagctaatatggtgtctggcacagagcagctgataaataaatattgattgaagagaagcagagagggagagaggaaagaaaggaaggataaggcagaggtagagctacaagactgtaattcatgagactttagaatatttgactaaagcataattaattaattccctccacacatcctaaaaattaacctttcattaaatgtttactattaacctttcttccccatatattctcagaagtaaggttaatcagtgctgaaaacatctaatgcattaaacattttattaatttaatttccagttatggtaagtgtttttgttgttgttttggtttttggttttgggtttttttatgttgcccaggctggtctcacactcctgggcttaagcaatcctcctacctcagcctcccacgtagctagaattacaggcacacatcactgcacatggtttaggtatgataagtatttatacagattgcctctctttctttagccatagtttcagatgatgtttaatatattgagtggagtttggatagtaattcaagtacctattttctgttcacttggtaattgattataatcagttaaacgccagatttggggagcagggaaggcttacactcgacaactataatattctcactaaacatgacattctataatgaaaaataaaaaggaaattggaatattgggcttctaagatcattttaataattctgaaaaaatagaaattgagagctaatagaaattaaaggcagtgattttcaagagggaaatatctttcaaactttatagaatttattggtatacaattacaagtttaaaaaagtatttagataaacagttaaattttatctcataattattaattttagtcaatctgtattctacaacaaaaaactcataaaacaagagaatatagcagcatttaaatattctaaaatgttaatttcttgagaaaaactaggcatagtgatctaaattatttaatggaattctgttaccttgagtaactttttattatcaaataatatgccccataagacattctcaaatctgctaatctcaccaaatttctgtcacaatacttacattttctacatttaatcttagtggtgacttaactctccttcctacttcaacatatggtcatactgacaattcacaacatgccccaaacaaaacatcgcctactttgccttctatactactgttcacttcctttgattcctagaaaattgttgggtaactaagagaaggtattcatcagtttgttcaatgaaataaaactaaaatcaaaactatttcccacagttggccgtattttcaagtcatctctgcatcacagaaactggattaagattacaaacacgctctcttcctggaaacttcaactagcggtgatcctggtcatcacataaatgactctctttccctctcttctcaacaggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctacatatcagttttttagtgcattttattttggatttgttgaccagaaatttacatatttataaagttttttttcaatacagatactaaaaatgtattcacggttttaatagcatactattattactcctttgaggctaatgatttctcaaatgtaataataggtttatatagtgcttctgtattttctactcaaacattctttggaacgatgtaccatgtaaatggggcttgtcagaaatctgctgccatcatactcttacataaatattatgtttttttctatcttgtggcaaacagataactagtagaaaacagtaagtttccatacagaaaataatacagggaaaaatgttaattttaagtaatgaagtccactgcatgtttcacaaaggaaactactcatactacagttattcatcgcatacaaaaaaaagaacttcttcaggactttaaaaatttttatctatatagtctctagcaaaaggaaaaggggagtggatgtatttgattaaatgatttgtctctggtttgaaagtggaagcctgagttgagccaaatgcacaaacagtccctagtgtcttctcttgtgttaacgccacactggaaatttccctcgctccctcagatacacattaaaggaaataccagggggaaggattttagcagtttcttggtcatttcaatgatttgagatgtggttttttagtctgaggcaagtgaggggggtggagaggagactgggttcttcaaagttcctaaaatgtgtatttagatgagtctgtggttaaacctgagctgtgtggtcttctgtggtctgccccaaactcaagtgaatcagttcctgctcttcacgaccttggggatccggcactcaggccatgaggcagagactacggtgcttcaacattcaagtgcgcctctaagctagagccttaaaaaccacacagctcaggctgaactcctgtcagatacttataatgttctcaatgtcaagatgttaaaagtatatttttcatcagattttaaaaataaaagcaacatcgttatgcaaaaatataacataactaaggactgatttttcaataaaataaattttatgctaattataatgtaattgtatagcctatttataagatgactttttgctgataggaataatatttggcaaatctctccctcttagtctctgtttctctttctacatatatacatatataatatacacatatgtgtatgtatatatgtatatatctctatatatgtgtatcaatctacatatatatatataaatccataatgctcagtttaatctccgttacctataactgtgaatgcagaccatgtatgtggtcacccattccgcactgtaaaatcttgaaggaaaagaaacacactaagcatatgtttgaaaaaatacaaattcaatatgtttaaaaacatataaattcaatacattagctaatatttcttctacagattcactaccgtaaaataaaatcttatttttttactttgatttttctttagttctagtaactccatattagatgtatatgtgaaagctgtccagaaattgcacacttaagattgttagagtggattttttggctactctaagaagaatggcgagttgtggcgtggtgttttttgttttttaatctacaacaaaaaatgcaggtgaataagtctcaaggaatgataattttaaggaggccgttttctgctccattccttttaagtgttccctgaactccctctctctcgtgcacccacaaacacacaacacccgcacacatacatgcacacattcttccaaagctgagtcacagctgtccccttaggcaggggggcatatatattccagcctggcccactgcactcgtgactggccagaatctttgtgcccttccactagaagttcttctttttcctttatgtctaaattttacttgtgctttaagggacaactcatatttcatttccatagtttttcataattttcctccaagctagaaataagttctcccctgaactctcatgccactgtttctgtacttctcttaggacttttcaaatattctatcttgttatttacatgcatttctgatatcctctggtggactctaagtgcctggagggcaggagtcatgtctgatccattttatatttcttaagggacttagcacaataatgttcacacaataaatgtttgttgaattatttgtggaatttattttagtattgcttacagtgatacacatcaagtcacacactcataggtatttattgaacaactattaaattaaatgtttattgctattttaagcagttagggtactatagagtctctgaggcaactctcagtctattgaagatataagatacatatgtgaaacaagtaatgtccttaaaatatggagtaagattaattattctaacgaaatggaagctcagaagagtttaagtgtccaccaaggatcaccataaataaatggcacgccaatattagagcccaggtctcgtgactcctaccctagagatattttcatgacaacatggtgcttctacttgttccttttggattattaagtccccaagtcaaacaataacaagttatatggaaacattctcaggcaaggaatagaggcgtaaaattgaaaacatgcatcattgttcatggtggtggtgaggctagtggctgattgtagcagaaaagcatagctaatccaatataaatttcaagccaacttcaattttcagattgtcttcagactgtgtaaaaacacagccaattttttttattattattatactttaagttctggggtacatgtgcataacgtggacacaggaaggggaacatcccatatcggggcctgtcgtggggtgagggcaagggggagggaaagcattaggagatatacacgcagccaattttttaaaagtcagtcaaaaaatcattgctttagaaagttgaatctgtaaattttgaaccattcgctgctttagttttccagggttatccatgtctctagcatgtcaatttacacagtttttcatggtgacaaaatcatcctgcccctgagatgcttctgtagttagatttgtaactggggtagtatggcagaaaaaggctgtcagaaccaaaaactgtagaatgtagagatgagagaaagcttggcaatcaatgaaaatggtgatgattttcaggtgaaaaaaaaaaaaatccaaacttagggaagaagaaattgtatttgaaaagactgctgcaatagaagcgggtattgcaatagggagtgcactccgactgtaatatctacaagcatctccgagttcaggcagaaaggcttttctttaataccgaggtaaacaggaaaagaaaaagctgggtaccagagcattgggtgagtaggtgtggtgatcaggtatttgagcaggaaacgtcttctttgtggttagccagttctgagcggtacggtgaggggtggtagctctactttccagtgcttggttaagctcccaacacttgtttaaattcaaaggcagtccaaagttctaagtcctggtgaaagcaagaagcctgaattaggtttggtcaagttatcaaatattattttcagattggttagcagggacaaacaattcagctagtaatttccaagataaaaaataggaatttggaaggtttgtgtctcactttgttatagtgtttgtaaacaaacaagggattcatctatgaggtttatctaagtaatatggagaagaatgggtgtttgtagtgagtcatttctggaaacacaaaaaggtgggaagttttttgacccttgctgcttttcaagaacacaggtaaagttcattatcacaggtgagtccactggaataggaagaatttttcaaaaattgtcattggtgttcagccaacagtgattacaagaaaggatttttctcatagtagacaaatagtagtggctttttaagcagaaataactgcaaagtaaaagtgtaaatattacaagctagatgagaacatttaattttaatgctgagcttgccaatcatctcttgggttggactcctgcttataaaacctggcactctggtttgtaaatttgtccttaaaatgtcataacatgagtccataagcctggtgccaagggtcaaagcaaaaattgcactggacttggctggggatgttggctcacacccgtaatctcagcactttggaggcctaggtgggtggattgcttgagcccaggagttcaagacctgcctggccaacatggagaaaccccatgtctactaaaaatagaaaaattagccaggcatgttggtgcacagctgtagtcccagctacttgggaggctgaggtgggaggatcacttgagcccaggacgtgaaggttgcagtgagtggtgatagtgccacggcattcagcctgggccacagagaaagactctgtcaaaaaaaaatgcactggacaaagttacacatgcaaagaagacttttaaaagccaaatgcaatagaggaaagaagccagaactcagtctgagctctaagagatggagaggttttaagagctgggaagagactagaggattataggtcacctgtgtttgttcattgccctaacccaaaacaagcataaactttcaggtatctttatgataagaggtagttttacttttgaagcaagttgcctgcagaagttaggcacttaccctcttacagaaactggaagataaggacacgcttccatgaagatttcaatagagatggctccaaggtccttgagaaagactcctgggctataaaagtagcaaggagttttggattttttggtttttgtttgtttgtttgtttgtttttgtttttgtttttttaattacatctcaaggaggcagataaagatttgcaagttttctaaatgaacagctctaagaaaagggaggtcaggaagaagactgtctaaagtttagtcaagttgaggagaatgtcaaagcattcttggccacaagtaagctaatagactggcacctcaaaaccaactaaattgataagacccatccatgggctcaatcagctagaggacagtcacctgtcccaaaacacccagccagaaacatctggcaaatcttacccttacataaaagcaaatgattcattgtgaaaatgattctctcttagcaaccaccaatgtatgagtctcaaaagcctcttgaggggttgctgagtacacctcccttcccactatccactaacctccaggaagaaaggcgagctcgcctttaaaaagggattttcaacaaaagagaataatctcagtaattagagtcgaaggttagcctttcaatttctattcttttattttaccagctacaagtgtgtatcaatttttcagattaattcctaaactagcattatcctgtttcccctctctcaaaattagaatttcacttctaagattcataatgaattttatacatagaatggaatataattttatgtagcaattatgttgtgctttatcctaaagtggacttgaggtggtttataaagatacatacttttttaatacatccaacaaatatatattcagaattagctgcagtctagatactgtgttagaagtgggtgatgtgatattgaacaagacatggttcccatttttaagggacttagggtctctgaggtcatacagactgacaaatcaaactgtaagagtttgatggatttatgtggaaaataaataagggcgtacttatttatttccaagaacgggcattgatacaggttgctagaaaataataggaaggacaatcaaggtgatacagaggctaatgtagtacctaaaatgtatgcctcgaggtcttagacttttccctggagctttgccaagtgatgaccttgagcttcctagcaaccaatgcaaatacggaaactacatttagttgtgtagttcacagtgcctctaaaataaaagccaacatttcctctgtagaaacagaaaaccaagaggtgcctcttgttaaccctcatgcttcattccacggtaaattttttatcaataacattcttataaaatctcagagttttatagagatgcttcttatgttccttcttgaagggtaatgtggtggtgtatttatgtgtcaacttcacaaggccacagtagccagatatttagtcaaatagcattccacatgtcactatgaaggtattttttaagatgagactaacatttaaatcagtagactttgagtaaagccgattcccctcagtactgtggatggcctcatcaaatcagttgaaagcattaggagaaaaacaccgaggtcccctgaggaaaaaggaattctgcctcctgactgccttcaaactacagctacaacaaccaccctttctagagcctccagctgctggcttgccctgcagattagggacttaccagcccctacaatcacatgagtcaattcttaaagatacatctctttctgtatatatgcacttatcctatctatccatgtttctctggagaaacttggctaataaaattaaaggctttacatccaagtaccatcaacagaaacagtttttcacagggtcagtacaatgtgctacatgtataaagctctctcatggtctggctgaataaaagaaaaatagtagaacatctattctacttcaagaactcacccaagaataggatttctcaaaacagaggtttaggtaacaattttaagctttctgagtgcttgtaaatactttctttataaatgtttatttaatcctcataagaaatctataaggcatattctatcattattttcattttacaaataaagaaactgaggtacatatcttctccaatatcacacaaggtagcaaatgccagagccagaattcatcctcactgcttagttttacagtctaagttctcaactactctgctgaagagtgaataatttttagtctgcagaaagtttaaggttaaattcactggtctggcaggtatttggattgaattaagattagatctgcatgcctcattgtctgcagaaccttgcatagaaacatggtatccagaaggcctctccccctccgtggagaagaatgttgaagaattgccaagaacttcctcagaacacaagtttgggtttagttcaacatataggagactgagatcccaaagttgtgcatcataaaacatggaaagaataacttttgcttagagaatatgatcttcagtttactaaagcatgctgtgtccacagaagtgttctttttaatttcaatattcatgaaacatctaacttttaagtgatggaattttccagtgacctgtataggataaactggctgcaaaatataatccaaagtgaccagtattaattatccaattagatatgcactaaaaattatgattagagctttgaaattgtgaattgagaatcatacatccagataatgattatatcagaggataagatatgtcatatggctctattatttcatgaccataagatcatgttataagaggaaggatgctacaggagatatgtttttctttctctgagttgtggtgaggaagctaatatatccagctcatcaagaagtagtagcaagtcattaatgggaagagaagctaaaacacagctttgttttgtctcactgtgaattatccagaattggccccttggagggatcattaccacaaacctggacactcaaggtaagattaagacataggttatgtataagcatataagctggagaatcataaaggtgaataaaagctgctgatagtcttaggttttttggttttgttttttgttttccctcatagaatttccatcaaagtgaaaaagagcataataataatcaaagaaggattagctgtgttcccagagctcagtagcattcttttcaaatactgtcctgagaagcccagacttgattttttgtcactgtaggaaaccactatgagttttggatgaaatgtctcacaactagtgagtagttgcaattttaaaaggagtagcatgcttctaaatttttttattcttaaaaataaattttattctaataacttttttttttttttgagacagagtcttgctctgtcaccaggctagagtgcaggggcacaagctcagctcactgcaacctccacctcccgagttcaagcaattctcctgcctcaagctcccgagtagctgggattacaggcaagcaccaccacacccagctaattgttgtatttttagtagagacggggtttcaccatgttggccaggatggtctcaatctcctgacctcttgatccacccgcctgagcctcccaaagtgctggaattacaggcatgagccactgcacctggcccatctaataacctttttcaacattagccctgagcaggattaataataattctgaggatacaaatgtcaaatttctcagatatgtttacagataaagttttgtatcttatatagatttatagtgtatagttgtcatttgagttatgtaatcagactgatttgaatggttttagatatatttctatacaagctctgaccatctgatgcctttaataagaacagcaaagtctatgccaggtggttcttgtgcctagcctgggagggatttcacatggttgctccttcctgatcctcctcttcatgagagcagagggacattgagcacgggaatcatctgttggggtccttctcttgctgtccagccttcctagtgactcaagtatcaggaaagctgaataaagaatggagcaaattcatgacagggcctcctcctctcttagggtcttcaaccacctcatgacctccatggacagattcggctgccaccctttcctaaaaagagggatactcccacaagtcactttcagcaaacagcctccacaacaaggcagttctgctggaaacttttcttcccttttgtttcagaatcttggagcatgaccagcttttaggcaattatccatttccttttcacttccggagttctttatatccatcctctacgcagataaatcatatcagatgacccatccaattggagactttggataaagcagtttatttgcacaatctcactcttggtcattcctcagacaggtgagaacttgacccacttttcttcatggagagatgcaagtataaaacatgacactaattatgctttgaactgaggctctccaattatgatcatgtctcccaattttactaacccatgtactcatttggcaggaagcctgtttgctaagctcccttgaagagaaaaacatgagggtgcatatgaagctgtactggggctggttaactcagatggtgtggtgctcatgatggagcaccagcctcagtatgagcccagcgctattctcttgccgcagagaaaaggcatggaggagaaggccaagacaaacctctatccctgccaagttcagcagtgaatcagagagtacttcatagaaatccattctgtggcctcctgaacagggaccaggcattcataatcagcacagtttattttaattgagcagcagatcatttatctgatgacaaaaattttattaggattttcagaatgcttgaattataagtacagtgtggtctttttttttttatatttttatgagggtatcaaaagcatcagttcctagaggttgttatatatctatctatatataaattttttaaaaggtaattccatgaagtgtgctgctattattgtggagtagccaagaaattgttcaccaagtatacagatttctcaggaacccaagcacagaccctctgcctgaatatttacccagcatgttttctaggacatcacagagctgaggttgcttatgtttctgttgacatcaacatgatgaccatgtgtttatatagcaggatgctagcccttgtccacaatttcaaatgcttcactccaccacagctgtgcagagaccttccctattataatgagtataattaacttccagagttgtaattctaacatggtagatttttcagaatttatcagttgacactaaaaaatctgcatattatttcattcttaggggaaattatcttactttctttaactatgtatacaagaaaagatagtaggccttcatgggtacttgcctagctgtataaagtattcctggccaggcacgttgactcatgcctgtaatcccagcactttgggaggccgaggcaggtggatcatgaggtcgggagatccagaccatcctggctaacacagtgaaaccccgtctctattaaaaatacaaaaaattaaccaggtgtggtggcgggcgcctgtagtcccagctacttgggacgctgaggcaggagaatggtgtgaacccaggaggcggagcttgcagtgagtggagatcgcaccactgcactccagcctgggcgacagggcgaaactccatctcaaaaaaaaaggaaatctgttgaacaaaaaaatatatggcagagaaaaaaaaagaagaatggggaaaagaggagggggcatttctttatgaacacacttgtctttttagttgtgtaggaggtgggccagcaaagtaggactaataactttactgtctgaagaccactgtgttgaatctgatgacctgctgaggtctacactaacttaaaaagtctatgattctgatgaaggattttgacccccaaaatgtatatacattataattagttatattagcaaaatacataaagataatattggagaagtatcttccagtgacgagaccacatgattctgtattcccaaggcagaagtttctggaatctaaattctccccatggaatgccatgtcattatcagccctggtttgtaagtaatataaaagtgttccatgtcctgtcctgaagggagaaggtcatgatgtgtgcctcattctgctatttggcaagggctttgaatatttgcagcttttttttcttgtaaatttttgtttttaatgaaagtaaaatcacatgtgcatccaaactcaattgaaagaaaagagttgttagcactttataataatcatcacacaccatcacgctacaggaaatagcatgtagtccattgttgttttggtaacataccctggtacatcatctgatagatgtcatattaaatgctttctttttccaggggagagaaagagaatattgaaatataagattgacctgatgcagtataaatacccatttgccccaataatttatccttttttctgaggacaaagaattttttttccttttctgactaggacaaaagcaattaagagctaagttattaaaaaatccattatcagatagcagagtcatttactgatataatcagaaaaactaaagggcagtttgagatgtcaatgaggaagaatttgaagagaaagaaagtcatacactgctaatattggttggtaacaaggtgcacaaactctggtgagttgtggccattactcaaccttattcataaaagcatttttccctctttgattccaagctgaatctagcttctgcagtcaattttctaatgtaaacggcgagtgttctgtatagattatttgtttatttattgccccaagtcagctcctggtgagttgagccttgcttaaacttactttctcttcctctgcagagttataaggctcagcagggccatagctgcagtctccaaaccttgcctgaccttgagcttcaccttgtctactataccaattttaggaacattctagaaaagcttctccagggcagtgactaaccccaggtacccctcgcacaatggaacatttgcaaaccttgcagcaatcacatctgttttgttgacctcagagactgatctatcatttcaaaaagaaacacaagaatctcttattccctagaaaaagaacattgtacaaaagaaaaatttgccaggtttatttgaaaatacacccataggtaggcttcttggaccttgaactactaaagtaatgcagagaattctcttcacttacttacggtcctacaatgaaagctgatgatgacctttaaaaatgttatctcaccacagaataataaaaattattaaaatagcttcaacatctctccttgtatgtaaaaaaacacaccactttacctgcagtctagcatgttttggagcattttgaaagattttcagacaatagaaattttttaccccaagttatggttacatagaagacaggtattcaaattacttaaattattaaaatagagtagggcaccctgcctatgctgtcactgtcaacagcactgagcattggagtagataactactgtcacaaagcaatgtcagtctctagccaagcatgtaggaagatggacacatcttaaaaaaaaaaaaaaacaaagtcaggtgggttggctgtaatcccagcatgtaatcacgcctgtaatcccagcactttgagaggccaaggtgggcggatcacgaggtcaagagatggacacaatccttgccaacatgatgaaaccctgtctctattaaaaatacaaaaattagctgggcttggtggcgtgtgcctgtagtcccaactactcgggaggctggggcaggagaatcgcttgaacttgggaggcggaggttgcagtgggctgagatcagccactgcactccagcctgatgacagggcaagactctgtctcaaaacaaaacaaaacaaaacaaaaaaaagtgttggatatctcatgtaatttattgcatactctactgaaaatgaaaaagaatagtcgtaaggtactcatgttttgttttcacaccattatacagtcaaaaaatcctaaaacaggctgggcgcagcggctcatgcctgtaatcccagcactttataaaaataaaaaataataaataaataaataaaaccttggtcttcatttgttcaagttgcttttcatcaaatggttgaaattagggcttcacagagatcatttcattacagttttgcggtcagtgtaaccccacatttaatactcccatttttgagagaagataaatattttcattaaataactcaaaaagttagctgcacaacttgttttagaacaaaaccttttcatagcatgtgcccccacctccctttatcatcacccaagtacttgaaaaattacaagaagaaagaaaacatgatgacaagaaaattgcttctgaattatcatgttctacagaaagaaaggtatttaagaaaacatttaaaagataattaaaggctaaaaaaaaggagttttgtggcaaagggattcaaatttctgttgtgcttcagctgtggagctgacccatgcctgttttctgagtatttgatccatgcgaagcacagccaaatgggacacctggtgctgtggttgccagcagtgaagcggacatgtatcagggttctactcaatatgcaaaccattttcagactttatagtaatttaaaagttcctcttaaagtatcctttgtgtgtcaacaaaaaagaaccaaaatgctgtgtacagagctttcaggggggtagagattggatgctgtaggctgcaaagtgagacagccatccccagttgtcctatagcacagtgatttccaaacttttcttgggatcaggactgctttacacccttggaaattattaactatcccaaatatcttttctttgttaaaatatttgaaatatgcctattagacatttaaaatatcattttacatttatttttctatttaaaataataataaactcattgtcggttaacaaaaaaaaaagttttaaggaaaagtaacgtatttttcaaaacaagaaaatttagtgagaatagcattgttttacattttttgcaaatttcttgaatgcctggctgacttgaagacagctggattctcttatctgcttctgcacttcatgcgttcaattcaactatatgaagtatgtaaagaaaaatctgggtccacagagatattgatcataaaaagaaagaatcttttcataatcttttttaacattatacattattctttgatgctacaccaaaacccagagcagaagttttttaaaagttagttgcaatgaggaatctgagaccatatcaataaactttttatcctcttatattaaaacctagtagtctatcttgtactttcaatggatcttgtactctgcacaattttgtaatatgatcattaaccatttgaaaaatatcggctgagttatgcaggtcttccaaatgttaaaatctttcatttatacaatatcaaaaaatcatattcattcatatcaccactaatatcatcagaaaagtctttaagtattgggaagtgatcaagctcatggtggcagacacgttttccaaaattctgattttcatttgaaagctcgaaatttattattggcaaaaaaataccatctattgatttcctttaagtggcaggctcacacactttgtacttaggaggctgaggcaggaggatcatttgagcccaggagtttgaggtacagtgaactatgattacaccactgcactccagcctggtgacatggcaagaacctgtgtctaaagaaaagaaagaaaaaaaaaaaggaaatgtctttcaactgcttatttgtaatttgttctctccagtaagaattttgcttcctgaaacaagtagctagttcagattgcaactcaattacaaaatgtttttccctgagataactatagtacttcagtagcggaggaaatgcttttttaaaacctcttatttcatcatctgcaatattgaaagaacatatacttaaggactgagatttaatacaattaattttcactgattcactaatgccattcgtatgtgaaattgacttcgtgctgtgttttgcttttgtttgcttttgttttatttttctactgagagtgctttgaagtgaagagctacaagatgactttaatggtttggtgccactgtttttatttgagctaaaaagtaccagaagttttaccactgttgcttttgtaccattaatgtgcaaatagcaacacagtgaaaagccaaataatatatcggcattgttgggaaagcagttatagctttgtgaactcctgcaagaatcttggggacccccaaggtcccggcatgacacattgagaactactgggatatgaaaaccaccccacagaaataaaatgatagaaattatctacagagatcaattatgaataagatttatgtagttataataatggaatcattaatattgatctaaataaaattaccatatatatcaggaaaggggaagaggataatgtgtgttgatggtggatacaaggaggtgaaagagttaaattctgtcatctaaaatgggaagtaaatacataaattacctaaaaacctaaaaaacaaaaaaaaactcacaaaatcattaattcacaatatatggtaactaacaatagaaactactgcaagagttatatataaactgttgtcctgacttccaatgctttacatgatttgctcctcccttagctctgttctcatggcttaccttacctttggctgactccactccagccatacaggctttctagacttctgtatacacaccaagcattgctgcttacttaattcttctgtgttgtcaggtctgcctggaccacactttgcccagaaatgtgcatggttaatctctcattacctcaggtatttttaaataaggctcatgtgactactctatctctacatctttcctgtgctcatgattcatcccctcttgctctattttcccccaccattcctagtacaatcacacatactgtatactttatttagggtacttattgtcttttgtctgtgccttcccactctgatagaatataaattctatctaagcaattttacctattttattcactaatgaatcccaagcacctacaacagtgtgtgacatatagaagatgctcaataaatacttgttgaacatatgtttgaatgaggagcagaaaatggtgaggtaaaacaggtaagagtctgctatttctcataggaaaccttatagaaccatttgacttttcaatgtgtgcaagtataacttcaataaaaataacagacaaatttatggaaataaatatataacagtatcctgtcagaattagtagagactgtaaaatgtaaatttaggagttgtgagagaaaggaggacaggatgggagctgagaagaagaaccaagaggagtttgaggaaggtagggagaacaagacaaggcttgctgaaatgtcgtggttggaaaaagccttattgaaagtcccacaggagaacagaacacagtctacagcactgccactggctcttataatcgcttcttttttaaggggcttattaagatataatcaatatataaaaaactacacatatatgatgtgcataatttgatgagtctagacatatggatacacctgtgaaaccatcaccacaataaaggcaatacatgatacatccactccaaattttttttgtgcctcccccgcacttggccaagtgttcttgtgcaaggaaaaccctacatcaaccattcacagcagctctgatagaatgagtcctggcagaagtcagtgacaacaggacccatccttctcttcctcaacaaacccctagaatgagtttgcagcaactctagcccagaaatctgccagatccctcctagaaggaagctcagaaaaatgaaaggcaaagaaattgaaaatgactaccatcagaatcatatattttaatggagggagatagatacttaaaatgggaaagcctgaaggtgagaaggtaaagggtcaataccaaggagaaaaaatggcacagaaagcagagactgatgatgaaaataagtgtgaatatttggtgtcaggtgctttcctgttttaatggaaaggaaagagtttaagaaaagggagcaaaaaagactgcaaccaaggcatcaaaatgaaacagaaagggcacaaaaagctccataatttggcttagagtcaactctgtttttccttgatggcctgtgaacaaatagaagccacaacagacatgcctttgcccataggtacatacaaagcgcagctcaaacccatagggccagtgctgcttcaccaggtttagaagatttgtttaaacctcatctgcatcattaaaaagaggcatcagtctttaaatcctccattcatttatggaatggttattgaacgcttcctatgggccaggagatattctgagtactggggacacaatggtgagtgaaaagaaatgtgatcccagatcttgtaaaaattcctattaatcaggatttcctgaaataaataagtcctatggaggagagaaatgctggcgtggactgccgtgagagcacataagaggagaatttaacctggttgcaaactttggtatcatgtccataaatagtacgattgaccagtgatctgaagatgagtaggcattatgtgggtcagtacattttagacataatgtagggaatgggctgggtaggggtagatggaaaagacagttaagaggtaagcagggtaagtgaaagttgatagtcacccgagataatattgtgcctgtaaagatggagaaaactgaatttaagtgtaactgaggtggtaaagtcaatagaacttatgaagggttggagatgtgaaggtaggtatcaaagatgatgacttgatgtttagattctgcaaccagatggatggtgttggcaaccattgaataggcaatatctgaagaagactttaagatggaggcagaaatgacaggctggagatcatgagtttaatttgggacttattaaatttgagatgtatttgggactttcaacagaagatattggacaaggagatgagtaagtctacaactcagagcaaaggcctgcatgggagaaatgcatgcatcaatctatccatgggtggcaattgaacctgtagagtacatattgtctcttagagagtagagtcaggggacaagagaacctacaaactgttacctataatatataatgaggaggtagcagaaggagatccctaataaacccagagataaaacaggcaaagagaaaggagaaaacagcatgctgggcagcaccattctatacgacaattttattttcagatgggaggataaactatccagcatatttttttccacataggaattgtattaagttcatggaagatgtattaatatctgtaagtgagattttaaaagttgtttttctctaatgactttttattgggatttaccaaatccaaacagaaatttcttacctctcagcgatagtaaacaatgaataactcaaagtaaaaattaagtgattcttggtcacctccaatgtccctgactcctatgaaagattaatgaacaatcctgagaaaagttggaacttacatattcaaaaatattctgtgatgagctaagaagcaattatgaagctgggcatgttatgtgaataagcataagactataaaattattactctcaagttcaagagaacaaagctgtttaaaattattcttaactaaatggtatttctgataagtataatatgaattcaggaatgacaatatggcaaagatggctggtagtctgccagaaatttattctccttttctttctcaaactatatttttaatggtaacagttaaaggactacatgccctggtctctcttatagctgagtggctgagtgcctgtgtgatatgatagaagtactatattgcatagggacttctagaaaatctccttaaagggaaaggttgcctgtggccactttctcattcctgttgaatgaaatgaaaaagtgaaggctatcactgaagcagccatcaaaggccatgaaactaaatgctaagaataatggagcagcaagagagaatgtgccttcatcccagatgactatggagctaccatgagtcctcactcatgactggacttccttcatttatgagaactgtaaatgtccagctagtttaaaccattgttttgatgggcttctagtatatgaaactaaacctagtcctgaacaacttaaggttgtgaccatggaagaaattacaacagaggtaaaatccagttgagactttaagagtgaggaggggtaatggagaacagcagctttaaagaataatgttataatagaacattaaataaaatagattcaggattatcaattaagatggcagagacgaggcaggactagcttgcagctctcactcggatggacagagcagcaagtggagactcacattgtgaacttttgctccaagaactactgcatgaacatatcaggaaagccaagagaatccacagaacctttgaagaaactggatcaatgctgtaggctccctgagatgccacgaaactgtgagtctgcttgatttctcagtgggggggcttgtggtctggggcaagttctcaatcctggtcgccagttgcctgcaaatagacttggtgctgttgggggaacaaaatgggagtgaaatcagtgtttaggactacgggctatgtgagagcagggtgaggcctgtgactgccagctttcctccacttccctggcgacccatatgactcagcagaggcagtcataatccccctgggaacatagcataactccattggcctgggaaccacacccccatcccccacagcagtcacagcaagtcctgcctgccaaaggagaatctgagctcagacacacacctatccttaccctcacctgatggtctttctccacctgccctggtagtcaaagacaaaggtcataatctcttgggagctctatggccctgcccaatgcctgagaaacctgattacttaagtgggtgtccttagggcaagttcacatccttcctatactacagcagctcatgcgttcttgaaagtgccacctcctcgctggaggccaaccaacacaaaaccagtgcacaacacaaaaatataatcaaggacccttacagagtccatttcacccccctggtacctccag
